United States Patent
Tuch et al.

(10) Patent No.: US 10,662,479 B2
(45) Date of Patent: May 26, 2020

(54) IMMUNOGLOBULIN EXPRESSION LEVELS AS BIOMARKER FOR PROTEASOME INHIBITOR RESPONSE

(71) Applicant: Onyx Therapeutics, Inc., South San Francisco, CA (US)

(72) Inventors: Brian Tuch, Brisbane, CA (US); Jeremiah Degenhardt, San Mateo, CA (US); Andrea Loehr, San Francisco, CA (US); Kevin Kwei, Mountain View, CA (US); Christopher J. Kirk, San Francisco, CA (US)

(73) Assignee: Onyx Therapeutics, Inc., Thousand Oaks, CA (US)

( * ) Notice: Subject to any disclaimer, the term of this patent is extended or adjusted under 35 U.S.C. 154(b) by 0 days.

(21) Appl. No.: 14/910,668

(22) PCT Filed: Aug. 8, 2014

(86) PCT No.: PCT/US2014/050333
§ 371 (c)(1),
(2) Date: Feb. 5, 2016

(87) PCT Pub. No.: WO2015/021376
PCT Pub. Date: Feb. 12, 2015

(65) Prior Publication Data
US 2016/0177402 A1 Jun. 23, 2016

Related U.S. Application Data

(60) Provisional application No. 62/005,904, filed on May 30, 2014, provisional application No. 61/875,954, filed on Sep. 10, 2013, provisional application No. 61/863,809, filed on Aug. 8, 2013.

(51) Int. Cl.
*C12Q 1/6886* (2018.01)
*G01N 33/574* (2006.01)

(52) U.S. Cl.
CPC ..... *C12Q 1/6886* (2013.01); *G01N 33/57492* (2013.01); *C12Q 2600/106* (2013.01); *C12Q 2600/158* (2013.01); *G01N 2333/70535* (2013.01)

(58) Field of Classification Search
None
See application file for complete search history.

(56) References Cited

U.S. PATENT DOCUMENTS 8,278,038 B2 * 10/2012 Bryant ................. C12Q 1/6886
435/6.1
2006/0281122 A1 12/2006 Bryant et al.
2010/0099090 A1 * 4/2010 Tsuchihashi ......... C12Q 1/6809
435/7.24
2012/0015906 A1 * 1/2012 Shaughnessy, Jr. ........................
C12Q 1/6886
514/64
2016/0008382 A1 * 1/2016 Blakemore .......... G01N 33/574
514/19.3

FOREIGN PATENT DOCUMENTS

WO WO 2013/071142 5/2013

OTHER PUBLICATIONS

The Free Dictionary definition for "measuring"; available via url: < thefreedictionary.com/measuring>, printed on Sep. 20, 2017.*
Fostier et al OncoTargets and Therapy. Sep. 27, 2012. 5:237-244.*
Caraguel et al., Selection of a cutoff value for real-time polymerase chain reaction results to fit a diagnostic purpose: analytical and epidemiologic approaches, J. Vet. Diagn. Invest., 23(1):2-15 (2011).
Dempster et al., Maximum likelihood from incomplete data via teh EM algorithm, J. Royal Statistical Soc. Series B, 39(1):1-38 (1977).
Flicek et al., Ensembl 2013, Nucleic Acids Res., 41(Database issue):D48-55 (2013).
Gray et al., Genenames.org: the HGNC resources in 2013, Nucleic Acids Res., 41(Database issue):D545-52 (2013).
Hajek et al., Design and rationale of FOCUS (PX-171-011): a randomized, open-label, phase 3 study of carfilzomib versus best supportive care regimen in patients with relapsed and refractory multiple myeloma (R/R MM), BMC Cancer, 12:415 (2012).
Hu et al., OSA: a fast and accurate alignment tool for RNA-Seq, Bioinformatics, 28(14):1933-4 (2012).
International Preliminary Report on Patentability, International Application No. PCT/US2014/050333, dated Feb. 9, 2016.
International Search Report and Written Opinion, International Application No. PCT/US2014/050333, dated Oct. 10, 2014.
Jiang et al., Biomarker-adaptive threshold design: a procedure for evaluating treatment with possible biomarker-defined subset effect, J. Natl. Cancer Inst., 99(13):1036-43 (2007).
Keats et al., Development of Methods to Perform Next Generation Sequencing (NGS)-Based Genomics Studies on Multiple Myeloma Clinical Samples, Blood, 122:5347 (2013).
Ling et al., Response of myeloma to teh proteasome inhibitor bortezomib is correlated with the unfolded protein response regulator XBP-1, Haematologica, 97(1):64-72 (2012).

(Continued)

Primary Examiner — Carla J Myers
(74) Attorney, Agent, or Firm — Marshall, Gerstein & Borun LLP

(57) ABSTRACT

Methods of treating a tumor in a subject and methods of determining a treatment regimen for a subject with a tumor are provided herein. In exemplary aspects, the methods comprise measuring the level of expression of immunoglobulin, FCGR2B, a gene listed in Table 4, or a combination thereof. In exemplary aspects, the subject is a subject from which a sample was obtained, wherein the level of immunoglobulin, FCGR2B, a gene listed in Table 4, or a combination thereof, has been measured from the sample. Related kits, computer readable-storage media, systems, and methods implemented by a processor in a computer are further provided.

13 Claims, 10 Drawing Sheets

Specification includes a Sequence Listing.

(56) References Cited

OTHER PUBLICATIONS

Mackay et al., Real-time PCR in virology, Nucleic Acids Res., 30(6):1292-305 (2002).

Meister et al., Extensive immunoglobulin production sensities myeloma cells for proteasome inhibition, Cancer Res., 67(4):1783-92 (2007).

Mulligan et al., Gene expression profiling and correlation with outcome in clinical trials of the proteasome inhibitor bortezomib, Blood, 109(8):3177-88 (2007).

Obeng et al., Proteasome inhibitors induce a terminal unfolded protein response in multiple myeloma cells, Blood, 107(12):4907-16 (2006).

Odell et al., Immunofluorescence techniques, J. Invest. Dermatol., 133(1):e4 (2013).

Rody et al., T-cell metagene predicts a favorable prognosis in estrogen receptor-negative and HER2-positive breast cancers, Breast Cancer Res., 11(2):R15 (2009).

Søreide, Receiver-operating characteristic curve analysis in diagnostic, prognostic and predictive biomarker research, J. Clin. Pathol., 62(1):1-5 (2009).

Tuch et al., Immunoglobulin expression is a major determinant of patient sensitivity to proteasome inhibitors, Blood, 122(21):1903 (2013).

Tuch et al., U.S. Appl. No. 61/863,809, "Immunoglobulin expression levels as biomarker for proteasome inhibitor", filed Sep. 2013.

Van de Donk et al., New developments in teh management and treatment of newly diagnosed and relapsed/refractory multiple myeloma patients, Exp. Opin. Pharmacotherapy, 14(12):1569-73 (2013).

Kawano et al., Multiple myeloma cells expressing low levels of CD138 have an immature phenotype and reduced sensitivity to lenalidomide, *Int. J. Oncol.* 41:876-84 (2012).

Vij et al., An open-label, single-arm, phase 2 study of single-agent carfilzomib in patients with relapsed and/or refractory multiple myeloma who have been previously treated with bortezomib, *Br. J. Haematol.* 158:739-48 (2012).

\* cited by examiner

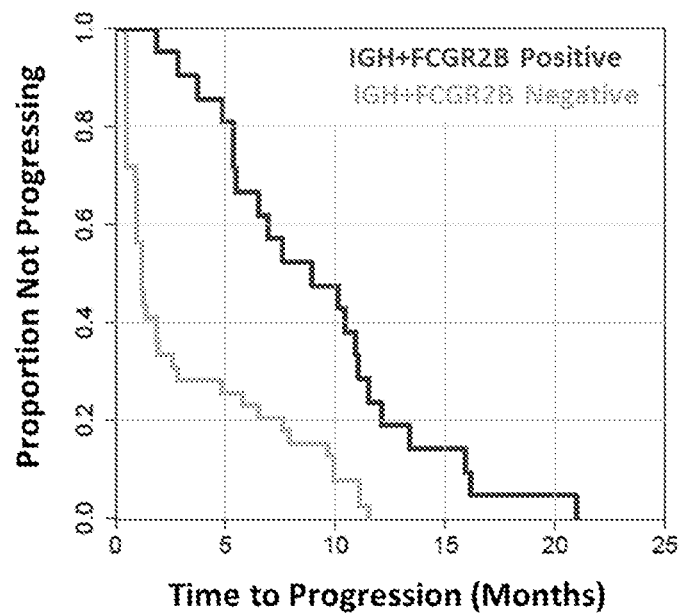
FIG. 9
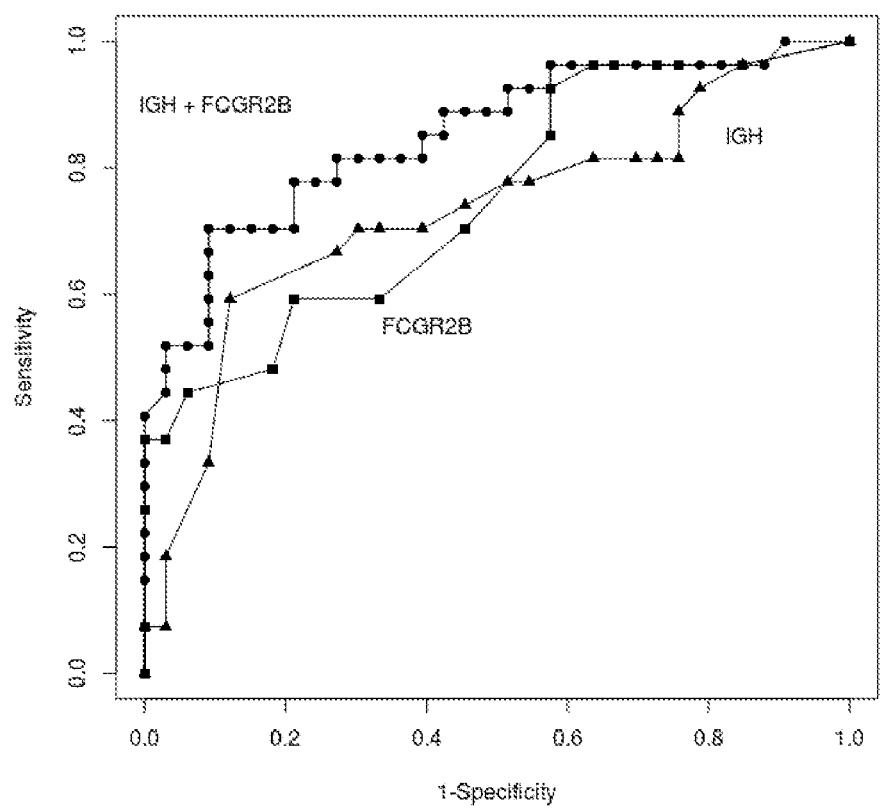

IMMUNOGLOBULIN EXPRESSION LEVELS AS BIOMARKER FOR PROTEASOME INHIBITOR RESPONSE

CROSS REFERENCE TO RELATED APPLICATIONS

This application claims the priority benefit of Provisional U.S. Patent Application No. 61/863,809, filed on Aug. 8, 2013, Provisional U.S. Patent Application No. 61/875,954, filed on Sep. 10, 2013, and Provisional U.S. Patent Application No. 62/005,904, filed on May 30, 2014, each of which is incorporated by reference in its entirety.

INCORPORATION BY REFERENCE OF MATERIAL SUBMITTED ELECTRONICALLY

Incorporated by reference in its entirety is a computer-readable nucleotide/amino acid sequence listing submitted concurrently herewith and identified as follows: 46,919,680 bytes ASCII (Text) file named "40058A_SeqListing.txt," created on Aug. 8, 2014."

TECHNICAL FIELD

This invention relates to the fields of molecular biology and cancer treatment. In some aspects, the invention relates to determining (e.g. predicting) a tumor's (e.g., a hematological tumor) sensitivity to treatment with a proteasome inhibitor. In some other aspects, the invention relates to methods useful for diagnosing, classifying, profiling, and treating cancer.

BACKGROUND

Multiple myeloma (MM) is an incurable malignancy that originates in the antibody-secreting bone marrow plasma cells. MM comprises approximately 10% of all hematologic malignancies. The progression of the tumor is well understood, and it can be diagnosed by the presence of multiple myeloma cells in the bone marrow and monitored by the amount of antibody secretion from the clonal population of plasma cells. With conventional treatment, median survival is approximately 3 to 4 years, but the clinical course is highly variable and difficult to predict. Several therapies for MM are now approved and many more are in development, promising improved outcomes for patients with this incurable cancer. With expanding treatment options, however, comes a pressing need to pair each patient with the most efficacious and safe treatment. With the narrow therapeutic index and the toxic potential of many available cancer therapies, such differential responses potentially contribute to patients undergoing unnecessary ineffective and even potentially harmful therapy regimens. If a designed therapy could be optimized to treat individual patients, such situations could be reduced or even eliminated. Furthermore, targeted designed therapy may provide more focused, successful patient therapy overall. Therefore, there is a need to better define patient-specific treatment strategies for the use of both standard and novel therapies.

Proteasome inhibition has emerged as an important strategy in cancer treatment, including in the treatment of multiple myeloma. By way of background, proteasomes are large, multienzyme complexes that play a key role in protein breakdown. The average human cell contains about 30,000 proteasomes, each of which contains several protein-digesting proteases. The proteasome mediates the proteasomal degradation pathway which is necessary to rid cells of excess and misfolded proteins. Proteasomal complexes help regulate a whole host of functions including transcription, viral infection, oncogenesis, cell cycle, stress response, ribosome biogenesis, abnormal protein catabolism, neural and muscular degeneration, antigen processing, DNA repair, and cellular differentiation. Proteasome activity is exquisitely controlled; when it becomes either overzealous (degrading more proteins than it should) or underachieving (neglecting to degrade certain proteins) disease can develop. Proteasome inhibitors (PIs), such as carfilzomib (marketed as Kyprolis® by Onyx Pharmaceuticals) and bortezomib (marketed as Velcade® by Millennium Pharmaceuticals), have become a standard therapy across all lines of MM therapy. Carfilzomib is a tetrapeptide epoxyketone, a selective proteasome inhibitor, and is approved for the treatment of patients with multiple myeloma who have already received at least two other treatments including bortezomib and an immunomodulatory agent (e.g., lenalidomide and/or thalidomide), and whose disease has progressed on their last therapy or within 60 days of their last therapy. Despite extensive study, the mechanism of selective tumor cell death following proteasome inhibition is poorly understood. Many patients have disease that does not respond to PIs, whereas others develop resistance, suggesting the need to better define patient-specific treatment strategies for the use of PI therapies.

SUMMARY

Provided herein are methods of treating a tumor in a subject. In exemplary embodiments, the method comprises (a) measuring the level of expression of (i) immunoglobulin (Ig), including gene or gene product, (ii) Fc gamma receptor 2B (FCGR2B), including gene or gene product, or (iii) both Ig and FCGR2B, in a sample obtained from the subject, wherein the sample comprises a cell from the tumor; and (b) administering to the subject an effective amount of a proteasome inhibitor, when the level of Ig expression and/or FCGR2B expression in the sample is greater than a reference level. When the level of Ig expression and/or FCGR2B expression in the sample is less than this reference level, then the patient is administered an alternative anti-tumor therapy that is not a proteasome inhibitor. In alternative or additional embodiments, the method comprises (a) measuring the level of expression of one or more genes or gene products listed in Table 4, in a sample obtained from the subject, wherein the sample comprises a cell from the tumor; and (b) administering to the subject an effective amount of a proteasome inhibitor, when (i) the level of expression of the one or more genes listed in Table 4 in the sample is greater than a reference level, and the change in gene expression level for the one or more genes or gene products is denoted in Table 4 as "up", or (ii) the level of expression of the one or more genes or gene products listed in Table 4 in the sample is less than a reference level, and the change in gene expression level for the one or more genes or gene products is denoted in Table 4 as "down", or (iii) both (i) and (ii).

In exemplary embodiments, the method comprises the step of administering to the subject an effective amount of a proteasome inhibitor. In exemplary aspects, the subject is a subject from which a sample was obtained and the level of expression of (i) immunoglobulin (Ig), (ii) Fc gamma receptor 2B (FCGR2B), or (iii) both Ig and FCGR2B, has been measured from the sample. In exemplary aspects, the proteasome inhibitor is administered, when the level of expression is greater than a reference level.

In alternative or additional aspects, the subject is a subject from which a sample was obtained and the level of expression of one or more genes or gene products listed in Table 4 has been measured from the sample. In exemplary aspects, the proteasome inhibitor is administered, when (i) the level of expression of the one or more genes or gene products listed in Table 4 in the sample is greater than a reference level, and the change in gene expression level for the one or more genes or gene products is denoted in Table 4 as "up", or (ii) the level of expression of the one or more genes or gene products listed in Table 4 in the sample is less than a reference level, and the change in gene expression level for the one or more genes or gene products is denoted in Table 4 as "down", or (iii) both (i) and (ii).

Also provided herein are methods of determining a treatment regimen for a subject with a tumor. In exemplary embodiments, the method comprises (a) measuring the level of expression of (i) immunoglobulin (Ig), (ii) Fc gamma receptor 2B (FCGR2B), or (iii) both Ig and FCGR2B, in a sample obtained from the subject, wherein the sample comprises a cell from the tumor, and (b) selecting a treatment regimen comprising administration of a proteasome inhibitor, when the level of Ig expression and/or FCGR2B expression in the sample is greater than a reference level. When the level of Ig expression and/or FCGR2B expression in the sample is less than this reference level, then the treatment regimen preferably includes administration of an alternative anti-tumor therapy that is not a proteasome inhibitor. In exemplary embodiments, the method comprises (a) measuring the level of expression of one or more genes or gene products listed in Table 4 in a sample obtained from the subject, wherein the sample comprises a cell from the tumor, and (b) selecting a treatment regimen comprising administration of a proteasome inhibitor, when (i) the level of expression of the one or more genes or gene products listed in Table 4 in the sample is greater than a reference level, and the change in gene expression level for the one or more genes or gene products is denoted in Table 4 as "up", or (ii) the level of expression of the one or more genes or gene products listed in Table 4 in the sample is less than a reference level, and the change in gene expression level for the one or more genes or gene products is denoted in Table 4 as "down", or (iii) both (i) and (ii). When (i) the level of expression of the one or more genes or gene products denoted in Table 4 as "up" is less than a reference level, or (ii) the level of expression of the one or more genes or gene products denoted in Table 4 as "down" is greater than a reference level, or both, then the treatment regimen preferably includes administration of an alternative anti-tumor therapy that is not a proteasome inhibitor.

Further provided herein are kits. In exemplary embodiments, the kit comprises one or more binding agents to an Ig gene or gene product, optionally an IgH, IgK or IgL gene segment or gene segment product, and a binding agent to FCGR2B gene or gene product. In exemplary embodiments, the kits comprises (i) one or more binding agents to an Ig gene or gene product, optionally an IgH, IgK or IgL gene segment or gene segment product, or a binding agent to FCGR2B gene or gene product and (ii) at least one binding agent to a gene or gene product listed in Table 4. In exemplary embodiments, the kit comprises at least a first binding agent and a second binding agent, wherein the first binding agent binds to a first gene or gene product encoded by a first gene listed in Table 4, wherein the second binding agent binds to a second gene or gene product encoded by a second gene listed in Table 4, wherein the first gene is different from the second gene.

Computer readable-storage media are furthermore provided herein. In exemplary embodiments, the computer readable storage medium is one having stored thereon a plurality of reference levels or ranges of reference levels, each reference level or range of reference levels corresponding to (i) an expression level of Ig or (ii) an expression level of FCGR2B, or (iii) an expression level of a gene listed in Table 4, or (iv) a combination thereof; and a data value that is an expression level of Ig and/or an expression level of FCGR2B and/or an expression level of a gene listed in Table 4, measured from a cell from a sample from a patient. In exemplary aspects, the the computer readable storage medium is one having stored thereon (I) a first set of data values and a second set of data values, wherein each data value of the first set is an expression level of Ig determined from a sample obtained from a responder and each data value of the second set is an expression level of Ig determined from a sample obtained from a non-responder; (II) a receiver operating characteristic (ROC) curve based on a first set of data values and a second set of data values, wherein each data value of the first set is an expression level of Ig determined from a sample obtained from a responder and each data value of the second set is an expression level of Ig determined from a sample obtained from a non-responder; or (III) a table listing (a) a plurality of cut-off points on the ROC curve of (II), (b) the % sensitivity associated with each cut-off point of (a), and (c) the % specificity associated with each cut-off point of (a).

In exemplary embodiments, the computer readable storage medium is one having stored thereon (I) a first set of data values and a second set of data values, wherein each data value of the first set is an expression level of FCGR2B determined from a sample obtained from a responder and each data value of the second set is an expression level of FCGR2B deteremined from a sample obtained from a non-responder; (II) a receiver operating characteristic (ROC) curve based on a first set of data values and a second set of data values, wherein each data value of the first set is an expression level of FCGR2B determined from a sample obtained from a responder and each data value of the second set is an expression level of FCGR2B deteremined from a sample obtained from a non-responder; or (III) a table listing (a) a plurality of cut-off points on the ROC curve of (II), (b) the % sensitivity associated with each cut-off point of (a), and (c) the % specificity associated with each cut-off point of (a).

In exemplary embodiments, the computer readable storage medium is one having stored thereon (I) a first set of data values and a second set of data values, wherein each data value of the first set is an expression level of a gene listed in Table 4 determined from a sample obtained from a responder and each data value of the second set is an expression level of a gene listed in Table 4 determined from a sample obtained from a non-responder; (II) a receiver operating characteristic (ROC) curve based on a first set of data values and a second set of data values, wherein each data value of the first set is an expression level of a gene listed in Table 4 determined from a sample obtained from a responder and each data value of the second set is an expression level of a gene listed in Table 4 determined from a sample obtained from a non-responder; or (III) a table listing (a) a plurality of cut-off points on the ROC curve of (II), (b) the % sensitivity associated with each cut-off point of (a), and (c) the % specificity associated with each cut-off point of (a). In exemplary aspects, the computer readable storage medium comprises two or more of the foregoing media.

In exemplary embodiments, the computer readable storage medium is one having stored thereon machine-readable instructions executable by a processor, comprising: (a) instructions for receiving a data value, α, relating to a test level of Ig expression from a sample obtained from a test subject; and (b) instructions for displaying an output relating to treating a patient for multiple myeloma with a proteasome inhibitor, when α is greater than β, a cutoff correlative with a % specificity of at least 50% and a % sensitivity of at least 50%, as determined by a receiver operating characteristic (ROC) curve.

In exemplary embodiments, the computer readable storage medium is one having stored thereon machine-readable instructions executable by a processor, comprising: (a) instructions for receiving a data value, α, relating to a test level of FCGR2B expression from a sample obtained from a test subject; and (b) instructions for displaying an output relating to treating a patient for multiple myeloma with a proteasome inhibitor, when α is greater than β, a cutoff correlative with a % specificity of at least 50% and a % sensitivity of at least 50%, as determined by a receiver operating characteristic (ROC) curve.

In exemplary embodiments, the computer readable storage medium is one having stored thereon machine-readable instructions executable by a processor, comprising: (a) instructions for receiving a data value, α, relating to a test level of expression of a gene or gene product listed in Table 4 from a sample obtained from a test subject, wherein the change in gene expression level for the gene is denoted in Table 4 as "up"; and (b) instructions for displaying an output relating to treating a patient for multiple myeloma with a proteasome inhibitor, when α is greater than β, a cutoff correlative with a % specificity of at least 50% and a % sensitivity of at least 50%, as determined by a receiver operating characteristic (ROC) curve.

In exemplary embodiments, the computer readable storage medium is one having stored thereon machine-readable instructions executable by a processor, comprising: (a) instructions for receiving a data value, α, relating to a test level of expression of a gene or gene product listed in Table 4 from a sample obtained from a test subject, wherein the change in gene expression level for the gene is denoted in Table 4 as "down"; and (b) instructions for displaying an output relating to treating a patient for multiple myeloma with a proteasome inhibitor, when α is less than β, a cutoff correlative with a % specificity of at least 50% and a % sensitivity of at least 50%, as determined by a receiver operating characteristic (ROC) curve.

The invention additionally provides systems comprising: a processor; a memory device coupled to the processor, and machine readable instructions stored on the memory device. In exemplary embodiments, the machine readable instructions, when executed by the processor, cause the processor to: (i.) receive a data value, α, relating to a test level of Ig expression from a sample obtained from a test subject; and (ii) display an output relating to treating a patient for multiple myeloma with a proteasome inhibitor, when α is greater than β, a cutoff correlative with a % specificity of at least 50% and a % sensitivity of at least 50%, as determined by a receiver operating characteristic (ROC) curve.

In exemplary embodiments, the machine readable instructions, when executed by the processor, cause the processor to: (i) receive a data value, α, relating to a test level of FCGR2B expression from a sample obtained from a test subject; and (ii) display an output relating to treating a patient for multiple myeloma with a proteasome inhibitor, when α is greater than β, a cutoff correlative with a % specificity of at least 50% and a % sensitivity of at least 50%, as determined by a receiver operating characteristic (ROC) curve.

In exemplary embodiments, the machine readable instructions, when executed by the processor, cause the processor to: (i) receive a data value, α, relating to a test level of expression of a gene or gene product listed in Table 4, wherein the change in gene expression level for the gene is denoted in Table 4 as "up", from a sample obtained from a test subject; and (ii) display an output relating to treating a patient for multiple myeloma with a proteasome inhibitor, when α is greater than β, a cutoff correlative with a % specificity of at least 50% and a % sensitivity of at least 50%, as determined by a receiver operating characteristic (ROC) curve.

In exemplary embodiments, the machine readable instructions, when executed by the processor, cause the processor to: (i) receive a data value, α, relating to a test level of expression of a gene or gene product listed in Table 4, wherein the change in gene expression level for the gene is denoted in Table 4 as "down", from a sample obtained from a test subject; and (ii) display an output relating to treating a patient for multiple myeloma with a proteasome inhibitor, when α is less than β, a cutoff correlative with a % specificity of at least 50% and a % sensitivity of at least 50%, as determined by a receiver operating characteristic (ROC) curve.

The invention further provides methods implemented by a processor in a computer. In exemplary embodiments, the method comprises the steps of: (a) receiving a data value, α, relating to a test level of Ig expression from a sample obtained from a test subject; and (b) displaying an output relating to treating a patient for multiple myeloma with a proteasome inhibitor, when α is greater than β, a cutoff correlative with a % specificity of at least 50% and a % sensitivity of at least 50%, as determined by a receiver operating characteristic (ROC) curve. In exemplary embodiments, the method comprises the steps of: (a) receiving a data value, α, relating to a test level of FCGR2B expression from a sample obtained from a test subject; and (b) displaying an output relating to treating a patient for multiple myeloma with a proteasome inhibitor, when α is greater than β, a cutoff correlative with a % specificity of at least 50% and a % sensitivity of at least 50%, as determined by a receiver operating characteristic (ROC) curve. In exemplary embodiments, the method comprises the steps of: (a) receiving a data value, α, relating to a test level of expression of a gene or gene product listed in Table 4 from a sample obtained from a test subject, wherein the change in gene expression level for the gene is denoted in Table 4 as "up"; and (b) displaying an output relating to treating a patient for multiple myeloma with a proteasome inhibitor, when α is greater than β, a cutoff correlative with a % specificity of at least 50% and a % sensitivity of at least 50%, as determined by a receiver operating characteristic (ROC) curve. In exemplary embodiments, the method comprises the steps of: (a) receiving a data value, α, relating to a test level of expression of a gene or gene product listed in Table 4 from a sample obtained from a test subject, wherein the change in gene expression level for the gene is denoted in Table 4 as "down"; and (b) displaying an output relating to treating a patient for multiple myeloma with a proteasome inhibitor, when α is less than β, a cutoff correlative with a % specificity of at least 50% and a % sensitivity of at least 50%, as determined by a receiver operating characteristic (ROC) curve.

Other features and advantages of the invention will be apparent from the following detailed description and figures, and from the claims.

BRIEF DESCRIPTION OF THE DRAWINGS

FIG. 8 is a is a graph demonstrating the time-to-progression (TTP) for IGH+FCGR2B positive an IGH+FCGR2G negative patients treated with carfilzomib.

FIG. 9 is a graph containing three receiver operating characteristic (ROC) curves, each curve plotting cutoff values corresponding to a % specificity and % sensitivity: IGH, FCGR2B, and the combination of IGH and FCGR2B.

DETAILED DESCRIPTION

Methods of Treating a Tumor

Figure 1A:
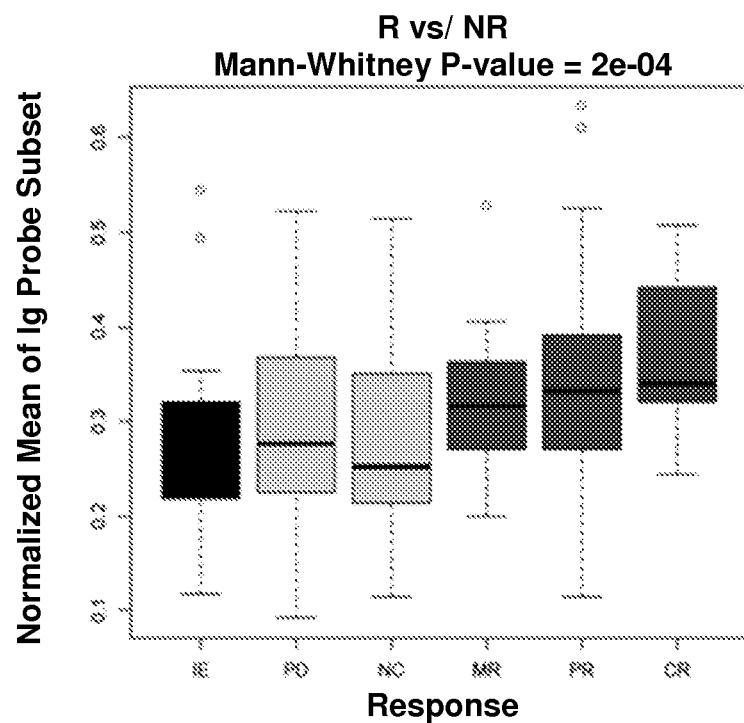
FIGS. 1A and 1B are graphs demonstrating the association between IG expression and bortezomib response. IE, response not evaluable; PD, progressive disease; no change, NC; minimal response, MR; partial response, PR; complete response, CR.

The invention provides methods of treating a tumor in a subject. In exemplary embodiments, the method comprises (a) measuring the level of expression of (i) immunoglobulin (Ig), including gene or gene product, (ii) Fc gamma receptor 2B (FCGR2B), including gene or gene product or (iii) both Ig and FCGR2B, in a sample obtained from the subject, wherein the sample comprises a cell from the tumor; and (b) administering to the subject an effective amount of a proteasome inhibitor when the level of Ig and/or FCGR2B expression in the sample is greater than a reference level.

In alternative or additional embodiments, the method comprises (a) measuring the level of expression of one or more genes or gene products listed in Table 4, in a sample obtained from the subject, wherein the sample comprises a cell from the tumor; and (b) administering to the subject an effective amount of a proteasome inhibitor, when (i) the level of expression of the one or more genes or gene products listed in Table 4 in the sample is greater than a reference level, and the change in gene expression level for the one or more genes or gene products is denoted in Table 4 as "up", or (ii) the level of expression of the one or more genes or gene products listed in Table 4 in the sample is less than a reference level, and the change in gene expression level for the one or more genes or gene products is denoted in Table 4 as "down", or (iii) both (i) and (ii).

The invention additional provides methods of treating a tumor in a subject, wherein the method comprises the step of administering to the subject an effective amount of a proteasome inhibitor and the subject is a subject from which a sample was obtained and the level of expression of (i) immunoglobulin (Ig), (ii) Fc gamma receptor 2B (FCGR2B), or (iii) both Ig and FCGR2B, has been measured from the sample. In exemplary aspects, the proteasome inhibitor is administered, when the level of expression is greater than a reference level.

In alternative or additional embodiments, the method of treating a tumor in a subject comprises the step of administering to the subject an effective amount of a proteasome inhibitor and the subject is a subject from which a sample was obtained and the level of expression of one or more genes or gene products listed in Table 4 has been measured from the sample. In exemplary aspects, the proteasome inhibitor is administered, when (i) the level of expression of the one or more genes listed in Table 4 in the sample is greater than a reference level, and the change in gene expression level for the one or more genes or gene products is denoted in Table 4 as "up", or (ii) the level of expression of the one or more genes or gene products listed in Table 4 in the sample is less than a reference level, and the change in gene expression level for the one or more genes or gene products is denoted in Table 4 as "down", or (iii) both (i) and (ii).

Methods of Determining a Treatment Regimen for a Subject with a Tumor

Also provided herein are methods of determining a treatment regimen for a subject with a tumor. In exemplary embodiments, the method comprises (a) measuring the level of expression of (i) immunoglobulin (Ig), (ii) Fc gamma receptor 2B (FCGR2B), or (iii) both Ig and FCGR2B, in a sample obtained from the subject, wherein the sample comprises a cell from the tumor, and (b) selecting a treatment regimen comprising administration of a proteasome inhibitor, when the level of Ig expression and/or FCGR2B expression in the sample is greater than a reference level. In additional or alternative embodiments, the method of determining a treatment regimen for a subject with a tumor comprises (a) measuring the level of expression of one or more genes or gene products listed in Table 4 in a sample obtained from the subject, wherein the sample comprises a cell from the tumor, and (b) selecting a treatment regimen comprising administration of a proteasome inhibitor, when (i) the level of expression of the one or more genes listed in Table 4 in the sample is greater than a reference level, and the change in gene expression level for the one or more genes or gene products is denoted in Table 4 as "up", or (ii) the level of expression of the one or more genes or gene products listed in Table 4 in the sample is less than a reference level, and the change in gene expression level for the one or more genes or gene products is denoted in Table 4 as "down", or (iii) both (i) and (ii).

Measurement of Expression Levels

In the methods of the invention, gene expression level(s) or gene segment expression level(s) is/are measured in a sample obtained from the subject. In exemplary aspects, the method comprises measuring the level, concentration, or amount of RNA, e.g., mRNA, encoded by the gene or gene segments in the sample. Levels of RNA, e.g., mRNA, may be measured by any technique known in the art, including but not limited to northern blotting or quantitative PCR (qPCR), including methods such as reverse transcription qPCR, real time qPCR, and end-point qPCR. Alternatively, "tag based" technologies, such as Serial analysis of gene expression (SAGE) and RNA-Seq, may be carried out to provide a relative measure of the cellular concentration of different mRNAs. Exemplary methods of measuring levels of RNA (e.g., mRNA) are also described herein at Example 5.

In alternative or additional aspects, the method comprises measuring the level, concentration, or amount of the protein product encoded by the gene or gene segments in the sample. Suitable methods of determining expression levels of protein products are known in the art and include immunoassays (e.g., Western blotting, an enzyme-linked immunosorbent assay (ELISA), a radioimmunoassay (RIA), and immunohistochemical assay. See, e.g., U.S. Patent Application Publication No. 2007/0212723 A1, Shang et al., *Circulation Research* 101: 1146-1154 (2007); and International Patent Application Publication Nos. WO/2012/094651 and WO/2010/129964. Exemplary methods of determining expression levels of protein products are also described herein at Example 6.

In alternative or additional aspects, the level of protein product is represented by a level of the protein product's biological activity, e.g., enzymatic activity. In exemplary aspects, the protein level is reflected by the levels of the substrate or product of the enzymatic reaction catalyzed by the protein product. Methods of assaying for the level of biological activity, e.g., enzymatic activity, are known in the art.

In some aspects, the level of the protein product is represented by the level of biological activity of a related protein, e.g., a protein which acts upstream or downstream of the protein product. For example, if the protein product is a phosphorylated protein in the active state, then, in some embodiments, the level of the protein product may be represented by the activity level of the kinase which phosphorylates the protein product. In other aspects, if the protein product is a transcription factor which activates expression of a gene, then, in some embodiments, the level of the protein product may be represented by the expression levels of the gene activated by the protein product.

In exemplary aspects, the expression level that is measured, may be normalized or calibrated to a level of a housekeeping gene. The housekeeping gene in some aspects is β-actin or GAPDH. In exemplary aspects, the housekeeping gene is any one of those set forth in the table below.

| Ensemble Gene ID | HGNC Gene ID |
|---|---|
| ENSG00000097007 | ABL1 |
| ENSG00000218739 | AC007390.5 |
| ENSG00000132842 | AP3B1 |
| ENSG00000065802 | ASB1 |
| ENSG00000108591 | DRG2 |
| ENSG00000181090 | EHMT1 |
| ENSG00000108262 | GIT1 |
| ENSG00000089022 | MAPKAPK5 |
| ENSG00000007047 | MARK4 |
| ENSG00000075975 | MKRN2 |
| ENSG00000198646 | NCOA6 |
| ENSG00000126653 | NSRP1 |
| ENSG00000107960 | OBFC1 |
| ENSG00000175470 | PPP2R2D |
| ENSG00000269277 | PPP2R2D |
| ENSG00000113456 | RAD1 |
| ENSG00000107185 | RGP1 |
| ENSG00000173456 | RNF26 |
| ENSG00000147164 | SNX12 |
| ENSG00000167182 | SP2 |
| ENSG00000110066 | SUV420H1 |
| ENSG00000149930 | TAOK2 |
| ENSG00000107021 | TBC1D13 |
| ENSG00000068354 | TBC1D25 |
| ENSG00000269499 | TBC1D25 |
| ENSG00000103671 | TRIP4 |
| ENSG00000130939 | UBE4B |
| ENSG00000170473 | WIBG |
| ENSG00000073050 | XRCC1 |
| ENSG00000121766 | ZCCHC17 |
| ENSG00000023041 | ZDHHC6 |

In exemplary aspects, the expression level that is measured, is not normalized or calibrated to a level of a housekeeping gene. In exemplary aspects, the expression level that is measured may represent an average expression level or a mean expression level based on more than one measurement of the expression level. In exemplary aspects, the measured expression level is an average or mean of several measurements of expression levels of the same sample. In exemplary aspects, the measured expression level is an average or mean of several measurements of expression levels of different samples containing the same components obtained from the same subject. In exemplary aspects, the measured expression level is quantile normalized, as is done in RNA Seq techniques.

Immunoglobulin (Ig)

In exemplary aspects, the sample obtained from the subject is measured for the expression level of immunoglobulins. Ig molecules comprise heavy chains and light chains, each of which have a constant region and a variable region. The genes encoding the segments of an Ig molecule are located at three loci within the human genome: the Ig heavy (IGH) locus, the Ig kappa (IGK) locus, and the Ig lambda (IGL) locus. The IGH locus is located on chromosome 14 (at ch. 14q32.33) and contains gene segments encoding Ig heavy chains. The IGK locus is located on chromosome 2 (at ch. 2p11.2) and contains gene segments encoding Ig light chains. The IGL locus is located on chromosome 22 (at ch. 22q11.2) and contains gene segments for Ig light chains. Each heavy chain and light chain gene contains multiple copies of different types of gene segments for the variable regions of the Ig molecule. For example, the immunoglobulin heavy chain region contains 44 Variable (V) gene segments[Matsuda et al., *J Expmtal Med* 188: 2151-2162 (1998)] plus 27 Diversity (D) gene segments and 6 Joining (J) gene segments. [Li et al., *Blood* 103: 4602-4609 (2004)]. Likewise, the light chain region possesses numerous V and J gene segments. However, light chain genes do not have D gene segments. DNA rearrangement causes one copy of each type of gene segment to be selected in any given lymphocyte, generating an enormous antibody repertoire; roughly $3\times10^{11}$ combinations are possible.

With regard to the inventive methods, when the sample obtained from the subject is measured for the expression level of immunoglobulins, the method may comprise measuring the expression level of any gene segment of the IGH locus, the IGK locus, or the IGL locus. In alternative or additional aspects, the method may comprise measuring the expression level of any IGH orphon gene segment which is not located at the IGH locus, any IGK orphon gene segment which is not located at the IGK locus, or any IGL orphon gene segment which is not located at the IGL locus. In exemplary aspects, the method comprises measuring the level of expression of one or more gene segments of the IGH locus, IGK locus, or IGL locus, or any IGH orphon gene segment, IGK orphon gene segment, or IGL orhon gene segment. In exemplary aspects, the method comprises measuring the level of expression of a combination of gene segments of at least two of the IGH locus, IGK locus, and IGL locus, or an orphon gene segment thereof. In exemplary aspects, the method comprises measuring the level of expression of a combination gene segments at each of the IGH locus, IGK locus, and IGL locus or at each of the IGH and IGK loci or at each of the IGH and IGL loci, or at each of the IGK and IGL loci. In alternative or additional aspects, the method comprises measuring the level of expression of a combination of IGH orphon gene segment(s), IGK orphon gene segment(s), and IGL orphon gene segment(s) or a combination of IGH orphon gene segments and IGK orphon gene segments or a combination of IGH orphon gene segments and IGL orphon gene segments or a combination of IGK orphon gene segments and IGL orphon gene segments.

In exemplary aspects, the method comprises measuring the level of expression of one or more gene segments at the IGH locus. In exemplary aspects, the one or more gene segments is selected from the group consisting of: IGHA1, IGHA2, IGHD, IGHD1-1, IGHD1-14, IGHD1-20, IGHD1-26, IGHD1-7, IGHD2-15, IGHD2-2, IGHD2-21, IGHD2-8, IGHD3-10, IGHD3-16, IGHD3-22, IGHD3-3, IGHD3-9, IGHD4-11, IGHD4-17, IGHD4-23, IGHD4-4, IGHD5-12, IGHD5-18, IGHD5-24, IGHD5-5, IGHD6-13, IGHD6-19, IGHD6-25, IGHD6-6, IGHD7-27, IGHE, IGHEP1, IGHEP2, IGHG1, IGHG2, IGHG3, IGHG4, IGHGP, IGHJ1, IGHJ1P, IGHJ2, IGHJ2P, IGHJ3, IGHJ3P, IGHJ4, IGHJ5, IGHJ6, IGHM, IGHMBP2, IGHV1-12, IGHV1-14, IGHV1-17, IGHV1-18, IGHV1-2, IGHV1-24, IGHV1-3, IGHV1-45, IGHV1-46, IGHV1-58, IGHV1-67, IGHV1-68, IGHV1-69, IGHV1-8, IGHV1OR21-1, IGHV2-10, IGHV2-26, IGHV2-5, IGHV2-70, IGHV2OR16-5, IGHV3-11, IGHV3-13, IGHV3-15, IGHV3-16, IGHV3-19, IGHV3-20, IGHV3-21, IGHV3-22, IGHV3-23, IGHV3-25, IGHV3-29, IGHV3-30, IGHV3-30-2, IGHV3-32, IGHV3-33, IGHV3-33-2, IGHV3-35, IGHV3-36, IGHV3-37, IGHV3-38, IGHV3-41, IGHV3-42, IGHV3-43, IGHV3-47, IGHV3-48, IGHV3-49, IGHV3-50, IGHV3-52, IGHV3-53, IGHV3-54, IGHV3-57, IGHV3-6, IGHV3-60, IGHV3-62, IGHV3-63, IGHV3-64, IGHV3-65, IGHV3-66, IGHV3-7, IGHV3-71, IGHV3-72, IGHV3-73, IGHV3-74, IGHV3-75, IGHV3-76, IGHV3-79, IGHV3-9, IGHV3OR16-8, IGHV4-28, IGHV4-31, IGHV4-34, IGHV4-39, IGHV4-4, IGHV4-55, IGHV4-59, IGHV4-61, IGHV4-80, IGHV5-51, IGHV5-78, IGHV6-1, IGHV7-27, IGHV7-34-1, IGHV7-40, IGHV7-56, IGHV7-81, IGHVII-1-1, IGHVII-15-1, IGHVII-20-1, IGHVII-22-1, IGHVII-26-2, IGHVII-28-1, IGHVII-30-1, IGHVII-31-1, IGHVII-33-1, IGHVII-40-1, IGHVII-43-1, IGHVII-44-2, IGHVII-46-1, IGHVII-49-1, IGHVII-51-2, IGHVII-53-1, IGHVII-60-1, IGHVII-62-1, IGHVII-65-1, IGHVII-67-1, IGHVII-74-1, IGHVII-78-1, IGHVIII-11-1, IGHVIII-13-1, IGHVIII-16-1, IGHVIII-2-1, IGHVIII-22-2, IGHVIII-25-1, IGHVIII-26-1, IGHVIII-38-1, IGHVIII-44, IGHVIII-47-1, IGHVIII-5-1, IGHVIII-51-1, IGHVIII-5-2, IGHVIII-67-2, IGHVIII-67-3, IGHVIII-67-4, IGHVIII-76-1, IGHVIII-82, and IGHVIV-44-1. In exemplary aspects, the one or more gene segments at the IgH locus comprises a sequence selected from the group consisting of SEQ ID NOs: 1-174. In exemplary aspects, the one or more gene segments at the IGH locus is one listed in the following table.

| HGNC ID | Approved Symbol | Approved Name | Previous Symbols | Synonyms | Chromosome | Accession Numbers | RefSeq IDs | Gene Family Tag | Gene family description |
|---|---|---|---|---|---|---|---|---|---|
| HGNC: 5487 | IGHD1OR15-1A | immunoglobulin heavy diversity 1/OR15-1A (non-functional) | | IGHD1/OR15-1A, IGHD1OR151A | 15q11.2 | X55575 | | IGHO | "Immunoglobulins/ IGH orphons" |
| HGNC: 5488 | IGHD1OR15-1B | immunoglobulin heavy diversity 1/OR15-1B (non-functional) | | IGHD1/OR15-1B, IGHD1OR151B | 15q11.2 | X55576 | | IGHO | "Immunoglobulins/ IGH orphons" |
| HGNC: 5493 | IGHD2OR15-2A | immunoglobulin heavy diversity 2/OR15-2A (non-functional) | | IGHD2/OR15-2A, IGHD2OR152A | 15q11.2 | X55577 | | IGHO | "Immunoglobulins/ IGH orphons" |
| HGNC: 5494 | IGHD2OR15-2B | immunoglobulin heavy diversity 2/OR15-2B (non-functional) | | IGHD2/OR15-2B, IGHD2OR152B | 15q11.2 | X55578 | | IGHO | "Immunoglobulins/ IGH orphons" |
| HGNC: 5500 | IGHD3OR15-3A | immunoglobulin heavy diversity 3/OR15-3A (non-functional) | | IGHD3/OR15-3A, IGHD3OR153A | 15q11.2 | X55579 | | IGHO | "Immunoglobulins/ IGH orphons" |
| HGNC: 5501 | IGHD3OR15-3B | immunoglobulin heavy diversity 3/OR15-3B (non-functional) | | IGHD3/OR15-3B, IGHD3OR153B | 15q11.2 | X55580 | | IGHO | "Immunoglobulins/ IGH orphons" |

-continued

| HGNC ID | Approved Symbol | Approved Name | Previous Symbols | Synonyms | Chromosome | Accession Numbers | RefSeq IDs | Gene Family Tag | Gene family description |
|---|---|---|---|---|---|---|---|---|---|
| HGNC: 5506 | IGHD4OR15-4A | immunoglobulin heavy diversity 4/OR15-4A (non-functional) | | IGHD4/OR15-4A, IGHD4OR154A | 15q11.2 | X55581 | | IGHO | "Immunoglobulins/ IGH orphons" |
| HGNC: 5507 | IGHD4OR15-4B | immunoglobulin heavy diversity 4/OR15-4B (non-functional) | | IGHD4/OR15-4B, IGHD4OR154B | 15q11.2 | X55582 | | IGHO | "Immunoglobulins/ IGH orphons" |
| HGNC: 5512 | IGHD5OR15-5A | immunoglobulin heavy diversity 5/OR15-5A (non-functional) | | IGHD5/OR15-5A, IGHD5OR155A | 15q11.2 | X55583 | | IGHO | "Immunoglobulins/ IGH orphons" |
| HGNC: 5513 | IGHD5OR15-5B | immunoglobulin heavy diversity 5/OR15-5B (non-functional) | | IGHD5/OR15-5B, IGHD5OR155B | 15q11.2 | X55584 | | IGHO | "Immunoglobulins/ IGH orphons" |
| HGNC: 5524 | IGHEP2 | immunoglobulin heavy constant epsilon P2 (pseudogene) | | | 9p24.1 | K01241 | NG_003254 | IGHO | "Immunoglobulins/ IGH orphons" |
| HGNC: 5563 | IGHV1OR15-1 | immunoglobulin heavy variable 1/OR15-1 (non-functional) | | IGHV1/OR15-1 | 15q11.2 | Z29631 | | IGHO | "Immunoglobulins/ IGH orphons" |
| HGNC: 5564 | IGHV1OR15-2 | immunoglobulin heavy variable 1/OR15-2 (pseudogene) | | IGHV1/OR15-2 | 15q11.1 | L25543 | | IGHO | "Immunoglobulins/ IGH orphons" |
| HGNC: 5565 | IGHV1OR15-3 | immunoglobulin heavy variable 1/OR15-3 (pseudogene) | | IGHV1/OR15-3 | 15q11.2 | Z29595 | | IGHO | "Immunoglobulins/ IGH orphons" |
| HGNC: 5566 | IGHV1OR15-4 | immunoglobulin heavy variable 1/OR15-4 (pseudogene) | | IGHV1/OR15-4 | 15q11.2 | Z29596 | | IGHO | "Immunoglobulins/ IGH orphons" |
| HGNC: 5567 | IGHV1OR15-5 | immunoglobulin heavy variable 1/OR15-5 (non-functional) | | IGHV1/OR15-5 | 15q11.2 | Z29633 | NG_016978 | IGHO | "Immunoglobulins/ IGH orphons" |
| HGNC: 5568 | IGHV1OR15-6 | immunoglobulin heavy variable 1/OR15-6 (pseudogene) | | IGHV1/OR15-6 | 15q11.2 | Z29634 | | IGHO | "Immunoglobulins/ IGH orphons" |
| HGNC: 5569 | IGHV1OR15-9 | immunoglobulin heavy variable 1/OR15-9 (non-functional) | VSIG7 | IGHV1/OR15-9, IGHV1OR159 | 15q11.1 | L25542 | | IGHO | "Immunoglobulins/ IGH orphons" |
| HGNC: 5570 | IGHV1OR16-1 | immunoglobulin heavy variable 1/OR16-1 (pseudogene) | | IGHV1/OR16-1 | 16p11.2 | Z29599 | | IGHO | "Immunoglobulins/ IGH orphons" |
| HGNC: 5571 | IGHV1OR16-2 | immunoglobulin heavy variable 1/OR16-2 (pseudogene) | | IGHV1/OR16-2 | 16p11.2 | Z29600 | | IGHO | "Immunoglobulins/ IGH orphons" |
| HGNC: 5572 | IGHV1OR16-3 | immunoglobulin heavy variable 1/OR16-3 (pseudogene) | | IGHV1/OR16-3 | 16p11.2 | Z29639 | | IGHO | "Immunoglobulins/ IGH orphons" |
| HGNC: 5573 | IGHV1OR16-4 | immunoglobulin heavy variable 1/OR16-4 (pseudogene) | | IGHV1/OR16-4 | 16p11.2 | Z17397 | | IGHO | "Immunoglobulins/ IGH orphons" |
| HGNC: 38040 | IGHV1OR21-1 | immunoglobulin heavy variable 1/OR21-1 (non-functional) | | IGHV1/OR21-1 | 21p11.2 | | NG_011680 | IGHO | "Immunoglobulins/ IGH orphons" |
| HGNC: 5579 | IGHV2OR16-5 | immunoglobulin heavy variable 2/OR16-5 (non-functional) | | IGHV2/OR16-5 | 16p11.2 | L25544 | | IGHO | "Immunoglobulins/ IGH orphons" |

-continued

| HGNC ID | Approved Symbol | Approved Name | Previous Symbols | Synonyms | Chromosome | Accession Numbers | RefSeq IDs | Gene Family Tag | Gene family description |
|---|---|---|---|---|---|---|---|---|---|
| HGNC: 5633 | IGHV3OR15-7 | immunoglobulin heavy variable 3/OR15-7 (pseudogene) | | IGHV3/OR15-7 | 15q11.2 | Z29597 | | IGHO | "Immunoglobulins/ IGH orphons" |
| HGNC: 5641 | IGHV3OR16-6 | immunoglobulin heavy variable 3/OR16-6 (pseudogene) | | IGHV3/OR16-6 | 16p11.2 | L25545 | | IGHO | "Immunoglobulins/ IGH orphons" |
| HGNC: 5642 | IGHV3OR16-7 | immunoglobulin heavy variable 3/OR16-7 (pseudogene) | | IGHV3/OR16-7 | 16p11.2 | Z29604 | | IGHO | "Immunoglobulins/ IGH orphons" |
| HGNC: 5643 | IGHV3OR16-8 | immunoglobulin heavy variable 3/OR16-8 (non-functional) | | IGHV3/OR16-8 | 16p11.2 | Z29605 | | IGHO | "Immunoglobulins/ IGH orphons" |
| HGNC: 5644 | IGHV3OR16-9 | immunoglobulin heavy variable 3/OR16-9 (non-functional) | | IGHV3/OR16-9 | 16p11.2 | Z29606 | | IGHO | "Immunoglobulins/ IGH orphons" |
| HGNC: 5634 | IGHV3OR16-10 | immunoglobulin heavy variable 3/OR16-10 (non-functional) | | IGHV3/OR16-10 | 16p11.2 | Z29607 | | IGHO | "Immunoglobulins/ IGH orphons" |
| HGNC: 5635 | IGHV3OR16-11 | immunoglobulin heavy variable 3/OR16-11 (pseudogene) | | IGHV3/OR16-11 | 16p11.2 | Z29608 | | IGHO | "Immunoglobulins/ IGH orphons" |
| HGNC: 5636 | IGHV3OR16-12 | immunoglobulin heavy variable 3/OR16-12 (non-functional) | | IGHV3/OR16-12 | 16p11.2 | Z29609 | | IGHO | "Immunoglobulins/ IGH orphons" |
| HGNC: 5637 | IGHV3OR16-13 | immunoglobulin heavy variable 3/OR16-13 (non-functional) | | IGHV3/OR16-13 | 16p11.2 | Z29610 | NG_011771 | IGHO | "Immunoglobulins/ IGH orphons" |
| HGNC: 5638 | IGHV3OR16-14 | immunoglobulin heavy variable 3/OR16-14 (pseudogene) | | IGHV3/OR16-14 | 16p11.2 | Z29611 | | IGHO | "Immunoglobulins/ IGH orphons" |
| HGNC: 5639 | IGHV3OR16-15 | immunoglobulin heavy variable 3/OR16-15 (pseudogene) | | IGHV3/OR16-15 | 16p11.2 | L25546 | | IGHO | "Immunoglobulins/ IGH orphons" |
| HGNC: 5640 | IGHV3OR16-16 | immunoglobulin heavy variable 3/OR16-16 (pseudogene) | | IGHV3/OR16-16 | 16p11.2 | Z29613 | | IGHO | "Immunoglobulins/ IGH orphons" |
| HGNC: 5658 | IGHV4OR15-8 | immunoglobulin heavy variable 4/OR15-8 (non-functional) | VSIG6 | IGHV4/OR15-8, IGHV4OR158 | 15q11.2 | Z29598 | | IGHO | "Immunoglobulins/ IGH orphons" |

In exemplary aspects, the method comprises measuring the level of expression of one or more gene segments at the IGK locus. In exemplary aspects, the one or more gene segments is selected from the group consisting of: IGKC, IGKJ1, IGKJ2, IGKJ3, IGKJ4, IGKJ5, IGKV1-12, IGKV1-13, IGKV1-16, IGKV1-17, IGKV1-22, IGKV1-27, IGKV1-32, IGKV1-33, IGKV1-35, IGKV1-37, IGKV1-39, IGKV1-5, IGKV1-6, IGKV1-8, IGKV1-9, IGKV1D-12, IGKV1D-13, IGKV1D-16, IGKV1D-17, IGKV1D-22, IGKV1D-27, IGKV1D-32, IGKV1D-33, IGKV1D-35, IGKV1D-37, IGKV1D-39, IGKV1D-42, IGKV1D-43, IGKV1D-8, IGKV1OR22-1, IGKV2-10, IGKV2-14, IGKV2-18, IGKV2-19, IGKV2-23, IGKV2-24, IGKV2-26, IGKV2-28, IGKV2-29, IGKV2-30, IGKV2-36, IGKV2-38, IGKV2-4, IGKV2-40, IGKV2D-10, IGKV2D-14, IGKV2D-18, IGKV2D-19, IGKV2D-23, IGKV2D-24, IGKV2D-26, IGKV2D-28, IGKV2D-29, IGKV2D-30, IGKV2D-36, IGKV2D-38, IGKV2D-40, IGKV2OR22-3, IGKV2OR22-4, IGKV3-11, IGKV3-15, IGKV3-20, IGKV3-25, IGKV3-31, IGKV3-34, IGKV3-7, IGKV3D-11, IGKV3D-15, IGKV3D-20, IGKV3D-25, IGKV3D-31, IGKV3D-34, IGKV3D-7, IGKV3OR22-2, IGKV4-1, IGKV5-2, IGKV6-21, IGKV6D-21, IGKV6D-41, IGKV7-3. In exemplary aspects, the one or more gene segments at the IgK locus comprises a sequence selected from the group consisting of SEQ ID NOs: 175-260. In exemplary aspects, the one or more gene segments at the IGK locus is one listed in the following table.

| HGNC ID | Approved Symbol | Approved Name | Previous Symbols | Synonyms | Chromosome | Accession Numbers | RefSeq IDs | Gene Family Tag | Gene family description |
|---|---|---|---|---|---|---|---|---|---|
| HGNC: 5715 | IGK | immunoglobulin kappa locus | IGK@ | | 2p11.2 | | NG_000833 | IGK | "Immunoglobulins/ IGK locus" |
| HGNC: 5716 | IGKC | immunoglobulin kappa constant | | HCAK1 | 2p11.2 | J00241 | NG_000834 | IGK | "Immunoglobulins/ IGK locus" |
| HGNC: 5719 | IGKJ1 | immunoglobulin kappa joining 1 | | J1 | 2p11.2 | J00242 | NG_000834 | IGK | "Immunoglobulins/ IGK locus" |
| HGNC: 5720 | IGKJ2 | immunoglobulin kappa joining 2 | | J2 | 2p11.2 | J00242 | NG_000834 | IGK | "Immunoglobulins/ IGK locus" |
| HGNC: 5721 | IGKJ3 | immunoglobulin kappa joining 3 | | | 2p11.2 | J00242 | NG_000834 | IGK | "Immunoglobulins/ IGK locus" |
| HGNC: 5722 | IGKJ4 | immunoglobulin kappa joining 4 | | | 2p11.2 | J00242 | NG_000834 | IGK | "Immunoglobulins/ IGK locus" |
| HGNC: 5723 | IGKJ5 | immunoglobulin kappa joining 5 | | | 2p11.2 | J00242 | NG_000834 | IGK | "Immunoglobulins/ IGK locus" |
| HGNC: 5741 | IGKV1-5 | immunoglobulin kappa variable 1-5 | | | 2p11.2 | Z00001 | NG_000834 | IGK | "Immunoglobulins/ IGK locus" |
| HGNC: 5742 | IGKV1-6 | immunoglobulin kappa variable 1-6 | | | 2p11.2 | M64858 | NG_000834 | IGK | "Immunoglobulins/ IGK locus" |
| HGNC: 5743 | IGKV1-8 | immunoglobulin kappa variable 1-8 | | IGKV18, L9 | 2p11.2 | Z00014 | NG_000834 | IGK | "Immunoglobulins/ IGK locus" |
| HGNC: 5744 | IGKV1-9 | immunoglobulin kappa variable 1-9 | | IGKV19, L8 | 2p11.2 | Z00013 | NG_000834 | IGK | "Immunoglobulins/ IGK locus" |
| HGNC: 5730 | IGKV1-12 | immunoglobulin kappa variable 1-12 | | IGKV112, L19 | 2p11.2 | V01577 | NG_000834 | IGK | "Immunoglobulins/ IGK locus" |
| HGNC: 5731 | IGKV1-13 | immunoglobulin kappa variable 1-13 (gene/pseudogene) | | | 2p11.2 | Z00010 | NG_000834 | IGK | "Immunoglobulins/ IGK locus" |
| HGNC: 5732 | IGKV1-16 | immunoglobulin kappa variable 1-16 | | IGKV116, L1 | 2p11.2 | J00248 | NG_000834 | IGK | "Immunoglobulins/ IGK locus" |
| HGNC: 5733 | IGKV1-17 | immunoglobulin kappa variable 1-17 | | IGKV117, A30 | 2p11.2 | X72808 | NG_000834 | IGK | "Immunoglobulins/ IGK locus" |
| HGNC: 5734 | IGKV1-22 | immunoglobulin kappa variable 1-22 (pseudogene) | | | 2p11.2 | X71885 | NG_000834 | IGK | "Immunoglobulins/ IGK locus" |
| HGNC: 5735 | IGKV1-27 | immunoglobulin kappa variable 1-27 | | IGKV127, A20 | 2p11.2 | X63398 | NG_000834 | IGK | "Immunoglobulins/ IGK locus" |
| HGNC: 5736 | IGKV1-32 | immunoglobulin kappa variable 1-32 (pseudogene) | | | 2p11.2 | X71883 | NG_000834 | IGK | "Immunoglobulins/ IGK locus" |
| HGNC: 5737 | IGKV1-33 | immunoglobulin kappa variable 1-33 | | IGKV133, O18 | 2p11.2 | M64856 | NG_000834 | IGK | "Immunoglobulins/ IGK locus" |
| HGNC: 5738 | IGKV1-35 | immunoglobulin kappa variable 1-35 (pseudogene) | | | 2p11.2 | X71890 | NG_000834 | IGK | "Immunoglobulins/ IGK locus" |
| HGNC: 5739 | IGKV1-37 | immunoglobulin kappa variable 1-37 (non-functional) | | IGKV137, O14 | 2p11.2 | X59316 | NG_000834 | IGK | "Immunoglobulins/ IGK locus" |
| HGNC: 5740 | IGKV1-39 | immunoglobulin kappa variable 1-39 (gene/pseudogene) | | | 2p11.2 | X59315 | NG_000834 | IGK | "Immunoglobulins/ IGK locus" |
| HGNC: 5759 | IGKV1D-8 | immunoglobulin kappa variable 1D-8 | | | 2p11.2 | Z00008 | NG_000833 | IGK | "Immunoglobulins/ IGK locus" |
| HGNC: 5746 | IGKV1D-12 | immunoglobulin kappa variable 1D-12 | | | 2p11.2 | X17263 | NG_000833 | IGK | "Immunoglobulins/ IGK locus" |
| HGNC: 5747 | IGKV1D-13 | immunoglobulin kappa variable 1D-13 | | | 2p11.2 | X17262 | NG_000833 | IGK | "Immunoglobulins/ IGK locus" |
| HGNC: 5748 | IGKV1D-16 | immunoglobulin kappa variable 1D-16 | | | 2p11.2 | K01323 | NG_000833 | IGK | "Immunoglobulins/ IGK locus" |
| HGNC: 5749 | IGKV1D-17 | immunoglobulin kappa variable 1D-17 | | | 2p11.2 | X63392 | NG_000833 | IGK | "Immunoglobulins/ IGK locus" |
| HGNC: 5750 | IGKV1D-22 | immunoglobulin kappa variable 1D-22 (pseudogene) | | | 2p11.2 | X71887 | NG_000833 | IGK | "Immunoglobulins/ IGK locus" |

-continued

| HGNC ID | Approved Symbol | Approved Name | Previous Symbols | Synonyms | Chromosome | Accession Numbers | RefSeq IDs | Gene Family Tag | Gene family description |
|---|---|---|---|---|---|---|---|---|---|
| HGNC: 5751 | IGKV1D-27 | immunoglobulin kappa variable 1D-27 (pseudogene) | | | 2p11.2 | Z00004 | NG_000833 | IGK | "Immunoglobulins/ IGK locus" |
| HGNC: 5752 | IGKV1D-32 | immunoglobulin kappa variable 1D-32 (pseudogene) | | | 2p11.2 | X71896 | NG_000833 | IGK | "Immunoglobulins/ IGK locus" |
| HGNC: 5753 | IGKV1D-33 | immunoglobulin kappa variable 1D-33 | | | 2p11.2 | M64855 | NG_000833 | IGK | "Immunoglobulins/ IGK locus" |
| HGNC: 5754 | IGKV1D-35 | immunoglobulin kappa variable 1D-35 (pseudogene) | | | 2p11.2 | X71894 | NG_000833 | IGK | "Immunoglobulins/ IGK locus" |
| HGNC: 5755 | IGKV1D-37 | immunoglobulin kappa variable 1D-37 (non-functional) | | IGKV1D37, O4 | 2p11.2 | X71893 | NG_000833 | IGK | "Immunoglobulins/ IGK locus" |
| HGNC: 5756 | IGKV1D-39 | immunoglobulin kappa variable 1D-39 | | | 2p11.2 | X59312 | NG_000833 | IGK | "Immunoglobulins/ IGK locus" |
| HGNC: 5757 | IGKV1D-42 | immunoglobulin kappa variable 1D-42 (non-functional) | | | 2p11.2 | X72816 | NG_000833 | IGK | "Immunoglobulins/ IGK locus" |
| HGNC: 5758 | IGKV1D-43 | immunoglobulin kappa variable 1D-43 | | | 2p11.2 | X72817 | NG_000833 | IGK | "Immunoglobulins/ IGK locus" |
| HGNC: 5788 | IGKV2-4 | immunoglobulin kappa variable 2-4 (pseudogene) | | | 2p11.2 | X72814 | NG_000834 | IGK | "Immunoglobulins/ IGK locus" |
| HGNC: 5776 | IGKV2-10 | immunoglobulin kappa variable 2-10 (pseudogene) | | | 2p11.2 | Z00012 | NG_000834 | IGK | "Immunoglobulins/ IGK locus" |
| HGNC: 5777 | IGKV2-14 | immunoglobulin kappa variable 2-14 (pseudogene) | | | 2p11.2 | X72810 | NG_000834 | IGK | "Immunoglobulins/ IGK locus" |
| HGNC: 5778 | IGKV2-18 | immunoglobulin kappa variable 2-18 (pseudogene) | | | 2p11.2 | X63400 | NG_000834 | IGK | "Immunoglobulins/ IGK locus" |
| HGNC: 5779 | IGKV2-19 | immunoglobulin kappa variable 2-19 (pseudogene) | | | 2p11.2 | X12692 | NG_000834 | IGK | "Immunoglobulins/ IGK locus" |
| HGNC: 5780 | IGKV2-23 | immunoglobulin kappa variable 2-23 (pseudogene) | | | 2p11.2 | X71885 | NG_000834 | IGK | "Immunoglobulins/ IGK locus" |
| HGNC: 5781 | IGKV2-24 | immunoglobulin kappa variable 2-24 | | | 2p11.2 | X12684 | NG_000834 | IGK | "Immunoglobulins/ IGK locus" |
| HGNC: 5782 | IGKV2-26 | immunoglobulin kappa variable 2-26 (pseudogene) | | | 2p11.2 | X71884 | NG_000834 | IGK | "Immunoglobulins/ IGK locus" |
| HGNC: 5783 | IGKV2-28 | immunoglobulin kappa variable 2-28 | | | 2p11.2 | X63397 | NG_000834 | IGK | "Immunoglobulins/ IGK locus" |
| HGNC: 5784 | IGKV2-29 | immunoglobulin kappa variable 2-29 (gene/pseudogene) | | | 2p11.2 | X63396 | NG_000834 | IGK | "Immunoglobulins/ IGK locus" |
| HGNC: 5785 | IGKV2-30 | immunoglobulin kappa variable 2-30 | | | 2p11.2 | X63403 | NG_000834 | IGK | "Immunoglobulins/ IGK locus" |
| HGNC: 5786 | IGKV2-36 | immunoglobulin kappa variable 2-36 (pseudogene) | | | 2p11.2 | X71889 | NG_000834 | IGK | "Immunoglobulins/ IGK locus" |
| HGNC: 5787 | IGKV2-38 | immunoglobulin kappa variable 2-38 (pseudogene) | | | 2p11.2 | X71888 | NG_000834 | IGK | "Immunoglobulins/ IGK locus" |
| HGNC: 5789 | IGKV2-40 | immunoglobulin kappa variable 2-40 | | | 2p11.2 | X59314 | NG_000834 | IGK | "Immunoglobulins/ IGK locus" |

-continued

| HGNC ID | Approved Symbol | Approved Name | Previous Symbols | Synonyms | Chromosome | Accession Numbers | RefSeq IDs | Gene Family Tag | Gene family description |
|---|---|---|---|---|---|---|---|---|---|
| HGNC: 5792 | IGKV2D-10 | immunoglobulin kappa variable 2D-10 (pseudogene) | | | 2p11.2 | X17265 | NG_000833 | IGK | "Immunoglobulins/ IGK locus" |
| HGNC: 5793 | IGKV2D-14 | immunoglobulin kappa variable 2D-14 (pseudogene) | | | 2p11.2 | X72811 | NG_000833 | IGK | "Immunoglobulins/ IGK locus" |
| HGNC: 5794 | IGKV2D-18 | immunoglobulin kappa variable 2D-18 (pseudogene) | | | 2p11.2 | X63395 | NG_000833 | IGK | "Immunoglobulins/ IGK locus" |
| HGNC: 5795 | IGKV2D-19 | immunoglobulin kappa variable 2D-19 (pseudogene) | | | 2p11.2 | X71882 | NG_000833 | IGK | "Immunoglobulins/ IGK locus" |
| HGNC: 5796 | IGKV2D-23 | immunoglobulin kappa variable 2D-23 (pseudogene) | | | 2p11.2 | X71887 | NG_000833 | IGK | "Immunoglobulins/ IGK locus" |
| HGNC: 5797 | IGKV2D-24 | immunoglobulin kappa variable 2D-24 (non-functional) | | | 2p11.2 | X63401 | NG_000833 | IGK | "Immunoglobulins/ IGK locus" |
| HGNC: 5798 | IGKV2D-26 | immunoglobulin kappa variable 2D-26 | | | 2p11.2 | X12689 | NG_000833 | IGK | "Immunoglobulins/ IGK locus" |
| HGNC: 5799 | IGKV2D-28 | immunoglobulin kappa variable 2D-28 | | | 2p11.2 | X12691 | NG_000833 | IGK | "Immunoglobulins/ IGK locus" |
| HGNC: 5800 | IGKV2D-29 | immunoglobulin kappa variable 2D-29 | | | 2p11.2 | M31952 | NG_000833 | IGK | "Immunoglobulins/ IGK locus" |
| HGNC: 5801 | IGKV2D-30 | immunoglobulin kappa variable 2D-30 | | | 2p11.2 | X63402 | NG_000833 | IGK | "Immunoglobulins/ IGK locus" |
| HGNC: 5802 | IGKV2D-36 | immunoglobulin kappa variable 2D-36 (pseudogene) | | | 2p11.2 | X71893 | NG_000833 | IGK | "Immunoglobulins/ IGK locus" |
| HGNC: 5803 | IGKV2D-38 | immunoglobulin kappa variable 2D-38 (pseudogene) | | | 2p11.2 | X71892 | NG_000833 | IGK | "Immunoglobulins/ IGK locus" |
| HGNC: 5804 | IGKV2D-40 | immunoglobulin kappa variable 2D-40 | | | 2p11.2 | X59311 | NG_000833 | IGK | "Immunoglobulins/ IGK locus" |
| HGNC: 5821 | IGKV3-7 | immunoglobulin kappa variable 3-7 (non-functional) | | | 2p11.2 | X02725 | NG_000834 | IGK | "Immunoglobulins/ IGK locus" |
| HGNC: 5815 | IGKV3-11 | immunoglobulin kappa variable 3-11 | | | 2p11.2 | X01668 | NG_000834 | IGK | "Immunoglobulins/ IGK locus" |
| HGNC: 5816 | IGKV3-15 | immunoglobulin kappa variable 3-15 | | | 2p11.2 | M23090 | NG_000834 | IGK | "Immunoglobulins/ IGK locus" |
| HGNC: 5817 | IGKV3-20 | immunoglobulin kappa variable 3-20 | | | 2p11.2 | X12686 | NG_000834 | IGK | "Immunoglobulins/ IGK locus" |
| HGNC: 5818 | IGKV3-25 | immunoglobulin kappa variable 3-25 (pseudogene) | | | 2p11.2 | X06583 | NG_000834 | IGK | "Immunoglobulins/ IGK locus" |
| HGNC: 5819 | IGKV3-31 | immunoglobulin kappa variable 3-31 (pseudogene) | | | 2p11.2 | X71883 | NG_000834 | IGK | "Immunoglobulins/ IGK locus" |
| HGNC: 5820 | IGKV3-34 | immunoglobulin kappa variable 3-34 (pseudogene) | | | 2p11.2 | X71891 | NG_000834 | IGK | "Immunoglobulins/ IGK locus" |
| HGNC: 5829 | IGKV3D-7 | immunoglobulin kappa variable 3D-7 | | | 2p11.2 | X72820 | NG_000833 | IGK | "Immunoglobulins/ IGK locus" |
| HGNC: 5823 | IGKV3D-11 | immunoglobulin kappa variable 3D-11 | | | 2p11.2 | X17264 | NG_000833 | IGK | "Immunoglobulins/ IGK locus" |

| HGNC ID | Approved Symbol | Approved Name | Previous Symbols | Synonyms | Chromosome | Accession Numbers | RefSeq IDs | Gene Family Tag | Gene family description |
|---|---|---|---|---|---|---|---|---|---|
| HGNC: 5824 | IGKV3D-15 | immunoglobulin kappa variable 3D-15 (gene/pseudogene) | | | 2p11.2 | X72815 | NG_000833 | IGK | "Immunoglobulins/ IGK locus" |
| HGNC: 5825 | IGKV3D-20 | immunoglobulin kappa variable 3D-20 | | | 2p11.2 | X12687 | NG_000833 | IGK | "Immunoglobulins/ IGK locus" |
| HGNC: 5826 | IGKV3D-25 | immunoglobulin kappa variable 3D-25 (pseudogene) | | | 2p11.2 | X71886 | NG_000833 | IGK | "Immunoglobulins/ IGK locus" |
| HGNC: 5827 | IGKV3D-31 | immunoglobulin kappa variable 3D-31 (pseudogene) | | | 2p11.2 | X71896 | NG_000833 | IGK | "Immunoglobulins/ IGK locus" |
| HGNC: 5828 | IGKV3D-34 | immunoglobulin kappa variable 3D-34 (pseudogene) | | | 2p11.2 | X71895 | NG_000833 | IGK | "Immunoglobulins/ IGK locus" |
| HGNC: 5834 | IGKV4-1 | immunoglobulin kappa variable 4-1 | | IGKV41, B3 | 2p11.2 | Z00023 | NG_000834 | IGK | "Immunoglobulins/ IGK locus" |
| HGNC: 5835 | IGKV5-2 | immunoglobulin kappa variable 5-2 | | IGKV52, B2 | 2p11.2 | X02485 | NG_000834 | IGK | "Immunoglobulins/ IGK locus" |
| HGNC: 5836 | IGKV6-21 | immunoglobulin kappa variable 6-21 (non-functional) | | IGKV621, A26 | 2p11.2 | X63399 | NG_000834 | IGK | "Immunoglobulins/ IGK locus" |
| HGNC: 5837 | IGKV6D-21 | immunoglobulin kappa variable 6D-21 (non-functional) | | IGKV6D21, A10 | 2p11.2 | X12683 | NG_000833 | IGK | "Immunoglobulins/ IGK locus" |
| HGNC: 5838 | IGKV6D-41 | immunoglobulin kappa variable 6D-41 (non-functional) | | | 2p11.2 | X12688 | NG_000833 | IGK | "Immunoglobulins/ IGK locus" |
| HGNC: 5839 | IGKV7-3 | immunoglobulin kappa variable 7-3 (pseudogene) | | | 2p11.2 | X12682 | NG_000834 | IGK | "Immunoglobulins/ IGK locus" |

In exemplary aspects, the method comprises measuring the level of expression of one or more gene segments at the IGL locus. In exemplary aspects, the one or more gene segments is selected from the group consisting of: IGLC1, IGLC2, IGLC3, IGLC4, IGLC5, IGLC6, IGLC7, IGL-COR22-1, IGLJ1, IGLJ2, IGLJ3, IGLJ4, IGLJ5, IGLJ6, IGLJ7, IGLL1, IGLL3, IGLON5, IGLV10-54, IGLV10-67, IGLV11-55, IGLV1-36, IGLV1-40, IGLV1-41, IGLV1-44, IGLV1-47, IGLV1-50, IGLV1-51, IGLV1-62, IGLV2-11, IGLV2-14, IGLV2-18, IGLV2-23, IGLV2-28, IGLV2-33, IGLV2-34, IGLV2-5, IGLV2-8, IGLV3-1, IGLV3-10, IGLV3-12, IGLV3-13, IGLV3-15, IGLV3-16, IGLV3-17, IGLV3-19, IGLV3-2, IGLV3-21, IGLV3-22, IGLV3-24, IGLV3-25, IGLV3-26, IGLV3-27, IGLV3-29, IGLV3-30, IGLV3-31, IGLV3-32, IGLV3-4, IGLV3-6, IGLV3-7, IGLV3-9, IGLV4-3, IGLV4-60, IGLV4-69, IGLV5-37, IGLV5-45, IGLV5-48, IGLV5-52, IGLV6-57, IGLV7-35, IGLV7-43, IGLV7-46, IGLV8-61, IGLV9-49, IGLVI-20, IGLVI-38, IGLVI-42, IGLVI-56, IGLVI-63, IGLVI-68, IGLVI-70, IGLVIV-53, IGLVIV-59, IGLVIV-64, IGLVIV-65, IGLVIV-66-1, IGLVV-58, IGLVV-66, IGLVVI-22-1, IGLVVI-25-1, and IGLVVII-41-1. In exemplary aspects, the one or more gene segments at the IgL locus comprises a sequence selected from the group consisting of SEQ ID NOs: 261-350. In exemplary aspects, the one or more gene segments at the IGL locus is one listed in the following table.

| HGNC ID | Approved Symbol | Approved Name | Previous Symbols | Synonyms | Chromosome | Accession Numbers | RefSeq IDs | Gene Family Tag | Gene family description |
|---|---|---|---|---|---|---|---|---|---|
| HGNC: 5853 | IGL | immunoglobulin lambda locus | IGL@ | | 22q11.2 | | NG_000002 | IGL | "Immunoglobulins/ IGL locus" |
| HGNC: 5855 | IGLC1 | immunoglobulin lambda constant 1 (Mcg marker) | IGLC | | 22q11.2 | J00252 | NG_000002 | IGL | "Immunoglobulins/ IGL locus" |
| HGNC: 5856 | IGLC2 | immunoglobulin lambda constant 2 (Kern–Oz– marker) | IGLC | | 22q11.2 | J00253 | NG_000002 | IGL | "Immunoglobulins/ IGL locus" |

-continued

| HGNC ID | Approved Symbol | Approved Name | Previous Symbols | Synonyms | Chromosome | Accession Numbers | RefSeq IDs | Gene Family Tag | Gene family description |
|---|---|---|---|---|---|---|---|---|---|
| HGNC: 5857 | IGLC3 | immunoglobulin lambda constant 3 (Kern−Oz+ marker) | IGLC | | 22q11.2 | J00254 | NG_000002 | IGL | "Immunoglobulins/ IGL locus" |
| HGNC: 5858 | IGLC4 | immunoglobulin lambda constant 4 (pseudogene) | IGLC | | 22q11.2 | J03009 | NG_000002 | IGL | "Immunoglobulins/ IGL locus" |
| HGNC: 5859 | IGLC5 | immunoglobulin lambda constant 5 (pseudogene) | IGLC | | 22q11.2 | J03010 | NG_000002 | IGL | "Immunoglobulins/ IGL locus" |
| HGNC: 5860 | IGLC6 | immunoglobulin lambda constant 6 (Kern+Oz− marker, gene/pseudogene) | IGLC | | 22q11.2 | J03011 | NG_000002 | IGL | "Immunoglobulins/ IGL locus" |
| HGNC: 5861 | IGLC7 | immunoglobulin lambda constant 7 | | | 22q11.2 | X51755 | NG_000002 | IGL | "Immunoglobulins/ IGL locus" |
| HGNC: 5863 | IGLJ1 | immunoglobulin lambda joining 1 | | | 22q11.2 | X04457 | NG_000002 | IGL | "Immunoglobulins/ IGL locus" |
| HGNC: 5864 | IGLJ2 | immunoglobulin lambda joining 2 | | | 22q11.2 | M15641 | NG_000002 | IGL | "Immunoglobulins/ IGL locus" |
| HGNC: 5865 | IGLJ3 | immunoglobulin lambda joining 3 | | | 22q11.2 | M15642 | NG_000002 | IGL | "Immunoglobulins/ IGL locus" |
| HGNC: 5866 | IGLJ4 | immunoglobulin lambda joining 4 (non-functional) | | | 22q11.2 | X51755 | NG_000002 | IGL | "Immunoglobulins/ IGL locus" |
| HGNC: 5867 | IGLJ5 | immunoglobulin lambda joining 5 (non-functional) | | | 22q11.2 | X51755 | NG_000002 | IGL | "Immunoglobulins/ IGL locus" |
| HGNC: 5868 | IGLJ6 | immunoglobulin lambda joining 6 | | | 22q11.2 | M18338 | NG_000002 | IGL | "Immunoglobulins/ IGL locus" |
| HGNC: 5869 | IGLJ7 | immunoglobulin lambda joining 7 | | | 22q11.2 | X51755 | NG_000002 | IGL | "Immunoglobulins/ IGL locus" |
| HGNC: 5876 | IGLV1-36 | immunoglobulin lambda variable 1-36 | | | 22q11.2 | Z73653 | NG_000002 | IGL | "Immunoglobulins/ IGL locus" |
| HGNC: 5877 | IGLV1-40 | immunoglobulin lambda variable 1-40 | | | 22q11.2 | M94116 | NG_000002 | IGL | "Immunoglobulins/ IGL locus" |
| HGNC: 5878 | IGLV1-41 | immunoglobulin lambda variable 1-41 (pseudogene) | | | 22q11.2 | M94118 | NG_000002 | IGL | "Immunoglobulins/ IGL locus" |
| HGNC: 5879 | IGLV1-44 | immunoglobulin lambda variable 1-44 | | | 22q11.2 | Z73654 | NG_000002 | IGL | "Immunoglobulins/ IGL locus" |
| HGNC: 5880 | IGLV1-47 | immunoglobulin lambda variable 1-47 | | | 22q11.2 | Z73663 | NG_000002 | IGL | "Immunoglobulins/ IGL locus" |
| HGNC: 5881 | IGLV1-50 | immunoglobulin lambda variable 1-50 (non-functional) | | | 22q11.2 | M94112 | NG_000002 | IGL | "Immunoglobulins/ IGL locus" |
| HGNC: 5882 | IGLV1-51 | immunoglobulin lambda variable 1-51 | | | 22q11.2 | Z73661 | NG_000002 | IGL | "Immunoglobulins/ IGL locus" |
| HGNC: 5883 | IGLV1-62 | immunoglobulin lambda variable 1-62 (pseudogene) | | | 22q11.2 | D87022 | NG_000002 | IGL | "Immunoglobulins/ IGL locus" |
| HGNC: 5894 | IGLV2-5 | immunoglobulin lambda variable 2-5 (pseudogene) | | | 22q11.2 | Z73641 | NG_000002 | IGL | "Immunoglobulins/ IGL locus" |
| HGNC: 5895 | IGLV2-8 | immunoglobulin lambda variable 2-8 | | | 22q11.2 | X97462 | NG_000002 | IGL | "Immunoglobulins/ IGL locus" |
| HGNC: 5887 | IGLV2-11 | immunoglobulin lambda variable 2-11 | | | 22q11.2 | Z73657 | NG_000002 | IGL | "Immunoglobulins/ IGL locus" |
| HGNC: 5888 | IGLV2-14 | immunoglobulin lambda variable 2-14 | | | 22q11.2 | Z73664 | NG_000002 | IGL | "Immunoglobulins/ IGL locus" |
| HGNC: 5889 | IGLV2-18 | immunoglobulin lambda variable 2-18 | | | 22q11.2 | Z73642 | NG_000002 | IGL | "Immunoglobulins/ IGL locus" |
| HGNC: 5890 | IGLV2-23 | immunoglobulin lambda variable 2-23 | | | 22q11.2 | X14616 | NG_000002 | IGL | "Immunoglobulins/ IGL locus" |

| HGNC ID | Approved Symbol | Approved Name | Previous Symbols | Synonyms | Chromosome | Accession Numbers | RefSeq IDs | Gene Family Tag | Gene family description |
|---|---|---|---|---|---|---|---|---|---|
| HGNC: 5891 | IGLV2-28 | immunoglobulin lambda variable 2-28 (pseudogene) | | | 22q11.2 | X97466 | NG_000002 | IGL | "Immunoglobulins/ IGL locus" |
| HGNC: 5892 | IGLV2-33 | immunoglobulin lambda variable 2-33 (non-functional) | | | 22q11.2 | Z73643 | NG_000002 | IGL | "Immunoglobulins/ IGL locus" |
| HGNC: 5893 | IGLV2-34 | immunoglobulin lambda variable 2-34 (pseudogene) | | | 22q11.2 | D87013 | NG_000002 | IGL | "Immunoglobulins/ IGL locus" |
| HGNC: 5896 | IGLV3-1 | immunoglobulin lambda variable 3-1 | | | 22q11.2 | X57826 | NG_000002 | IGL | "Immunoglobulins/ IGL locus" |
| HGNC: 5904 | IGLV3-2 | immunoglobulin lambda variable 3-2 (pseudogene) | | | 22q11.2 | X97468 | NG_000002 | IGL | "Immunoglobulins/ IGL locus" |
| HGNC: 5915 | IGLV3-4 | immunoglobulin lambda variable 3-4 (pseudogene) | | | 22q11.2 | D87024 | NG_000002 | IGL | "Immunoglobulins/ IGL locus" |
| HGNC: 5916 | IGLV3-6 | immunoglobulin lambda variable 3-6 (pseudogene) | | | 22q11.2 | X97465 | NG_000002 | IGL | "Immunoglobulins/ IGL locus" |
| HGNC: 5917 | IGLV3-7 | immunoglobulin lambda variable 3-7 (pseudogene) | | | 22q11.2 | X97470 | NG_000002 | IGL | "Immunoglobulins/ IGL locus" |
| HGNC: 5918 | IGLV3-9 | immunoglobulin lambda variable 3-9 (gene/pseudogene) | | | 22q11.2 | X97473 | NG_000002 | IGL | "Immunoglobulins/ IGL locus" |
| HGNC: 5897 | IGLV3-10 | immunoglobulin lambda variable 3-10 | | | 22q11.2 | X97464 | NG_000002 | IGL | "Immunoglobulins/ IGL locus" |
| HGNC: 5898 | IGLV3-12 | immunoglobulin lambda variable 3-12 | | | 22q11.2 | Z73658 | NG_000002 | IGL | "Immunoglobulins/ IGL locus" |
| HGNC: 5899 | IGLV3-13 | immunoglobulin lambda variable 3-13 (pseudogene) | | | 22q11.2 | X97463 | NG_000002 | IGL | "Immunoglobulins/ IGL locus" |
| HGNC: 5900 | IGLV3-15 | immunoglobulin lambda variable 3-15 (pseudogene) | | | 22q11.2 | D87015 | NG_000002 | IGL | "Immunoglobulins/ IGL locus" |
| HGNC: 5901 | IGLV3-16 | immunoglobulin lambda variable 3-16 | | | 22q11.2 | X97471 | NG_000002 | IGL | "Immunoglobulins/ IGL locus" |
| HGNC: 5902 | IGLV3-17 | immunoglobulin lambda variable 3-17 (pseudogene) | | | 22q11.2 | X97472 | NG_000002 | IGL | "Immunoglobulins/ IGL locus" |
| HGNC: 5903 | IGLV3-19 | immunoglobulin lambda variable 3-19 | | | 22q11.2 | X56178 | NG_000002 | IGL | "Immunoglobulins/ IGL locus" |
| HGNC: 5905 | IGLV3-21 | immunoglobulin lambda variable 3-21 | | | 22q11.2 | X71966 | NG_000002 | IGL | "Immunoglobulins/ IGL locus" |
| HGNC: 5906 | IGLV3-22 | immunoglobulin lambda variable 3-22 (gene/pseudogene) | | | 22q11.2 | Z73666 | NG_000002 | IGL | "Immunoglobulins/ IGL locus" |
| HGNC: 5907 | IGLV3-24 | immunoglobulin lambda variable 3-24 (pseudogene) | | | 22q11.2 | X71968 | NG_000002 | IGL | "Immunoglobulins/ IGL locus" |
| HGNC: 5908 | IGLV3-25 | immunoglobulin lambda variable 3-25 | | | 22q11.2 | X97474 | NG_000002 | IGL | "Immunoglobulins/ IGL locus" |
| HGNC: 5909 | IGLV3-26 | immunoglobulin lambda variable 3-26 (pseudogene) | | | 22q11.2 | X97467 | NG_000002 | IGL | "Immunoglobulins/ IGL locus" |
| HGNC: 5910 | IGLV3-27 | immunoglobulin lambda variable 3-27 | | | 22q11.2 | D86994 | NG_000002 | IGL | "Immunoglobulins/ IGL locus" |
| HGNC: 5911 | IGLV3-29 | immunoglobulin lambda variable 3-29 (pseudogene) | | | 22q11.2 | Z73644 | NG_000002 | IGL | "Immunoglobulins/ IGL locus" |
| HGNC: 5912 | IGLV3-30 | immunoglobulin lambda variable 3-30 (pseudogene) | | | 22q11.2 | Z73646 | NG_000002 | IGL | "Immunoglobulins/ IGL locus" |

| HGNC ID | Approved Symbol | Approved Name | Previous Symbols | Synonyms | Chromosome | Accession Numbers | RefSeq IDs | Gene Family Tag | Gene family description |
|---|---|---|---|---|---|---|---|---|---|
| HGNC: 5913 | IGLV3-31 | immunoglobulin lambda variable 3-31 (pseudogene) | | | 22q11.2 | X97469 | NG_000002 | IGL | "Immunoglobulins/ IGL locus" |
| HGNC: 5914 | IGLV3-32 | immunoglobulin lambda variable 3-32 (non-functional) | | | 22q11.2 | Z73645 | NG_000002 | IGL | "Immunoglobulins/ IGL locus" |
| HGNC: 5919 | IGLV4-3 | immunoglobulin lambda variable 4-3 | | | 22q11.2 | X57828 | NG_000002 | IGL | "Immunoglobulins/ IGL locus" |
| HGNC: 5920 | IGLV4-60 | immunoglobulin lambda variable 4-60 | | | 22q11.2 | Z73667 | NG_000002 | IGL | "Immunoglobulins/ IGL locus" |
| HGNC: 5921 | IGLV4-69 | immunoglobulin lambda variable 4-69 | | | 22q11.2 | Z73648 | NG_000002 | IGL | "Immunoglobulins/ IGL locus" |
| HGNC: 5922 | IGLV5-37 | immunoglobulin lambda variable 5-37 | | | 22q11.2 | Z73672 | NG_000002 | IGL | "Immunoglobulins/ IGL locus" |
| HGNC: 5923 | IGLV5-39 | immunoglobulin lambda variable 5-39 | | | 22q11.2 | Z73668 | | IGL | "Immunoglobulins/ IGL locus" |
| HGNC: 5924 | IGLV5-45 | immunoglobulin lambda variable 5-45 | | | 22q11.2 | Z73670 | NG_000002 | IGL | "Immunoglobulins/ IGL locus" |
| HGNC: 5925 | IGLV5-48 | immunoglobulin lambda variable 5-48 (non-functional) | | | 22q11.2 | Z73649 | NG_000002 | IGL | "Immunoglobulins/ IGL locus" |
| HGNC: 5926 | IGLV5-52 | immunoglobulin lambda variable 5-52 | | | 22q11.2 | Z73669 | NG_000002 | IGL | "Immunoglobulins/ IGL locus" |
| HGNC: 5927 | IGLV6-57 | immunoglobulin lambda variable 6-57 | | | 22q11.2 | Z73673 | NG_000002 | IGL | "Immunoglobulins/ IGL locus" |
| HGNC: 5928 | IGLV7-35 | immunoglobulin lambda variable 7-35 (pseudogene) | | | 22q11.2 | Z73660 | NG_000002 | IGL | "Immunoglobulins/ IGL locus" |
| HGNC: 5929 | IGLV7-43 | immunoglobulin lambda variable 7-43 | | | 22q11.2 | X14614 | NG_000002 | IGL | "Immunoglobulins/ IGL locus" |
| HGNC: 5930 | IGLV7-46 | immunoglobulin lambda variable 7-46 (gene/pseudogene) | | | 22q11.2 | Z73674 | NG_000002 | IGL | "Immunoglobulins/ IGL locus" |
| HGNC: 5931 | IGLV8-61 | immunoglobulin lambda variable 8-61 | | | 22q11.2 | Z73650 | NG_000002 | IGL | "Immunoglobulins/ IGL locus" |
| HGNC: 5933 | IGLV9-49 | immunoglobulin lambda variable 9-49 | | | 22q11.2 | Z73675 | NG_000002 | IGL | "Immunoglobulins/ IGL locus" |
| HGNC: 5884 | IGLV10-54 | immunoglobulin lambda variable 10-54 | | | 22q11.2 | Z73676 | NG_000002 | IGL | "Immunoglobulins/ IGL locus" |
| HGNC: 5885 | IGLV10-67 | immunoglobulin lambda variable 10-67 (pseudogene) | | | 22q11.2 | Z73651 | NG_000002 | IGL | "Immunoglobulins/ IGL locus" |
| HGNC: 5886 | IGLV11-55 | immunoglobulin lambda variable 11-55 (non-functional) | | | 22q11.2 | D86996 | NG_000002 | IGL | "Immunoglobulins/ IGL locus" |
| HGNC: 5934 | IGLVI-20 | immunoglobulin lambda variable (I)-20 (pseudogene) | | IGLV(I)-20 | 22q11.2 | D87007 | NG_000002 | IGL | "Immunoglobulins/ IGL locus" |
| HGNC: 5935 | IGLVI-38 | immunoglobulin lambda variable (I)-38 (pseudogene) | | IGLV(I)-38 | 22q11.2 | D87009 | NG_000002 | IGL | "Immunoglobulins/ IGL locus" |
| HGNC: 5936 | IGLVI-42 | immunoglobulin lambda variable (I)-42 (pseudogene) | | IGLV(I)-42 | 22q11.2 | X14613 | NG_000002 | IGL | "Immunoglobulins/ IGL locus" |

-continued

| HGNC ID | Approved Symbol | Approved Name | Previous Symbols | Synonyms | Chromosome | Accession Numbers | RefSeq IDs | Gene Family Tag | Gene family description |
|---|---|---|---|---|---|---|---|---|---|
| HGNC: 5937 | IGLVI-56 | immunoglobulin lambda variable (I)-56 (pseudogene) | | IGLV(I)-56 | 22q11.2 | D86996 | NG_000002 | IGL | "Immunoglobulins/ IGL locus" |
| HGNC: 5938 | IGLVI-63 | immunoglobulin lambda variable (I)-63 (pseudogene) | | IGLV(I)-63 | 22q11.2 | D87022 | NG_000002 | IGL | "Immunoglobulins/ IGL locus" |
| HGNC: 5939 | IGLVI-68 | immunoglobulin lambda variable (I)-68 (pseudogene) | | IGLV(I)-68 | 22q11.2 | D86993 | NG_000002 | IGL | "Immunoglobulins/ IGL locus" |
| HGNC: 5940 | IGLVI-70 | immunoglobulin lambda variable (I)-70 (pseudogene) | | IGLV(I)-70 | 22q11.2 | D86993 | NG_000002 | IGL | "Immunoglobulins/ IGL locus" |
| HGNC: 5941 | IGLVIV-53 | immunoglobulin lambda variable (IV)-53 (pseudogene) | | IGLV(IV)-53 | 22q11.2 | D86996 | NG_000002 | IGL | "Immunoglobulins/ IGL locus" |
| HGNC: 5942 | IGLVIV-59 | immunoglobulin lambda variable (IV)-59 (pseudogene) | | IGLV(IV)-59 | 22q11.2 | D87000 | NG_000002 | IGL | "Immunoglobulins/ IGL locus" |
| HGNC: 5943 | IGLVIV-64 | immunoglobulin lambda variable (IV)-64 (pseudogene) | | IGLV(IV)-64 | 22q11.2 | D87022 | NG_000002 | IGL | "Immunoglobulins/ IGL locus" |
| HGNC: 5944 | IGLVIV-65 | immunoglobulin lambda variable (IV)-65 (pseudogene) | | IGLV(IV)-65 | 22q11.2 | D87022 | NG_000002 | IGL | "Immunoglobulins/ IGL locus" |
| HGNC: 15692 | IGLVIV-66-1 | immunoglobulin lambda variable (IV)-66-1 (pseudogene) | | IGLV(IV)-66-1 | 22q11.2 | D87004 | NG_000002 | IGL | "Immunoglobulins/ IGL locus" |
| HGNC: 5945 | IGLVV-58 | immunoglobulin lambda variable (V)-58 (pseudogene) | | IGLV(V)-58 | 22q11.2 | D87000 | NG_000002 | IGL | "Immunoglobulins/ IGL locus" |
| HGNC: 5946 | IGLVV-66 | immunoglobulin lambda variable (V)-66 (pseudogene) | | IGLV(V)-66 | 22q11.2 | D87004 | NG_000002 | IGL | "Immunoglobulins/ IGL locus" |
| HGNC: 15689 | IGLVVI-22-1 | immunoglobulin lambda variable (VI)-22-1 (pseudogene) | | IGLV(VI)-22-1 | 22q11.2 | X71351 | NG_000002 | IGL | "Immunoglobulins/ IGL locus" |
| HGNC: 15690 | IGLVVI-25-1 | immunoglobulin lambda variable (VI)-25-1 (pseudogene) | | IGLV(VI)-25-1 | 22q11.2 | D86994 | NG_000002 | IGL | "Immunoglobulins/ IGL locus" |
| HGNC: 15691 | IGLVVII-41-1 | immunoglobulin lambda variable (VII)-41-1 (pseudogene) | | IGLV(VII)-41-1 | 22q11.2 | X99568 | NG_000002 | IGL | "Immunoglobulins/ IGL locus" |

In exemplary aspects, the method comprises measuring the expression of one or more IGH, IGK, or IGL orphon gene segments, and optionally, the one or more gene segments is one listed in the following table.

| HGNC ID | Approved Symbol | Approved Name | Previous Symbols | Synonyms | Chromosome |
|---|---|---|---|---|---|
| HGNC: 5487 | IGHD1OR15-1A | immunoglobulin heavy diversity 1/OR15-1A (non-functional) | | IGHD1/OR15-1A, IGHD1OR151A | 15q11.2 |

| | | | | |
|---|---|---|---|---|
| HGNC: 5488 | IGHD1OR15-1B | immunoglobulin heavy diversity 1/OR15-1B (non-functional) | IGHD1/OR15-1B, IGHD1OR151B | 15q11.2 |
| HGNC: 5493 | IGHD2OR15-2A | immunoglobulin heavy diversity 2/OR15-2A (non-functional) | IGHD2/OR15-2A, IGHD2OR152A | 15q11.2 |
| HGNC: 5494 | IGHD2OR15-2B | immunoglobulin heavy diversity 2/OR15-2B (non-functional) | IGHD2/OR15-2B, IGHD2OR152B | 15q11.2 |
| HGNC: 5500 | IGHD3OR15-3A | immunoglobulin heavy diversity 3/OR15-3A (non-functional) | IGHD3/OR15-3A, IGHD3OR153A | 15q11.2 |
| HGNC: 5501 | IGHD3OR15-3B | immunoglobulin heavy diversity 3/OR15-3B (non-functional) | IGHD3/OR15-3B, IGHD3OR153B | 15q11.2 |
| HGNC: 5506 | IGHD4OR15-4A | immunoglobulin heavy diversity 4/OR15-4A (non-functional) | IGHD4/OR15-4A, IGHD4OR154A | 15q11.2 |
| HGNC: 5507 | IGHD4OR15-4B | immunoglobulin heavy diversity 4/OR15-4B (non-functional) | IGHD4/OR15-4B, IGHD4OR154B | 15q11.2 |
| HGNC: 5512 | IGHD5OR15-5A | immunoglobulin heavy diversity 5/OR15-5A (non-functional) | IGHD5/OR15-5A, IGHD5OR155A | 15q11.2 |
| HGNC: 5513 | IGHD5OR15-5B | immunoglobulin heavy diversity 5/OR15-5B (non-functional) | IGHD5/OR15-5B, IGHD5OR155B | 15q11.2 |
| HGNC: 5524 | IGHEP2 | immunoglobulin heavy constant epsilon P2 (pseudogene) | | 9p24.1 |
| HGNC: 5563 | IGHV1OR15-1 | immunoglobulin heavy variable 1/OR15-1 (non-functional) | IGHV1/OR15-1 | 15q11.2 |
| HGNC: 5564 | IGHV1OR15-2 | immunoglobulin heavy variable 1/OR15-2 (pseudogene) | IGHV1/OR15-2 | 15q11.1 |
| HGNC: 5565 | IGHV1OR15-3 | immunoglobulin heavy variable 1/OR15-3 (pseudogene) | IGHV1/OR15-3 | 15q11.2 |
| HGNC: 5566 | IGHV1OR15-4 | immunoglobulin heavy variable 1/OR15-4 (pseudogene) | IGHV1/OR15-4 | 15q11.2 |

| | | | | | |
|---|---|---|---|---|---|
| HGNC: 5567 | IGHV1OR15-5 | immunoglobulin heavy variable 1/OR15-5 (non-functional) | | IGHV1/OR15-5 | 15q11.2 |
| HGNC: 5568 | IGHV1OR15-6 | immunoglobulin heavy variable 1/OR15-6 (pseudogene) | | IGHV1/OR15-6 | 15q11.2 |
| HGNC: 5569 | IGHV1OR15-9 | immunoglobulin heavy variable 1/OR15-9 (non-functional) | VSIG7 | IGHV1/OR15-9, IGHV1OR159 | 15q11.1 |
| HGNC: 5570 | IGHV1OR16-1 | immunoglobulin heavy variable 1/OR16-1 (pseudogene) | | IGHV1/OR16-1 | 16p11.2 |
| HGNC: 5571 | IGHV1OR16-2 | immunoglobulin heavy variable 1/OR16-2 (pseudogene) | | IGHV1/OR16-2 | 16p11.2 |
| HGNC: 5572 | IGHV1OR16-3 | immunoglobulin heavy variable 1/OR16-3 (pseudogene) | | IGHV1/OR16-3 | 16p11.2 |
| HGNC: 5573 | IGHV1OR16-4 | immunoglobulin heavy variable 1/OR16-4 (pseudogene) | | IGHV1/OR16-4 | 16p11.2 |
| HGNC: 38040 | IGHV1OR21-1 | immunoglobulin heavy variable 1/OR21-1 (non-functional) | | IGHV1/OR21-1 | 21p11.2 |
| HGNC: 5579 | IGHV2OR16-5 | immunoglobulin heavy variable 2/OR16-5 (non-functional) | | IGHV2/OR16-5 | 16p11.2 |
| HGNC: 5633 | IGHV3OR15-7 | immunoglobulin heavy variable 3/OR15-7 (pseudogene) | | IGHV3/OR15-7 | 15q11.2 |
| HGNC: 5641 | IGHV3OR16-6 | immunoglobulin heavy variable 3/OR16-6 (pseudogene) | | IGHV3/OR16-6 | 16p11.2 |
| HGNC: 5642 | IGHV3OR16-7 | immunoglobulin heavy variable 3/OR16-7 (pseudogene) | | IGHV3/OR16-7 | 16p11.2 |
| HGNC: 5643 | IGHV3OR16-8 | immunoglobulin heavy variable 3/OR16-8 (non-functional) | | IGHV3/OR16-8 | 16p11.2 |
| HGNC: 5644 | IGHV3OR16-9 | immunoglobulin heavy variable 3/OR16-9 (non-functional) | | IGHV3/OR16-9 | 16p11.2 |
| HGNC: 5634 | IGHV3OR16-10 | immunoglobulin heavy variable 3/OR16-10 (non-functional) | | IGHV3/OR16-10 | 16p11.2 |

| | | | | | |
|---|---|---|---|---|---|
| HGNC: 5635 | IGHV3OR16-11 | immunoglobulin heavy variable 3/OR16-11 (pseudogene) | | IGHV3/OR16-11 | 16p11.2 |
| HGNC: 5636 | IGHV3OR16-12 | immunoglobulin heavy variable 3/OR16-12 (non-functional) | | IGHV3/OR16-12 | 16p11.2 |
| HGNC: 5637 | IGHV3OR16-13 | immunoglobulin heavy variable 3/OR16-13 (non-functional) | | IGHV3/OR16-13 | 16p11.2 |
| HGNC: 5638 | IGHV3OR16-14 | immunoglobulin heavy variable 3/OR16-14 (pseudogene) | | IGHV3/OR16-14 | 16p11.2 |
| HGNC: 5639 | IGHV3OR16-15 | immunoglobulin heavy variable 3/OR16-15 (pseudogene) | | IGHV3/OR16-15 | 16p11.2 |
| HGNC: 5640 | IGHV3OR16-16 | immunoglobulin heavy variable 3/OR16-16 (pseudogene) | | IGHV3/OR16-16 | 16p11.2 |
| HGNC: 5658 | IGHV4OR15-8 | immunoglobulin heavy variable 4/OR15-8 (non-functional) | VSIG6 | IGHV4/OR15-8, IGHV4OR158 | 15q11.2 |
| HGNC: 5761 | IGKV1OR-2 | immunoglobulin kappa variable 1/OR-2 (pseudogene) | IGKVPZ2 | IGKV1/OR-2 | 9q21.11 |
| HGNC: 5762 | IGKV1OR-3 | immunoglobulin kappa variable 1/OR-3 (pseudogene) | IGKVPZ3 | IGKV1/OR-3 | 9q12 |
| HGNC: 5763 | IGKV1OR-4 | immunoglobulin kappa variable 1/OR-4 (pseudogene) | IGKVPZ4 | IGKV1/OR-4 | reserved |
| HGNC: 5764 | IGKV1OR1-1 | immunoglobulin kappa variable 1/OR1-1 (pseudogene) | IGKVP1 | IGKV1/OR1-1 | 1 |
| HGNC: 5766 | IGKV1OR2-0 | immunoglobulin kappa variable 1/OR2-0 (non-functional) | | IGKV1/OR2-0 | 2p11.2 |
| HGNC: 5760 | IGKV1OR2-1 | immunoglobulin kappa variable 1/OR2-1 (pseudogene) | IGKVPZ1, IGKV1OR-1 | IGKV1/OR-1, IGKV1/OR2-1 | 2p11.1 |
| HGNC: 5769 | IGKV1OR2-3 | immunoglobulin kappa variable 1/OR2-3 (pseudogene) | | IGKV1/OR2-3 | 2q11.2 |
| HGNC: 5770 | IGKV1OR2-6 | immunoglobulin kappa variable 1/OR2-6 (pseudogene) | | IGKV1/OR2-6 | 2q11.2 |
| HGNC: 5771 | IGKV1OR2-9 | immunoglobulin kappa variable 1/OR2-9 (pseudogene) | | IGKV1/OR2-9 | 2q11.2 |

-continued

| HGNC: 5768 | IGKV1OR2-11 | immunoglobulin kappa variable 1/OR2-11 (pseudogene) | | IGKV1/OR2-11 | 2q11.2 |
| HGNC: 5767 | IGKV1OR2-108 | immunoglobulin kappa variable 1/OR2-108 (non-functional) | | IGKV1/OR2-108, IGKV1OR2108, IGO1 | 2q12-q14 |
| HGNC: 37488 | IGKV1OR2-118 | immunoglobulin kappa variable 1/OR2-118 (pseudogene) | | IGKV1/OR2-118 | 2p11.1 |
| HGNC: 44978 | IGKV1OR10-1 | immunoglobulin kappa variable 1/OR10-1 (pseudogene) | | IGKV1/OR10-1 | 10q11.21 |
| HGNC: 5765 | IGKV1OR15-118 | immunoglobulin kappa variable 1/OR15-118 (pseudogene) | IGKVP2 | IGKV1/OR-118, IGKV1/OR15-118 | 15 |
| HGNC: 5772 | IGKV1OR22-1 | immunoglobulin kappa variable 1/OR22-1 (pseudogene) | IGKVP5 | IGKV1/OR22-1 | 22q11 |
| HGNC: 5773 | IGKV1OR22-5 | immunoglobulin kappa variable 1/OR22-5 (pseudogene) | IGKVP7, IGKV1OR22-5A | IGKV1/OR22-5, IGKV1/OR22-5A | 22q11 |
| HGNC: 37729 | IGKV1ORY-1 | immunoglobulin kappa variable 1/ORY-1 (pseudogene) | | IGKV1/ORY-1 | Yq11.21 |
| HGNC: 5805 | IGKV2OR2-1 | immunoglobulin kappa variable 2/OR2-1 (pseudogene) | IGKV2OR2-1A | IGKV2/OR2-1, IGKV2/OR2-1A | 2q11.2 |
| HGNC: 5808 | IGKV2OR2-2 | immunoglobulin kappa variable 2/OR2-2 (pseudogene) | | IGKV2/OR2-2 | 2q11.2 |
| HGNC: 5809 | IGKV2OR2-4 | immunoglobulin kappa variable 2/OR2-4 (pseudogene) | | IGKV2/OR2-4 | 2q11.2 |
| HGNC: 5810 | IGKV2OR2-7 | immunoglobulin kappa variable 2/OR2-7 (pseudogene) | | IGKV2/OR2-7 | 2q11.2 |
| HGNC: 37489 | IGKV2OR2-7D | immunoglobulin kappa variable 2/OR2-7D (pseudogene) | | IGKV2/OR2-7D | 2q11.2 |
| HGNC: 5811 | IGKV2OR2-8 | immunoglobulin kappa variable 2/OR2-8 (pseudogene) | | IGKV2/OR2-8 | 2q11.2 |
| HGNC: 5806 | IGKV2OR2-10 | immunoglobulin kappa variable 2/OR2-10 (pseudogene) | | IGKV2/OR2-10 | 2q11.2 |

| HGNC: 5812 | IGKV2OR22-3 | immunoglobulin kappa variable 2/OR22-3 (pseudogene) | IGKVP4 | IGKV2/OR22-3 | 22q11 |
| HGNC: 5813 | IGKV2OR22-4 | immunoglobulin kappa variable 2/OR22-4 (pseudogene) | IGKVP6 | IGKV2/OR22-4 | 22q11 |
| HGNC: 5832 | IGKV3OR2-5 | immunoglobulin kappa variable 3/OR2-5 (pseudogene) | | IGKV3/OR2-5 | 2q11.2 |
| HGNC: 5830 | IGKV3OR2-268 | immunoglobulin kappa variable 3/OR2-268 (non-functional) | IGKV268, IGKV3OR2-268A | IGKV3/OR2-268, IGKV3/OR2-268A | 2p12 |
| HGNC: 5833 | IGKV3OR22-2 | immunoglobulin kappa variable 3/OR22-2 (pseudogene) | IGKVP3 | IGKV3/OR22-2 | 22q11 |
| HGNC: 15696 | IGLCOR22-1 | immunoglobulin lambda constant/OR22-1 (pseudogene) | | IGLC/OR22-1 | 22q12.2-q12.3 |
| HGNC: 15697 | IGLCOR22-2 | immunoglobulin lambda constant/OR22-2 (pseudogene) | | IGLC/OR22-2 | 22q12.2-q12.3 |
| HGNC: 28614 | IGLJCOR18 | immunoglobulin lambda joining-constant/OR18 (pseudogene) | | IGLJ-COR18, IGLJ-C/OR18 | 18p11.31 |
| HGNC: 5932 | IGLV8OR8-1 | immunoglobulin lambda variable 8/OR8-1 (pseudogene) | | IGLV8/OR8-1 | 8q11.2 |
| HGNC: 15694 | IGLVIVOR22-1 | immunoglobulin lambda variable (IV)/OR22-1 (pseudogene) | | IGLV(IV)/OR22-1 | 22q11.2-q12.1 |
| HGNC: 15695 | IGLVIVOR22-2 | immunoglobulin lambda variable (IV)/OR22-2 (pseudogene) | | IGLV(IV)/OR22-2 | 22q12.2-q12.3 |

| HGNC ID | Accession Numbers | RefSeq IDs | Gene Family Tag | Gene family description |
| --- | --- | --- | --- | --- |
| HGNC: 5487 | X55575 | | IGHO | "Immunoglobulins/IGH orphons" |
| HGNC: 5488 | X55576 | | IGHO | "Immunoglobulins/IGH orphons" |
| HGNC: 5493 | X55577 | | IGHO | "Immunoglobulins/IGH orphons" |
| HGNC: 5494 | X55578 | | IGHO | "Immunoglobulins/IGH orphons" |
| HGNC: 5500 | X55579 | | IGHO | "Immunoglobulins/IGH orphons" |
| HGNC: 5501 | X55580 | | IGHO | "Immunoglobulins/IGH orphons" |
| HGNC: 5506 | X55581 | | IGHO | "Immunoglobulins/IGH orphons" |
| HGNC: 5507 | X55582 | | IGHO | "Immunoglobulins/IGH orphons" |
| HGNC: 5512 | X55583 | | IGHO | "Immunoglobulins/IGH orphons" |
| HGNC: 5513 | X55584 | | IGHO | "Immunoglobulins/IGH orphons" |

-continued

| | | | | |
|---|---|---|---|---|
| HGNC: 5524 | K01241 | NG_003254 | IGHO | "Immunoglobulins/ IGH orphons" |
| HGNC: 5563 | Z29631 | | IGHO | "Immunoglobulins/ IGH orphons" |
| HGNC: 5564 | L25543 | | IGHO | "Immunoglobulins/ IGH orphons" |
| HGNC: 5565 | Z29595 | | IGHO | "Immunoglobulins/ IGH orphons" |
| HGNC: 5566 | Z29596 | | IGHO | "Immunoglobulins/ IGH orphons" |
| HGNC: 5567 | Z29633 | NG_016978 | IGHO | "Immunoglobulins/ IGH orphons" |
| HGNC: 5568 | Z29634 | | IGHO | "Immunoglobulins/ IGH orphons" |
| HGNC: 5569 | L25542 | | IGHO | "Immunoglobulins/ IGH orphons" |
| HGNC: 5570 | Z29599 | | IGHO | "Immunoglobulins/ IGH orphons" |
| HGNC: 5571 | Z29600 | | IGHO | "Immunoglobulins/ IGH orphons" |
| HGNC: 5572 | Z29639 | | IGHO | "Immunoglobulins/ IGH orphons" |
| HGNC: 5573 | Z17397 | | IGHO | "Immunoglobulins/ IGH orphons" |
| HGNC: 3804 | | NG_011680 | IGHO | "Immunoglobulins/ IGH orphons" |
| HGNC: 5579 | L25544 | | IGHO | "Immunoglobulins/ IGH orphons" |
| HGNC: 5633 | Z29597 | | IGHO | "Immunoglobulins/ IGH orphons" |
| HGNC: 5641 | L25545 | | IGHO | "Immunoglobulins/ IGH orphons" |
| HGNC: 5642 | Z29604 | | IGHO | "Immunoglobulins/ IGH orphons" |
| HGNC: 5643 | Z29605 | | IGHO | "Immunoglobulins/ IGH orphons" |
| HGNC: 5644 | Z29606 | | IGHO | "Immunoglobulins/ IGH orphons" |
| HGNC: 5634 | Z29607 | | IGHO | "Immunoglobulins/ IGH orphons" |
| HGNC: 5635 | Z29608 | | IGHO | "Immunoglobulins/ IGH orphons" |
| HGNC: 5636 | Z29609 | | IGHO | "Immunoglobulins/ IGH orphons" |
| HGNC: 5637 | Z29610 | NG_011771 | IGHO | "Immunoglobulins/ IGH orphons" |
| HGNC: 5638 | Z29611 | | IGHO | "Immunoglobulins/ IGH orphons" |
| HGNC: 5639 | L25546 | | IGHO | "Immunoglobulins/ IGH orphons" |
| HGNC: 5640 | Z29613 | | IGHO | "Immunoglobulins/ IGH orphons" |
| HGNC: 5658 | Z29598 | | IGHO | "Immunoglobulins/ IGH orphons" |
| HGNC: 5761 | X64640 | NG_011657 | IGKO | "Immunoglobulins/ IGK orphons" |
| HGNC: 5762 | X64641 | | IGKO | "Immunoglobulins/ IGK orphons" |
| HGNC: 5763 | X64642 | | IGKO | "Immunoglobulins/ IGK orphons" |
| HGNC: 5764 | M20809 | NG_011766 | IGKO | "Immunoglobulins/ IGK orphons" |
| HGNC: 5766 | Y08392 | | IGKO | "Immunoglobulins/ IGK orphons" |
| HGNC: 5760 | Z12367 | | IGKO | "Immunoglobulins/ IGK orphons" |
| HGNC: 5769 | X05102 | | IGKO | "Immunoglobulins/ IGK orphons" |
| HGNC: 5770 | X05103 | | IGKO | "Immunoglobulins/ IGK orphons" |
| HGNC: 5771 | X51879 | | IGKO | "Immunoglobulins/ IGK orphons" |
| HGNC: 5768 | X51885 | | IGKO | "Immunoglobulins/ IGK orphons" |
| HGNC: 5767 | X51887 | | IGKO | "Immunoglobulins/ IGK orphons" |
| HGNC: 37488 | | NG_011659 | IGKO | "Immunoglobulins/ IGK orphons" |

-continued

| | | | | |
|---|---|---|---|---|
| HGNC: 44978 | | | IGKO | "Immunoglobulins/ IGK orphons" |
| HGNC: 5765 | | | IGKO | "Immunoglobulins/ IGK orphons" |
| HGNC: 5772 | Z00040 | NG_011658 | IGKO | "Immunoglobulins/ IGK orphons" |
| HGNC: 5773 | Z00003 | | IGKO | "Immunoglobulins/ IGK orphons" |
| HGNC: 37729 | | | IGKO | "Immunoglobulins/ IGK orphons" |
| HGNC: 5805 | X05101 | | IGKO | "Immunoglobulins/ IGK orphons" |
| HGNC: 5808 | X51884 | | IGKO | "Immunoglobulins/ IGK orphons" |
| HGNC: 5809 | X51883 | | IGKO | "Immunoglobulins/ IGK orphons" |
| HGNC: 5810 | X51881 | NG_011671 | IGKO | "Immunoglobulins/ IGK orphons" |
| HGNC: 37489 | X51881 | | IGKO | "Immunoglobulins/ IGK orphons" |
| HGNC: 5811 | X51880 | NG_011662 | IGKO | "Immunoglobulins/ IGK orphons" |
| HGNC: 5806 | X51886 | NG_011661 | IGKO | "Immunoglobulins/ IGK orphons" |
| HGNC: 5812 | Z00041 | | IGKO | "Immunoglobulins/ IGK orphons" |
| HGNC: 5813 | M20707 | | IGKO | "Immunoglobulins/ IGK orphons" |
| HGNC: 5832 | X51882 | | IGKO | "Immunoglobulins/ IGK orphons" |
| HGNC: 5830 | X74459 | | IGKO | "Immunoglobulins/ IGK orphons" |
| HGNC: 5833 | Z00042 | | IGKO | "Immunoglobulins/ IGK orphons" |
| HGNC: 15696 | AL008723 | | IGLO | "Immunoglobulins/ IGL orphons" |
| HGNC: 15697 | AL021937 | | IGLO | "Immunoglobulins/ IGL orphons" |
| HGNC: 28614 | J00255 | XM_497569 | IGLO | "Immunoglobulins/ IGL orphons" |
| HGNC: 5932 | Y08831 | | IGLO | "Immunoglobulins/ IGL orphons" |
| HGNC: 15694 | AL008721 | | IGLO | "Immunoglobulins/ IGL orphons" |
| HGNC: 15695 | AL021937 | | IGLO | "Immunoglobulins/ IGL orphons" |

In exemplary aspects of the inventive methods provided herein, the method comprises measuring the level of expression of all the gene segments at the IGH, IGK, and IGL loci and all the IGH orhpon gene segments, all the IGK orphon gene segments, and all the IGL orphon gene segments. In exemplary aspects, the level of expression is the sum of the expression levels of more than one gene segment of the IgH locus, IgK locus, and/or IgL locus. In exemplary aspects, the level of Ig expression is the sum of the expression levels of all the gene segments of the IgH locus and optionally all the IGH orphon gene segments. In exemplary aspects, the level of Ig expression is the sum of the expression levels of all the gene segments of the IgK locus and optionally all the IGK orphon gene segments. In exemplary aspects, the level of Ig expression is the sum of the expression levels of all the gene segments of the IgL locus and optionally all the IGL orphon gene segments. In exemplary aspects, the level of expression of Ig is the sum of (i) the levels of expression of all the gene segments of the IgH locus, (ii) the levels of expression of all the gene segments of the IgK locus, and (iii) the levels of expression of all the gene segments of the IgL locus, and optionally, all the IgH orphon gene segments, all the IgK orphon gene segments, and all the IgL orphon gene segments.

FCGR2B

In exemplary aspects, the sample obtained from the subject is measured for the expression level of FCGR2B. FCGR2B is also known as CD32 of the Fc fragmen of IgG, low affinity IIb, receptor. The gene encoding FCGR2B is located at ch. 1q23. Exemplary sequences encoding FCGR2B are provided herein as SEQ ID NO: 351 and 352, but are also known in the art. The FCGR2B gene is Entrez Gene No. 2213. The nucleotide sequence and amino acid sequence are available in the NCBI's nucleotide database as Accession No. NM_004001 and NP_003992.3 (SEQ ID NOs: 352-353, respectively).

Genes and Gene Segments of Table 4

In exemplary aspects, the sample obtained from the subject is measured for the expression level of one or more genes (or gene segments) listed in Table 4 set forth below. As used herein, the term "gene" refers to both a gene and gene segments. Table 4 includes, for each gene (or gene segment): (i) the HUGO gene symbol, if available, (ii) the Ensembl Gene Name, (iii) gene expression level data, and (iv) statistical data: the P-value and Q-value. The HUGO Gene Symbol is a name determined and approved by the HUGO Gene Nomenclature Committee (HGNC). The HGNC approves both a short-form abbreviation known as a gene symbol, and also a longer and more descriptive name.

Each gene symbol is unique and the HGNC ensures that each gene is only given one approved gene symbol. This unique gene symbol allows for clear and unambiguous reference to genes in scientific communications, and facilitates electronic data retrieval from databases and publications. Gene symbols also maintain parallel construction for different members of a gene family and can also be used for orthologous genes in other vertebrate species. A record for each gene symbol listed in Table 4 is accessible by the public via the HGNC database. The HGNC database is a curated online repository of HGNC-approved gene nomenclature, gene families, and associated resources including links to genomic, proteomic and phenotypic information. The HGNC database contains records for over 38,000 gene symbols is accessible to the public on the internet at http://www.genenames.org. The Ensemble Gene Name provided in Table 4 is the one listed in the HGNC database record for the indicated gene or gene segment. The Ensembl project produces genome databases for vertebrates and other eukaryotic species, and makes this information freely available on the internet at http://uswest.ensembl.org/index.html. When this Ensembl gene name or accession number is entered in the search window at the above web address, the sequence of the gene, as well as other structural information of the gene, may be accessed.

Reference Levels and Reference Values

In exemplary embodiments of the inventive methods, the expression level of the indicated gene(s) or gene segment(s) is/are compared to a reference level or reference value. As used herein, the term "reference level" is a cutoff or threshold against which the measured expression level is compared, which correlates with a pre-determined % specificity and/or pre-determined % sensitivity, as determined by a receiver operative characteristics (ROC) curve. In exemplary aspects, the ROC curve is based on the distribution of biomarker expression levels of a population of responders and the distribution of biomarker expression levels of a population of non-responders. In exemplary aspects, the reference level is a cutoff which correlates with X % specificity and Y % sensitivity, as determined by an ROC curve, wherein each of X and Y is selected from 25, 30, 35, 40, 45, 50, 55, 60, 65, 70, 75, 80, 85, 90, 91, 92, 93, 94, 95, 96, 97, 98, and 99.

In exemplary aspects, when the level of expression of an Ig is measured or has been measured, the reference level is a cutoff correlative with a pre-determined % specificity and/or pre-determined % sensitivity, as determined by a receiver operative characteristics (ROC) curve. In exemplary aspects, the ROC curve is based on the distribution of Ig expression levels of a population of responders and the distribution of Ig expression levels of a population of non-responders. Exemplary definitions of responders and non-responders are found herein at Example 2. In exemplary aspects, the reference level is the point on the ROC curve at which the % specificity is X %, wherein X is selected from 25, 30, 35, 40, 45, 50, 55, 60, 65, 70, 75, 80, 85, 90, 91, 92, 93, 94, 95, 96, 97, 98, and 99. In exemplary aspects, the reference level is the point on the ROC curve at which the % sensitivity is Y %, wherein Y is selected from 25, 30, 35, 40, 45, 50, 55, 60, 65, 70, 75, 80, 85, 90, 91, 92, 93, 94, 95, 96, 97, 98, and 99. In exemplary aspects, the reference level is a cut off correlative with a % specificity of at least 50% and a % sensitivity of at least 50%, as determined by the ROC curve. In exemplary aspects, the reference level is a cut off correlative with a % specificity of at least 75% and a % sensitivity of at least 75%, as determined by the ROC curve. In exemplary aspects, the reference level is a cut off correlative with a % specificity of at least 85% and a % sensitivity of at least 85%, as determined by the ROC curve. In exemplary aspects, the reference level is a cut off correlative with a % specificity of at least 90% and a % sensitivity of at least 90%, as determined by the ROC curve.

In exemplary aspects, when the level of expression of FCGR2B is measured or has been measured, the reference level is a cutoff correlative with a pre-determined % specificity and/or pre-determined % sensitivity, as determined by an ROC curve. In exemplary aspects, the ROC curve is based on the distribution of FCGR2B expression levels of a population of responders and the distribution of FCGR2B expression levels of a population of non-responders. Exemplary definitions of responders and non-responders are found herein at Example 2. In exemplary aspects, the reference level is the point on the ROC curve at which the % specificity is X %, wherein X is selected from 25, 30, 35, 40, 45, 50, 55, 60, 65, 70, 75, 80, 85, 90, 91, 92, 93, 94, 95, 96, 97, 98, and 99. In exemplary aspects, the reference level is the point on the ROC curve at which the % sensitivity is Y %, wherein Y is selected from 25, 30, 35, 40, 45, 50, 55, 60, 65, 70, 75, 80, 85, 90, 91, 92, 93, 94, 95, 96, 97, 98, and 99. In exemplary aspects, the reference level is a cut off correlative with a % specificity of at least 50% and a % sensitivity of at least 50%, as determined by the ROC curve. In exemplary aspects, the reference level is a cut off correlative with a % specificity of at least 75% and a % sensitivity of at least 75%, as determined by the ROC curve. In exemplary aspects, the reference level is a cut off correlative with a % specificity of at least 85% and a % sensitivity of at least 85%, as determined by the ROC curve. In exemplary aspects, the reference level is a cut off correlative with a % specificity of at least 90% and a % sensitivity of at least 90%, as determined by the ROC curve.

In exemplary aspects, when the level of expression of a gene or gene segment listed in Table 4 is measured or has been measured, the reference level is a cutoff correlative with a pre-determined % specificity and/or pre-determined % sensitivity, as determined by an ROC curve. In exemplary aspects, the ROC curve is based on the distribution of expression levels of the gene or gene segment listed in Table 4 of a population of responders and the distribution of expression levels of the a gene or gene segment listed in Table 4 of a population of non-responders. Exemplary definitions of responders and non-responders are found herein at Example 2. In exemplary aspects, the reference level is the point on the ROC curve at which the % specificity is X %, wherein X is selected from 25, 30, 35, 40, 45, 50, 55, 60, 65, 70, 75, 80, 85, 90, 91, 92, 93, 94, 95, 96, 97, 98, and 99. In exemplary aspects, the reference level is the point on the ROC curve at which the % sensitivity is Y %, wherein Y is selected from 25, 30, 35, 40, 45, 50, 55, 60, 65, 70, 75, 80, 85, 90, 91, 92, 93, 94, 95, 96, 97, 98, and 99. In exemplary aspects, the reference level is a cut off correlative with a % specificity of at least 50% and a % sensitivity of at least 50%, as determined by the ROC curve. In exemplary aspects, the reference level is a cut off correlative with a % specificity of at least 75% and a % sensitivity of at least 75%, as determined by the ROC curve. In exemplary aspects, the reference level is a cut off correlative with a % specificity of at least 85% and a % sensitivity of at least 85%, as determined by the ROC curve. In exemplary aspects, the reference level is a cut off correlative with a % specificity of at least 90% and a % sensitivity of at least 90%, as determined by the ROC curve.

In exemplary aspects, the expression level measured in the sample is above the reference level or reference value. In exemplary aspects, when the expression level measured in the sample is above the reference level or reference value and the expression level measured is that of an Ig, FCGR2B, or a gene or gene segment listed in Table 4 and labeled as having a change in gene expression level of "up", the method comprises administering to the subject an effective amount of a proteasome inhibitor or selecting a treatment regimen comprising administration of a proteasome inhibitor. In exemplary aspects, when the expression level measured in the sample is below the reference level or reference value and the expression level measured is that of an Ig, FCGR2B, or a gene or gene segment listed in Table 4 and labeled as having a change in gene expression level of "up", an effective amount of a proteasome inhibitor is not administered to the subject or a treatment regimen comprising administration of a proteasome inhibitor is not selected or a treatment regimen lacking administration of a proteasome inhibitor is selected.

In exemplary aspects, the expression level measured in the sample is below the reference level or reference value. In exemplary aspects, when the expression level measured in the sample is below the reference level or reference value and the expression level measured is that of a gene or gene segment listed in Table 4 and labeled as having a change in gene expression level of "down", the method comprises administering to the subject an effective amount of a proteasome inhibitor or selecting a treatment regimen comprising administration of a proteasome inhibitor. In exemplary aspects, when the expression level measured in the sample is above the reference level or reference value and the expression level measured is that of a gene or gene segment listed in Table 4 and labeled as having a change in gene expression level of "down", an effective amount of a proteasome inhibitor is not administered to the subject or a treatment regimen comprising administration of a proteasome inhibitor is not selected or a treatment regimen lacking administration of a proteasome inhibitor is selected.

In exemplary aspects, the expression level measured in the sample is greater than or above the reference level or reference value. The extent to which the measured expression level is above the reference level or reference value may be to any extent. In exemplary aspects, the measured expression level is at least or about 10% greater than the reference level (e.g., at least or about 15% greater than the reference level, at least or about 20% greater than the reference level, at least or about 25% greater than the reference level, at least or about 30% greater than the reference level, at least or about 35% greater than the reference level, at least or about 40% greater than the reference level, at least or about 45% greater than the reference level, at least or about 50% greater than the reference level, at least or about 55% greater than the reference level, at least or about 60% greater than the reference level, at least or about 65% greater than the reference level, at least or about 70% greater than the reference level, at least or about 75% greater than the reference level, at least or about 80% greater than the reference level, at least or about 85% greater than the reference level, at least or about 90% greater than the reference level, at least or about 95% greater than the reference level). In exemplary aspects, the measured expression level is at least 2-fold greater than the reference level, at least 3-fold greater than the reference level, at least 4-fold greater than the reference level, at least 5-fold greater than the reference level, at least 6-fold greater than the reference level, at least 7-fold greater than the reference level, at least 8-fold greater than the reference level, at least 9-fold greater than the reference level, or at least 10-fold greater than the reference level.

In exemplary aspects, the expression level measured in the sample is below or less than the reference level or reference value. The extent to which the measured expression level is below the reference level or reference value may be to any extent. In exemplary aspects, the measured expression level is at least or about 10% less than the reference level, at least or about 15% less than the reference level, at least or about 20% less than the reference level, at least or about 25% less than the reference level, at least or about 30% less than the reference level, at least or about 35% less than the reference level, at least or about 40% less than the reference level, at least or about 45% less than the reference level, at least or about 50% less than the reference level, at least or about 55% less than the reference level, at least or about 60% less than the reference level, at least or about 65% less than the reference level, at least or about 70% less than the reference level, at least or about 75% less than the reference level, at least or about 80% less than the reference level, at least or about 85% less than the reference level, at least or about 90% less than the reference level, at least or about 95% less than the reference level. In exemplary aspects, the measured expression level is at least 2-fold less than the reference level, at least 3-fold less than the reference level, at least 4-fold less than the reference level, at least 5-fold less than the reference level, at least 6-fold less than the reference level, at least 7-fold less than the reference level, at least 8-fold less than the reference level, at least 9-fold less than the reference level, or at least 10-fold less than the reference level.

In exemplary aspects, the reference level is normalized to a housekeeping gene, such as, the β-actin gene or GADPH gene. The levels may be normalized to another housekeeping gene, such as any of those described herein. In exemplary aspects, the reference level is not normalized to a housekeeping gene. In exemplary aspects, the reference level is normalized wherein the measured expression level is normalized or not normalized when the measured expression level is not normalized.

Responders and Non-Responders

As used herein, the term "responder" refers to one who has multiple myeloma, has been treated with the referenced drug, e.g., proteasome inhibitor, and has responded to treatment with the referenced drug, wherein response to treatment is as defined by the International Myeloma Working Group in Durie et al., "International uniform response criteria for multiple myeloma" *Leukemia, Volume* 20, No. 10, (2006). In exemplary aspects, a responder is one who has demonstrated a complete response (CR), a stringent complete response (sCR), a very good partial response (VGPR), or a partial response (PR). The definitions for a CR, sCR, VGPR, and PR are known in the art. See, Durie et al., 2006, supra. In exemplary aspects, a responder is one who has demonstrated a CR, sCR, VGPR, PR or a minimal response (MR). A response who has demonstrated an MR is one who has demonstrated at least a 25% decrease in paraprotein levels upon treatment.

As used herein, the term "non-responder" refers to one who has multiple myeloma, has been treated with the referenced drug, e.g., proteasome inhibitor, and has not responded to treatment with the reference drug, wherein response treatment is defined by the International Myeloma Working Group in Durie et al., 2006, supra. In exemplary aspects, a non-responder is one does not meet the criteria for a responder. In exemplary aspects, a non-responder is one who has demonstrated progressive disease (PD). In exemplary aspects, a non-responder is one who has demonstrated PD or stable disease (SD).

Additional Steps

In exemplary aspects, the method may include additional steps. For example, the method may include repeating one or more of the recited step(s) of the method. Accordingly, in exemplary aspects, the method comprises measuring the level of expression of Ig, FCGR2B, and/or one or more genes listed in Table 4 more than one time. In exemplary aspects, the method comprises measuring samples obtained from the subject every 6 to 12 months, wherein the measurement is based on a different biological sample obtained from the same subject.

In exemplary aspects, the method comprises measuring the sample for more than one expression level. For example, the method may comprise measuring the sample for Ig expression level and FCGR2B. In additional or alternative aspects, the method may comprise measuring the sample for at least one gene listed in Table 4. In exemplary aspects, the method may comprise measuring the sample for Ig expression and at least one gene listed in Table 4 or may comprise measuring the sample for FCGR2B expression and at least one gene listed in Table 4. In exemplary aspects, the method comprises measuring the expression level of more than one, more than two, more than three, more than four, more than five, more than six, more than seven, more than eight, more than nine, more than 10, more than 11, more than 12, more than 13, more than 14, more than 15, more than 16, more than 17, more than 18, more than 19, more than 20, more than 21, more than 22, more than 23, more than 24, more than 25, more than 26, more than 27, more than 28, more than 29, or more than 30 genes listed in Table 4. In exemplary aspects, the method comprises measuring the expression level of more than 100, more than 200, more than 300, more than 400 genes listed in Table 4. In exemplary aspects, the method comprises measuring the expression levels of all of the genes listed in Table 4.

In exemplary aspects, the method comprises measuring the RNA expression level of Ig, FCGR2B, or the one or more genes listed in Table 4, and comprises measuring the protein expression level of Ig, FCGR2B, or the one or more genes listed in Table 4.

In exemplary aspects, the subject's medical history is analyzed for expression levels of Ig, FCGR2B, and/or a gene or gene segment listed in Table 4.

In exemplary aspects, the method comprises sample preparation steps. For example, in some aspects, the method comprises selecting a specific cell population from the sample obtained from the subject. In exemplary aspects, the method comprises selecting for CD138-positive cells from the sample. The selection step may be carried out by any means known in the art, including, but not limited to FACS or chromatography. In exemplary aspects, wherein RNA expression levels are measured, the method may further comprise a step to extract or isolate the RNA from the cells of the sample. In exemplary aspects, the method comprises extracting RNA from CD138-positive tumor cells.

In exemplary aspects, wherein the method comprises measuring expression levels by measuring nucleic acids, e.g., RNA, mRNA, encoded by the Ig gene segment, the FCGR2B gene, and/or the gene listed in Table 4, the method further comprises amplifying at least a fragment of the nucleic acids to be measured. In exemplary aspects, the amplification is carried out via PCR or RT-PCR.

In exemplary aspects, the method comprises measuring the Ig expression level in the cell using a microarray platform that map to genes encoding Ig-related proteins. In exemplary aspects, the method comprises measuring the Ig protein load in the cells with an anti-human Ig antibody. In exemplary aspects, the measuring comprises measuring the presence, absence, or amount of a human Ig protein in the sample In exemplary aspects of the inventive methods of determining a treatment regimen for a subject with a tumor, the method may optionally include an administering step, wherein a therapeutic agent or device is administered to the subject, when the expression level of Ig, FCGR2B, and/or a gene or gene segment listed in Table 4 having a change in gene expression level denoted in Table 4 as "up" is increased. For example, the methods described herein may optionally comprise a step of providing an appropriate therapy (administering a pharmaceutical agent or implementing a standard of care) to the subject determined to have a need therefor. In exemplary aspects, the therapeutic agent is a proteasome inhibitor, including those discussed herein. In exemplary aspects, the therapeutic agent is carfilzomib, bortezomib, disulfiram, or oprozomib. The therapeutic agent may be administered to the subject by any suitable route of administration known in the art, some routes of which are described herein below.

Any and all possible combinations of the steps described herein are contemplated for purposes of the inventive methods.

Tumors and Cancer

As used herein, the term "tumor" refers to an abnormal mass of tissue that results when cells divide at a higher rate than a healthy cell and/or when the cells do not die. In exemplary aspects, the tumor is a malignant tumor. In exemplary aspects, the tumor is a carcinoma, sarcoma, lymphoma, leukemia, germ cell tumor, or a blastoma. In exemplary aspects, the tumor is a hematological tumor, and in further exemplary aspects, the hematological tumor is derived from lymphoid cells. In alternative aspects, the hematological tumor is derived from myeloid cells. In exemplary aspects, the hematological tumor is a lymphoma, e.g., a Hodgkin's lymphoma or a non-Hodgkin's lymphoma. In exemplary aspects, the non-Hodgkin's lymphoma is mantle cell lymphoma. In exemplary aspects, the hematological tumor is a multiple myeloma, including, but not limited to, smouldering myeloma, relapsed multiple myeloma, or refractory myeloma. The multiple myeloma may be of any stage of the International Staging System, including Stage I, Stage II, and Stage III (Greipp et al., *J Clin Oncol* 23: 3412-3420 (2005). In exemplary aspects, the multiple myeloma is a Stage I, Stage II, or Stage III multiple myeloma according to the Durie-Salmon staging system (Durie et al., *Cancer* 36:842-854 (1975).

Samples

With regard to the methods disclosed herein, in exemplary embodiments, the sample obtained from the subject comprises a bodily fluid, including, but not limited to, blood, plasma, serum, lymph, breast milk, saliva, mucous, semen, vaginal secretions, cellular extracts, inflammatory fluids, cerebrospinal fluid, feces, vitreous humor, or urine obtained from the subject. In some aspects, the sample is a composite panel of at least two of the foregoing samples. In exemplary aspects, the sample comprises blood or a fraction thereof (e.g., plasma, serum, fraction obtained via leukopheresis). In exemplary aspects, the sample comprises white blood cells obtained from the subject. In exemplary aspects, the sample comprises a cell or cells from the tumor being treated. The tumor may be any of those described herein, including but not limited to, a hematological tumor, e.g., multiple myeloma tumor, mantle cell lymphoma. In exemplary aspects, the sample comprises bone marrow cells, e.g., intact bone marrow cells. In exemplary aspects, the sample comprises intact bone marrow cells and the method comprises contacting antibodies specific for FCGR2B or for Ig with the sample. In exemplary aspects, the sample comprises blood, serum, a biopsy sample, or bone marrow cells. In exemplary aspects, the sample comprises CD138-positive tumor cells. In exemplary aspects, the sample is a sample obtained from any of the subjects described herein. In exemplary aspects, the sample is a bone marrow aspirate.

Subjects

With regard to the methods disclosed herein, the subject in exemplary aspects is a mammal, preferably a human.

In exemplary aspects, the subject is a subject with a tumor. In exemplary aspects, the tumor is any of those mentioned herein. In exemplary aspects, the subject has cancer. In exemplary aspects, the cancer is any of those mentioned herein. In exemplary aspects, the subject has previously been treated for multiple myeloma. In exemplary aspects, the subject has previously been diagnosed with multiple myeloma. In exemplary aspects, the subject is a human patient having or suspected of having multiple myeloma, refractory multiple myeloma, or relapsed multiple myeloma. In alternative aspects, the subject has never been treated for multiple myeloma. In exemplary aspects, the subject has been newly diagnosed for multiple myeloma.

Proteasome Inhibitors

As used herein, the term "proteasome inhibitor" refers to any drug that blocks the action of proteasomes. In exemplary aspects, the proteasome inhibitor is lactacystin, bortezomib, disulfiram, epigallocatechin-3-gallate, salinosporamide A, carfilzomib, ONX0912, CEP-18770, MLN9708, epoxomicin, MG132, and the like. In exemplary aspects, the proteasome inhibitor is carfilzomib, bortezomib, disulfiram, and oprozomib. In exemplary aspects, the proteasome inhibitor is carfilzomib or bortezomic or a structural analog thereof. In exemplary aspects, the proteasome inhibitor is carfilzomib.

Formulations and Routes of Administration

With regard to the administration of a therapeutic agent, e.g., proteasome inhibitor, the agent may be administered through any suitable means, compositions and routes known in the art.

Kits

The invention further provides kits. In exemplary embodiments, the kit comprises one or more binding agents to an Ig gene or gene segment, or a gene product thereof. In exemplary aspects, the kit comprises a binding agent which specifically binds to an IgH, IgK or IgL gene segment (including orphon gene segments) or a product encoded thereby, and a binding agent to an FCGR2B gene or gene product. In exemplary embodiments, the kits comprises (i) one or more binding agents to an Ig gene segment or a product encoded thereby, optionally an IgH, IgK or IgL gene segment or product encoded thereby, or a binding agent to FCGR2B gene or gene product and (ii) at least one binding agent to a gene listed in Table 4 or a gene product encoded thereby. In exemplary embodiments, the kit comprises at least a first binding agent and a second binding agent, wherein the first binding agent binds to a first gene or gene product encoded by a first gene listed in Table 4, wherein the second binding agent binds to a second gene or gene product encoded by a second gene listed in Table 4, wherein the first gene is different from the second gene.

In exemplary aspects, the kit comprises a proteasome inhibitor, e.g., any of those described herein. In exemplary aspects, the kit comprises a container suitable for holding a blood sample. In exemplary aspects, the kit comprises a vial, a tube, a microtiter plate, a dish, a flask, or the like. In exemplary aspects, the container holds about 5 mL of fluid, or less. In exemplary aspects, the kit comprises heparin to prevent the blood from clotting. In exemplary aspects, the kit comprises reagents suitable for isolating RNA or proteins from tumor cells. In exemplary aspects, the kit comprises reagents suitable for reverse transcribing the RNA into complimentary DNA (cDNA) and for amplification of the cDNA. In exemplary aspects, the kit comprises a reagent that produces a signal indicative of a reference level In exemplary aspects, the product encoded by said gene or gene segment is a nucleic acid molecule, e.g., an mRNA. In exemplary aspects, the binding agent is a nucleic acid probe. In exemplary aspects, the product encoded by said gene or gene segment is a protein, polypeptide, or peptide. In exemplary aspects, the binding agent is an antibody or an antigen-binding fragment thereof or a derivative thereof. In exemplary aspects, the kit comprises both nucleic acid probes and antibodies, or antigen binding fragments or derivatives thereof.

Binding Agents: Nucleic Acid Molecules

In exemplary embodiments, the binding agent is a nucleic acid molecule, e.g., a nucleic acid probe which specifically binds to (i) at least a portion of an Ig gene segment, a FCGR2B gene, or a gene or gene segment listed in Table 4, or (ii) at least a portion of a product encoded by the Ig gene segment, FCGR2B, or the gene or gene segment listed in Table 4, which product comprises nucleic acids. In exemplary aspects, the binding agent is a nucleic acid molecule which is about 5, about 10, about 15, about 20, about 25, about 30, about 35, about 40, about 45 or about 50 nucleotides in length. In exemplary aspects, the nucleic acid molecule is about 15 to about 30 nucleotides in length or about 20 to 30 nucleotides in length or about 25 to 30 nucleotides in length. In exemplary aspects, the nucleic acid molecule is about 25 nucleotides in length.

In exemplary aspects, the nucleic acid molecule comprises DNA or RNA. In exemplary aspects, the nucleic acid molecule comprises at least one non-naturally-occurring nucleotide and/or at least one non-naturally-occurring inter-nucleotide linkage and/or one or more modified nucleotides, all of which are well known in the art. Binding Agents: Antibodies and derivatives Any polynucleotide or polypeptide that binds the gene product may be used to detect its expression levels. In some embodiments, the polypeptide is a fragment of a receptor or ligand of the gene product. In some embodiments of the invention, the binding agent is an antibody that binds to a protein product encoded by an Ig gene segment, an FCGR2B gene, or a gene or gene segment listed in Table 4. The antibody may be any type of immunoglobulin known in the art. In exemplary embodiments, the antibody is an antibody of isotype IgA, IgD, IgE, IgG, or IgM. Also, the antibody in some embodiments is a monoclonal antibody. In other embodiments, the antibody is a polyclonal antibody.

In some embodiments, the antibody is a naturally-occurring antibody, e.g., an antibody isolated and/or purified from a mammal, or produced by a hybridoma generated from a mammalian cell. Methods of producing antibodies are well known in the art.

In some embodiments, the antibody is a genetically-engineered antibody, e.g., a single chain antibody, a humanized antibody, a chimeric antibody, a CDR-grafted antibody, a humaneered antibody, a bispecific antibody, a trispecific antibody, and the like. Genetic engineering techniques also provide the ability to make fully human antibodies in a non-human source.

In some aspects, the antibody is in polymeric, oligomeric, or multimeric form. In certain embodiments in which the antibody comprises two or more distinct antigen binding regions fragments, the antibody is considered bispecific, trispecific, or multi-specific, or bivalent, trivalent, or multivalent, depending on the number of distinct epitopes that are recognized and bound by the antibody.

Antigen Binding Fragments

In some aspects of the invention, the binding agent is an antigen binding fragment of an antibody. The antigen binding fragment (also referred to herein as "antigen binding portion") may be an antigen binding fragment of any of the antibodies described herein. The antigen binding fragment can be any part of an antibody that has at least one antigen binding site, including, but not limited to, Fab, F(ab')$_2$, dsFv, sFv, diabodies, triabodies, bis-scFvs, fragments expressed by a Fab expression library, domain antibodies, VhH domains, V-NAR domains, VH domains, VL domains, and the like.

Computer Related Inventions

Computer readable-storage media are furthermore provided herein. In exemplary embodiments, the computer readable storage medium is one having stored thereon a plurality of reference levels or ranges of reference levels, each reference level or range of reference levels corresponding to (i) an expression level of Ig or (ii) an expression level of FCGR2B, or (iii) an expression level of a gene listed in Table 4, or (iv) a combination thereof; and a data value that is an expression level of Ig and/or an expression level of FCGR2B and/or an expression level of a gene listed in Table 4, measured from a cell from a sample from a patient. In exemplary aspects, the data value that is the expression level of Ig is the sum of the expression levels of more than one gene segment of the IgH, IgK, and/or IgL locus, optionally, wherein the expression level of Ig is indicative of a responder or non-responder In exemplary aspects, the computer readable storage medium is one having stored thereon (I) a first set of data values and a second set of data values, wherein each data value of the first set is an expression level of Ig determined from a sample obtained from a responder and each data value of the second set is an expression level of Ig determined from a sample obtained from a non-responder; (II) a receiver operating characteristic (ROC) curve based on a first set of data values and a second set of data values, wherein each data value of the first set is an expression level of Ig determined from a sample obtained from a responder and each data value of the second set is an expression level of Ig determined from a sample obtained from a non-responder; or (III) a table listing (a) a plurality of cut-off points on the ROC curve of (II), (b) the % sensitivity associated with each cut-off point of (a), and (c) the % specificity associated with each cut-off point of (a).

In exemplary embodiments, the computer readable storage medium is one having stored thereon (I) a first set of data values and a second set of data values, wherein each data value of the first set is an expression level of FCGR2B determined from a sample obtained from a responder and each data value of the second set is an expression level of FCGR2B deteremined from a sample obtained from a non-responder; (II) a receiver operating characteristic (ROC) curve based on a first set of data values and a second set of data values, wherein each data value of the first set is an expression level of FCGR2B determined from a sample obtained from a responder and each data value of the second set is an expression level of FCGR2B deteremined from a sample obtained from a non-responder; or (III) a table listing (a) a plurality of cut-off points on the ROC curve of (II), (b) the % sensitivity associated with each cut-off point of (a), and (c) the % specificity associated with each cut-off point of (a).

In exemplary embodiments, the computer readable storage medium is one having stored thereon (I) a first set of data values and a second set of data values, wherein each data value of the first set is an expression level of a gene listed in Table 4 determined from a sample obtained from a responder and each data value of the second set is an expression level of a gene listed in Table 4 determined from a sample obtained from a non-responder; (II) a receiver operating characteristic (ROC) curve based on a first set of data values and a second set of data values, wherein each data value of the first set is an expression level of a gene listed in Table 4 determined from a sample obtained from a responder and each data value of the second set is an expression level of a gene listed in Table 4 determined from a sample obtained from a non-responder; or (III) a table listing (a) a plurality of cut-off points on the ROC curve of (II), (b) the % sensitivity associated with each cut-off point of (a), and (c) the % specificity associated with each cut-off point of (a). In exemplary aspects, the computer readable storage medium comprises two or more of the foregoing media.

In exemplary embodiments, the computer readable storage medium is one having stored thereon machine-readable instructions executable by a processor, comprising: (a) instructions for receiving a data value, $\alpha$, relating to a test level of Ig expression from a sample obtained from a test subject, e.g., a level of Ig expression measured from a sample obtained from a test subject; and (b) instructions for displaying an output relating to treating the test subject for multiple myeloma with a proteasome inhibitor, when $\alpha$ is greater than $\beta$, a cutoff correlative with a % specificity of at least 50% and a % sensitivity of at least 50%, as determined by a receiver operating characteristic (ROC) curve.

In exemplary embodiments, the computer readable storage medium is one having stored thereon machine-readable instructions executable by a processor, comprising: (a) instructions for receiving a data value, $\alpha$, relating to a test level of FCGR2B expression from a sample obtained from a test subject, e.g., a level of FCGR2B expression measured from a sample obtained from a test subject; and (b) instructions for displaying an output relating to treating the test subject for multiple myeloma with a proteasome inhibitor, when $\alpha$ is greater than $\beta$, a cutoff correlative with a % specificity of at least 50% and a % sensitivity of at least 50%, as determined by a receiver operating characteristic (ROC) curve.

In exemplary embodiments, the computer readable storage medium is one having stored thereon machine-readable instructions executable by a processor, comprising: (a) instructions for receiving a data value, $\alpha$, relating to a test level of expression of a gene listed in Table 4 from a sample obtained from a test subject, wherein the change in gene expression level for the gene is denoted in Table 4 as "up", e.g., a level of expression of the gene listed in Table 4 measured from a sample obtained from a test subject; and (b) instructions for displaying an output relating to treating the test subject for multiple myeloma with a proteasome inhibitor, when $\alpha$ is greater than $\beta$, a cutoff correlative with a % specificity of at least 50% and a % sensitivity of at least 50%, as determined by a receiver operating characteristic (ROC) curve.

In exemplary embodiments, the computer readable storage medium is one having stored thereon machine-readable instructions executable by a processor, comprising: (a) instructions for receiving a data value, α, relating to a test level of expression of a gene listed in Table 4 from a sample obtained from a test subject, wherein the change in gene expression level for the gene is denoted in Table 4 as "down", e.g., a level of expression of the gene listed in Table 4 measured from a sample obtained from a test subject; and (b) instructions for displaying an output relating to treating the test subject for multiple myeloma with a proteasome inhibitor, when α is less than β, a cutoff correlative with a % specificity of at least 50% and a % sensitivity of at least 50%, as determined by a receiver operating characteristic (ROC) curve.

The invention additionally provides systems comprising: a processor; a memory device coupled to the processor, and machine readable instructions stored on the memory device. In exemplary embodiments, the machine readable instructions, when executed by the processor, cause the processor to: (i.) receive a data value, α, relating to a test level of Ig expression from a sample obtained from a test subject, e.g., a level of expression of Ig measured from a sample obtained from a test subject; and (ii) display an output relating to treating the test subject for multiple myeloma with a proteasome inhibitor, when α is greater than β, a cutoff correlative with a % specificity of at least 50% and a % sensitivity of at least 50%, as determined by a receiver operating characteristic (ROC) curve.

In exemplary embodiments, the machine readable instructions, when executed by the processor, cause the processor to: (i) receive a data value, α, relating to a test level of FCGR2B expression from a sample obtained from a test subject, e.g., a level of expression of FCGR2B measured from a sample obtained from a test subject; and (ii) display an output relating to treating the test subject for multiple myeloma with a proteasome inhibitor, when α is greater than β, a cutoff correlative with a % specificity of at least 50% and a % sensitivity of at least 50%, as determined by a receiver operating characteristic (ROC) curve.

In exemplary embodiments, the machine readable instructions, when executed by the processor, cause the processor to: (i) receive a data value, α, relating to a test level of expression of a gene listed in Table 4, wherein the change in gene expression level for the gene is denoted in Table 4 as "up", from a sample obtained from a test subject, e.g., a level of expression of the gene listed in Table 4 measured from a sample obtained from a test subject; and (ii) display an output relating to treating the test subject for multiple myeloma with a proteasome inhibitor, when α is greater than β, a cutoff correlative with a % specificity of at least 50% and a % sensitivity of at least 50%, as determined by a receiver operating characteristic (ROC) curve.

In exemplary embodiments, the machine readable instructions, when executed by the processor, cause the processor to: (i) receive a data value, α, relating to a test level of expression of a gene listed in Table 4, wherein the change in gene expression level for the gene is denoted in Table 4 as "down", from a sample obtained from a test subject e.g., a level of expression of the gene listed in Table 4 measured from a sample obtained from a test subject; and (ii) display an output relating to treating the test subject for multiple myeloma with a proteasome inhibitor, when α is less than β, a cutoff correlative with a % specificity of at least 50% and a % sensitivity of at least 50%, as determined by a receiver operating characteristic (ROC) curve.

The invention further provides methods implemented by a processor in a computer. In exemplary embodiments, the method comprises the steps of: (a) receiving a data value, α, relating to a test level of Ig expression from a sample obtained from a test subject, a level of expression of Ig measured from a sample obtained from a test subject; and (b) displaying an output relating to treating the test subject for multiple myeloma with a proteasome inhibitor, when α is greater than β, a cutoff correlative with a % specificity of at least 50% and a % sensitivity of at least 50%, as determined by a receiver operating characteristic (ROC) curve. In exemplary embodiments, the method comprises the steps of: (a) receiving a data value, α, relating to a test level of FCGR2B expression from a sample obtained from a test subject e.g., a level of expression of FCGR2B measured from a sample obtained from a test subject; and (b) displaying an output relating to treating the test subject for multiple myeloma with a proteasome inhibitor, when α is greater than β, a cutoff correlative with a % specificity of at least 50% and a % sensitivity of at least 50%, as determined by a receiver operating characteristic (ROC) curve. In exemplary embodiments, the method comprises the steps of: (a) receiving a data value, α, relating to a test level of expression of a gene listed in Table 4 from a sample obtained from a test subject, wherein the change in gene expression level for the gene is denoted in Table 4 as "up" e.g., a level of expression of the gene listed in Table 4 measured from a sample obtained from a test subject; and (b) displaying an output relating to treating the test subject for multiple myeloma with a proteasome inhibitor, when α is greater than β, a cutoff correlative with a % specificity of at least 50% and a % sensitivity of at least 50%, as determined by a receiver operating characteristic (ROC) curve. In exemplary embodiments, the method comprises the steps of: (a) receiving a data value, α, relating to a test level of expression of a gene listed in Table 4 from a sample obtained from a test subject, wherein the change in gene expression level for the gene is denoted in Table 4 as "down" e.g., a level of expression of the gene listed in Table 4 measured from a sample obtained from a test subject; and (b) displaying an output relating to treating the test subject for multiple myeloma with a proteasome inhibitor, when α is less than β, a cutoff correlative with a % specificity of at least 50% and a % sensitivity of at least 50%, as determined by a receiver operating characteristic (ROC) curve.

Figure 10:
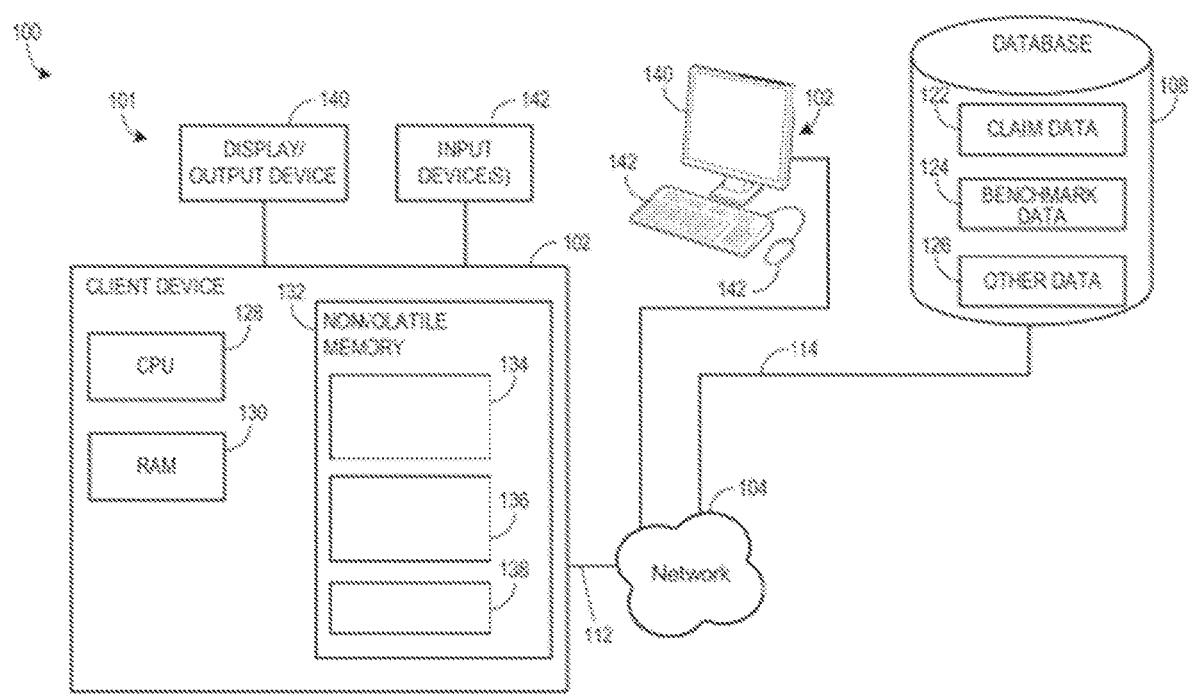
FIG. 10 is a schematic of an exemplary embodiment 101 of a system 100 for determining a therapeutic regimen for a subject with a tumor.

FIG. 10 illustrates an exemplary embodiment 101 of a system 100 for determining a therapeutic regimen for a subject with a tumor. Generally, the system 100 may include one or more client devices 102, a network 104, and a database 108. Each client device 102 may be communicatively coupled to the network 104 by one or more wired or wireless network connections 112, which may be, for example, a connection complying with a standard such as one of the IEEE 802.11 standards ("Wi-Fi"), the Ethernet standard, or any other appropriate network connection. Similarly, the database 108 may be communicatively coupled to the network 104 via one or more connections 114. (Of course, the database could alternatively be internal to one or more of the client devices 102.) The database 108 may store data related to the determination of the therapeutic regimen for a subject with a tumor including, but not limited to, data of a sample obtained from the subject, data of a sample obtained from a subject from a non-responder category or from a responder category, etc. The data of the samples may be, for example, related to one or more of a level of expression of an Ig gene segment, FCGR2B, or a gene or gene segment listed in Table 4.

As will be understood, the network 104 may be a local area network (LAN) or a wide-area network (WAN). That is, network 104 may include only local (e.g., intra-organization) connections or, alternatively, the network 104 may include connections extending beyond the organization and onto one or more public networks (e.g., the Internet). In some embodiments, for example, the client device 102 and the database 108 may be within the network operated by a single company (Company A). In other embodiments, for example, the client device(s) 102 may be on a network operated by Company A, while the database 108 may be on a network operated by a second company (Company B), and the networks of Company A and Company B may be coupled by a third network such as, for example, the Internet.

Referring still to FIG. 10, the client device 102 includes a processor 128 (CPU), a RAM 130, and a non-volatile memory 132. The non-volatile memory 132 may be any appropriate memory device including, by way of example and not limitation, a magnetic disk (e.g., a hard disk drive), a solid state drive (e.g., a flash memory), etc. Additionally, it will be understood that, at least with regard to FIG. 10, the database 108 need not be separate from the client device 102. Instead, in some embodiments, the database 108 is part of the non-volatile memory 132 and the data 122, 124, 126 may be stored as data within the memory 132. For example, the data 122 may be included as data in a spreadsheet file stored in the memory 132, instead of as data in the database 108. In addition to storing the records of the database 108 (in some embodiments), the memory 132 stores program data and other data necessary to analyze data of one or more sample and/or control populations, determine a mean of the data, determine a threshold against which data of the subject may be compared, and/or determine the therapeutic regimen for a subject with a tumor. For example, in an embodiment, the memory 132 stores a first routine 134, a second routine 136, and a third routine 138. The first routine 134 may receive data values related to one or more sample and/or control populations, and determine a mean of the data values received by the routine 134. The second routine 136 may compute one or more statistical parameters of the data collected by the first routine 134, such as determining a mean value, a standard deviation value, etc. Additionally and/or alternatively, the second routine 136 may set a first cutoff against which data from one or more subjects may be compared in order to determine the therapeutic regimen for a subject with a tumor. The third routine 138 may, for example, receive data for one or more subjects, compare the data of the one or more subjects to the cutoff value(s) determined by the second routine 136, and/or determine the therapeutic regimen for a subject with a tumor according to the comparison of the subject's data to the cutoff value. Regardless, each of the routines is executable by the processor 128 and comprises a series of compiled or compilable machine-readable instructions stored in the memory 132. Additionally, the memory 132 may store generated reports or records of data output by one of the routines 134 or 136. Alternatively, the reports or records may be output to the database 108. One or more display/output devices 140 (e.g., printer, display, etc.) and one or more input devices 142 (e.g., mouse, keyboard, tablet, touch-sensitive interface, etc.) may also be coupled to the client device 102, as is generally known.

As will be understood, although individual operations of one or more methods are illustrated and described as separate operations, one or more of the individual operations may be performed concurrently, and nothing requires that the operations be performed in the order illustrated. Structures and functionality presented as separate components in example configurations may be implemented as a combined structure or component. Similarly, structures and functionality presented as a single component may be implemented as separate components. These and other variations, modifications, additions, and improvements fall within the scope of the subject matter herein.

For example, the network 104 may include but is not limited to any combination of a LAN, a MAN, a WAN, a mobile, a wired or wireless network, a private network, or a virtual private network. Moreover, while only two clients 102 are illustrated in FIG. 10 to simplify and clarify the description, it is understood that any number of client computers are supported and can be in communication with one or more servers (not shown).

Additionally, certain embodiments are described herein as including logic or a number of routines. Routines may constitute either software routines (e.g., code embodied on a machine-readable medium or in a transmission signal) or hardware routines. A hardware routine is tangible unit capable of performing certain operations and may be configured or arranged in a certain manner. In example embodiments, one or more computer systems (e.g., a standalone, client or server computer system) or one or more hardware routines of a computer system (e.g., a processor or a group of processors) may be configured by software (e.g., an application or application portion) as a hardware routine that operates to perform certain operations as described herein.

Similarly, the methods or routines described herein may be at least partially processor-implemented. For example, at least some of the operations of a method may be performed by one or processors or processor-implemented hardware modules. The performance of certain of the operations may be distributed among the one or more processors, not only residing within a single machine, but deployed across a number of machines. In some example embodiments, the processor or processors may be located in a single location (e.g., within a home environment, an office environment or as a server farm), while in other embodiments the processors may be distributed across a number of locations.

The performance of certain of the operations may be distributed among the one or more processors, not only residing within a single machine, but deployed across a number of machines. In some example embodiments, the one or more processors or processor-implemented modules may be located in a single geographic location (e.g., within a home environment, an office environment, or a server farm). In other example embodiments, the one or more processors or processor-implemented modules may be distributed across a number of geographic locations.

Some embodiments may be described using the expression "coupled" and "connected" along with their derivatives. For example, some embodiments may be described using the term "coupled" to indicate that two or more elements are in direct physical or electrical contact. The term "coupled," however, may also mean that two or more elements are not in direct contact with each other, but yet still co-operate or interact with each other. The embodiments are not limited in this context.

As used herein, the terms "comprises," "comprising," "includes," "including," "has," "having" or any other variation thereof, are intended to cover a non-exclusive inclusion. For example, a process, method, article, or apparatus that comprises a list of elements is not necessarily limited to only those elements but may include other elements not expressly listed or inherent to such process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

In addition, use of the "a" or "an" are employed to describe elements and components of the embodiments herein. This is done merely for convenience and to give a general sense of the description. This description should be read to include one or at least one and the singular also includes the plural unless it is obvious that it is meant otherwise.

Additional Embodiments

The inventions described herein are based, in part, on the discovery that (i) high levels of immunoglobulin expression in cancer cells (e.g., hematological tumor cells) correlate with response to one or more proteasome inhibitors (e.g., carfilzomib, bortezomib, oprozomib); (ii) increased levels of FCGR2B expression in cancer cells (e.g., hematological tumor cells) correlate with response to one or more proteasome inhibitors (e.g., carfilzomib, bortezomib, oprozomib); and/or (iii) decreased levels of FCGR2B expression in cancer cells (e.g., hematological tumor cells) correlate with non-response to proteasome inhibitors (e.g., carfilzomib, bortezomib, oprozomib).

Provided herein are methods for treatment of tumors and/or determining efficacy of a treatment of a tumor with a proteasome inhibitor (e.g., carfilzomib, bortezomib, oprozomib) in a subject by determining the level of Ig expression or FCGR2B expression in a sample obtained from the tumor. These methods require detecting the level of Ig expression or overall Ig protein load in a sample or FCGR2B expression or overall FCGR2B protein load in a sample.

The disclosed methods can be employed to determine the efficacy of treatments for multiple myeloma in subjects who are undergoing carfilzomib therapy and/or in subjects who are undergoing therapy with other chemotherapeutic agents including, but not limited to, other proteasome inhibitors (e.g., oprozomib, bortezomib). Also provided are methods of selecting a subject for participation in a clinical study that include determining the level of Ig expression or FCGR2B expression in a sample (e.g., a biological sample) obtained form a subject having a tumor, or at risk for having a tumor.

The invention also provides additional methods of treating a tumor. In exemplary aspects, the method includes detecting the level of Ig expression or FCGR2B expression in a sample (e.g., a biological sample) obtained from a subject identified as having, or at risk for having a tumor, wherein a difference in the Ig expression level or FCGR2B expression level in the tumor cell compared to a reference level is an indication of the subject's responsiveness to treatment with a proteasome inhibitor. In one embodiment, the Ig expression level or FCGR2B expression level in the tumor cell is elevated as compared to the reference level, and the elevated levels indicate that the tumor is sensitive (e.g., susceptible) to the therapy with one or more proteasome inhibitors. According to one aspect, the methods disclosed herein comprise administering to subjects having elevated levels of Ig expression or FCGR2B expression in the tumor cell as compared to the reference level an effective amount of one or more proteasome inhibitors (e.g. carfilzomib, bortezomib or oprozomib). In one embodiment, the subject is administered an effective amount of carfilzomib.

In another embodiment, the Ig expression level or FCGR2B expression level in the tumor cell is reduced as compared to the reference level, and the reduced levels indicate that the tumor is not sensitive to the therapy with one or more proteasome inhibitors. According to one aspect, the methods disclosed herein comprise administering to subjects having reduced levels of Ig expression or FCGR2B expression in the tumor cell as compared to the reference level an effective amount of a chemotherapeutic agent other than a proteasome inhibitor. In one embodiment, the subject is administered an effective amount of a chemotherapeutic agent other than a carfilzomib. In some embodiments, the tumor is a hematologic tumor (e.g., a myeloma).

In explemplay aspects, the method of treating a tumor in a subject comprises identifying a subject having a tumor, or at risk for having a tumor; providing a sample comprising a cell from a tumor; detecting the level of immunoglobulin (Ig) expression in the sample; identifying a subject with elevated levels of Ig expression in a cell of the tumor as compared to a reference level; and administering to the identified subject an effective amount of a proteasome inhibitor. In exemplary aspects, the method comprises identifying a subject having a tumor, or at risk for having a tumor; providing a sample comprising a cell from a tumor; detecting the level of immunoglobulin (Ig) in the sample; identifying a subject with reduced levels of Ig in a cell of the tumor as compared to a reference level; and administering to the subject a chemotherapeutic agent other than a proteasome inhibitor.

In exemplary aspects, the method of treating a tumor in a subject comprises identifying a subject having a tumor, or at risk for having a tumor; providing a sample comprising a cell from a tumor; detecting the level of Fc gamma receptor 2B (FCGR2B) expression in the sample; identifying a subject with elevated levels of FCGR2B expression in a cell of the tumor as compared to a reference level; and administering to the identified subject an effective amount of a proteasome inhibitor. In exemplary aspects, the method comprises identifying a subject having a tumor, or at risk for having a tumor; providing a sample comprising a cell from a tumor; detecting the level of FCGR2B in the sample; identifying a subject with reduced levels of FCGR2B in a cell of the tumor as compared to a reference level; and administering to the subject a chemotherapeutic agent other than a proteasome inhibitor.

The invention also provides a method for determining whether to treat a subject having a tumor, e.g., a hematological tumor, with a proteasome inhibitor, e.g., carfilzomib. In exemplary aspects, the method of determining whether to treat a subject comprises identifying a subject having a hematological tumor, or at risk for having a hematological tumor. In one aspect, the hematological tumor is multiple myeloma. The level of Ig expression or FCGR2B expression in a sample (e.g., a biological sample) obtained from a subject is detected, and compared to a reference level. According to one aspect, the methods include determining to treat the subject with carfilzomib if the sample has elevated levels of Ig or FCGR2B, as compared to a reference level. In one embodiment, the subject is administered an effective amount of carfilzomib. Conversely, the methods include determining to treat the subject with a chemotherapeutic agent other than carfilzomib if the sample has reduced levels of Ig or FCGR2B as compared to a reference level. In exemplary aspects, the method comprises identifying a subject having a tumor, or at risk for having a tumor; providing a sample comprising a cell from the tumor; detecting the level of immunoglobulin (Ig) expression in the sample; and determining to treat a subject with a proteasome inhibitor, e.g., carfilzomib, if the subject has elevated levels of Ig in the sample as compared to a reference level. In exemplary aspects, the method further includes the step of administering to subject an effective amount of a proteasome inhibitor, e.g., carfilzomib.

In alternative or additional aspects, the method comprises identifying a subject having, at risk for, having a tumor, e.g., a hematological tumor; providing a sample comprising a cell from the tumor; detecting the level of FCGR2B expression in the sample; and determining to treat a subject with a proteasome inhibitor, e.g, carfilzomib, if the subject has elevated levels of FCGR2B in the sample as compared to a reference level. In exemplary aspects, the method further includes the step of administering to subject an effective amount of a proteasome inhibitor, e.g., carfilzomib.

The invention further provides a method of predicting the sensitivity of a tumor (e.g., a hematological tumor) to treatment with a proteasome inhibitor. In exemplary embodiments, the methods comprise identifying a subject having a tumor, or at risk for having a tumor. In one aspect, the tumor is multiple myeloma. These methods include detecting the level of Ig expression or FCGR2B expression in a sample (e.g., a biological sample) obtained from a subject identified as having, or at risk for having a tumor, and predicting that the tumor will be sensitive to (e.g., susceptible to) treatment with proteasome inhibitor if the sample has elevated levels of Ig or FCGR2B in the sample relative to a reference level. In one embodiment, the Ig expression level or the FCGR2B expression level in the sample is elevated as compared to the reference level, and the elevated levels indicate that the tumor is sensitive (e.g., susceptible) to the therapy with a proteasome inhibitor. According to one aspect, the methods disclosed herein comprise administering to subjects having elevated levels of Ig expression or FCGR2B expression in the sample as compared to the reference level an effective amount of proteasome inhibitor, including carfilzomib. In exemplary aspects, the method comprises identifying a subject having a tumor, or at risk for having a tumor; providing a sample comprising a cell from the tumor; detecting the level of Ig expression in the sample; comparing the level of Ig expressiong in the sample with a reference level; predicting that the tumor will be sensitive to treatment with a proteasome inhibitor if the sample has elevated levels of Ig in the sample relative to a reference level. In exemplary aspects, the method further includes the step of administering to the subject having a tumor predicted to be sensitive to treatment with a proteasome inhibitor, e.g., carfilzomib, an effective amount of a proteasome inhibitor, e.g., carfilzomib. In alternative or additional aspects, the method comprises identifying a subject having a tumor, or at risk for having a tumor; providing a sample comprising a cell from the tumor; detecting the level of FCGR2B expression in the sample; comparing the level of FCGR2B expression in the sample with a reference level; predicting that the tumor will be sensitive to treatment with a proteasome inhibitor if the sample has elevated levels of FCGR2B in the sample relative to a reference level. In exemplary aspects, the method further includes the step of administering to the subject having a tumor predicted to be sensitive to treatment with proteasome inhibitor, e.g., carfilzomib, an effective amount of a proteasome inhibitor, e.g., carfilzomib.

In another embodiment, the methods include detecting the level of Ig expression or FCGR2B expression in a sample (e.g., a biological sample) obtained from a subject identified as having, or at risk for having a tumor, and predicting that the tumor will not be sensitive (e.g., susceptible to) to treatment with proteasome inhibitor if the sample has reduced levels of Ig or FCGR2B in the sample relative to a reference level. According to one aspect, the methods disclosed herein comprise administering to subjects having reduced levels of Ig expression or FCGR2B expression in the tumor cell as compared to the reference level an effective amount of a chemotherapeutic agent other than a proteasome inhibitor. In one embodiment, the methods further comprise administering to the subject an effective amount of a chemotherapeutic agent other than a proteasome inhibitor (e.g., a chemotherapeutic agent other than carfilzomib).

Some embodiments, where the treatment has been indicated to be ineffective in the subject, further include administering, recommending, or prescribing an alternate treatment to the subject. In some embodiments, the alternate treatment can be a different therapeutic agent or a different combination of one or more therapeutic agents. In some embodiments, the alternate treatment can be an increased dosage of one or more therapeutic agents currently being taken by the subject, an increase in the frequency of administration of one or more therapeutic agents currently being taken by the subject, or an alteration in the route of delivery of one or more therapeutic agents being currently taken by the subject.

In exemplary aspects of the foregoing methods, the proteasome inhibitor is selected from the group consisting of carfilzomib, bortezomib and oprozomib. In exemplary aspects, the tumor is a hematological tumor, including, but not limited to multiple myeloma. In exemplary aspecst, the the cell is a CD138+ tumor cell.

In exemplary aspects of the foregoing methods comprising detecting the level of immunoglobulin (Ig) in the sample, the detecting comprises amplifying a fragment of a human Ig mRNA. In one embodiment, the detecting comprises measuring the Ig expression level in the cell using a microarray platform that map to genes encoding Ig-related proteins. In yet another embodiment, the detecting comprises measuring the Ig expression level in the cells using an anti-Ig antibody (e.g., an anti-human Ig antibody). In exemplary aspects of the foregoing methods comprising detecting the level of immunoglobulin (Ig) in the sample, the detecting comprises (i) amplifying a fragment of a human Ig mRNA; (ii) measuring the Ig expression level in the cell using a microarray platform that map to genes encoding Ig-related proteins; or (iii) measuring the Ig protein load in the cells with an anti-human Ig antibody.

In exemplary aspects of the foregoing methods comprising detecting the level of FCGR2B in the sample, the detecting comprises amplifying a fragment of a human FCGR2B mRNA. In one embodiment, the detecting comprises measuring the FCGR2B expression level in the cell using a microarray platform that map to genes encoding FCGR2B. In yet another embodiment, the detecting comprises measuring the Ig expression level in the cells using an anti-FCGR2B antibody (e.g., an anti-human FCGR2B antibody). In exemplary aspects of the foregoing methods comprising detecting the level of FCGR2B in the sample, the detecting comprises (i) amplifying a fragment of a human FCGR2B mRNA; (ii) measuring the FCGR2B expression level in the cell using a microarray platform that map to genes encoding FCGR2B; or (iii) measuring the FCGR2B protein load in the cells with an anti-human FCGR2B antibody.

The invention moreover provides a method of inhibiting proliferation of multiple myeloma cells in a subject. In exemplary aspects, the methods include detecting the level of Ig expression or FCGR2B expression level in multiple myeloma cells obtained from a subject, wherein a difference in the Ig expression level or FCGR2B expression level in the multiple myeloma cells compared to a reference level is an indication that treating the subject with a proteasome inhibitor will inhibit proliferation of multiple myeloma cells in the subject. In an exemplary embodiment, the Ig expression level or FCGR2B expression level in the multiple myeloma cells is elevated as compared to the reference level, and the elevated levels indicate that treating the subject with a proteasome inhibitor will inhibit proliferation of multiple myeloma cells in the subject. According to one aspect, the methods disclosed herein comprise administering to the subject an effective amount of a proteasome inhibitor. In one embodiment, the subject is administered an effective amount of carfilzomib. In another embodiment, the methods disclosed herein include designing a chemotherapeutic regimen comprising carfilzomib effective to inhibit proliferation of the tumor cells; and administering carfilzomib to the subject thereby treating the tumor.

In another embodiment, the Ig expression level or FCGR2B expression level in the multiple myeloma cells is reduced as compared to the reference level, and the reduced levels indicate that treating the subject with a proteasome inhibitor may not inhibit proliferation of multiple myeloma cells in the subject. According to one aspect, the methods disclosed herein comprise administering to the subjects an effective amount of a chemotherapeutic agent other than a proteasome inhibitor. In one embodiment, the subject is administered an effective amount of a chemotherapeutic agent other than a carfilzomib.

In exemplary aspects, the method of inhibiting proliferation of multiple myeloma cells in a subject comprises identifying a subject having, at risk for, or suspected of having multiple myeloma; detecting the level of Ig expression in multiple myeloma cells obtained from the subject; comparing the level of Ig expression in the multiple myeloma cells with a control sample; and a) administering to the subject an effective amount of a proteasome inhibitor to the subject if it has been determined that the multiple myeloma cells have elevated Ig expression relative to a reference level; or b) administering to the subject an effective amount of a chemotherapeutic agent other than a proteasome inhibitor to the subject if it has been determined that the multiple myeloma cells have reduced Ig expression relative to a reference level. In alternative or additional aspects, the method comprises identifying a subject having, at risk for, or suspected of having multiple myeloma; detecting the level of FCGR2B expression in multiple myeloma cells obtained from the subject; comparing the level of FCGR2B expression in the multiple myeloma cells with a control sample; and a) administering to the subject an effective amount of a proteasome inhibitor to the subject if it has been determined that the multiple myeloma cells have elevated FCGR2B expression relative to a reference level; or b) administering to the subject an effective amount of a chemotherapeutic agent other than a proteasome inhibitor to the subject if it has been determined that the multiple myeloma cells have reduced or unchanged FCGR2B expression relative to a reference level.

In exemplary aspects, the methods provided herein, (e.g., the method of determining whether to treat a subject), further comprises designing a chemotherapeutic regimen comprising carfilzomib effective to inhibit proliferation of the tumor cells (e.g., multiple myeloma cells); and administering carfilzomib to the subject thereby treating the tumor.

In exemplary aspects of any of the foregoing methods, the reference level of Ig is based on the Ig expression level determined from a plasma cell obtained from a healthy individual or the reference level of FCGR2B is based on the FCGR2B expression level determined from a plasma cell obtained from a healthy individual. In exemplary aspects, the reference level of Ig expression is based on the Ig expression level determined from a plasma cell obtained from an individual classified as non-responsive to therapy with a proteasome inhibitor. In exemplary embodiments, the reference level of FCGR2B expression is based on the FCGR2B expression level determined from a plasma cell obtained from a healthy individual. In another embodiment, the reference level of FCGR2B expression is based on the FCGR2B expression level determined from a plasma cell obtained from an individual classified as non-responsive to therapy with a proteasome inhibitor.

In exemplary aspects of any of the foregoing methods, the subject has previously been treated for multiple myeloma or has previously been diagnosed with multiple myeloma. In exemplary aspects of any of the foregoing methods, the sample is a blood, serum, or biopsy sample.

Also, in exemplary aspects of any of the foregoing methods, the detecting comprises amplifying a fragment of a human Ig mRNA or amplifying a fragment of a human FCGR2B mRNA. Optionally, the amplifying is by polymerase chain reaction (PCR) or RT-PCR. In exemplary aspects, the amplifying employs a detectably-labeled primer or probe.

With regard to the foregoing methods, the Ig expression levels or FCGR2B expression levels in a biological sample can be determined, for example, by using one or more oligonucleotides that are specific for genes encoding Ig-related proteins or for FCGR2B. For example, the levels of mRNA corresponding to a human Ig or human FCGR2B can be detected using oligonucleotides in Southern hybridizations, in situ hybridizations, and quantitative real-time PCR amplification (qRT-PCR). A plurality of oligonucleotides specific for a plurality genes encoding Ig-related proteins can be employed in an array format wherein each oligonucleotide is immobilized at a pre-determined location on a substrate, such as nitrocellulose membrane. Methods for performing such assays are well known to those of skill in the art.

The oligonucleotides employed in such methods are generally single-stranded molecules, such as synthetic antisense molecules or cDNA fragments, and are, for example, 6-60 nt, 15-30 or 20-25 nt in length.

Oligonucleotides specific for a polynucleotide encoding Ig-related proteins are prepared using techniques well known to those of skill in the art. For example, oligonucleotides can be designed using known computer algorithms to identify oligonucleotides of a defined length that are unique to the polynucleotide, have a GC content within a range suitable for hybridization, and lack predicted secondary structure that may interfere with hybridization. Oligonucleotides can be synthesized using methods well known to those in the art. For use in array formats, the oligonucleotides may be synthesized directly on the surface of a substrate. Oligonucleotides specific for the prostate cancer biomarkers disclosed herein are known in the art and are commercially available.

In certain embodiments, the oligonucleotides are labeled using one or more detectable moieties. DNA or mRNA isolated from a biological sample is contacted with the labeled oligonucleotides under conditions that allow for formation of hybridization complexes, and the amount of label associated with the hybridization complexes is measured and compared to a standard value.

In alternative or additional aspects, the detecting comprises measuring the presence, absence, or amount of a human Ig protein or FCGR2B protein in the test sample. In exemplary aspects, the measuring uses an antibody that specifically binds to a human Ig protein or a human FCGR2B protein. Antibodies that bind to human Ig employed in the present methods, together with ELISA kits that employ such antibodies for the detection of human Ig employed herein, are well known to those of skill in the art and are available commercially. Optionally, the measuring is by an ELISA assay, a western blot assay, or an immunohistochemical assay.

In certain embodiments, the Ig or FCGR2B, expression level is determined using a binding agent, such as a protein, antibody or antibody fragment, that specifically binds to the human Ig or FCGR2B, for example in an enzyme-linked immunosorbent assay (ELISA), radioimmunoassay, antibody array, Western blot, immunohistochemical, immunoprecipitation or immunofluoresence assay. Methods for performing such assays are well known to those of skill in the art.

Solid phase substrates, or carriers, that can be effectively employed in such assays are well known to those of skill in the art and include, for example, 96 well microtiter plates, glass, paper, and microporous membranes constructed, for example, of nitrocellulose, nylon, polyvinylidene difluoride, polyester, cellulose acetate, mixed cellulose esters and polycarbonate.

With regard to the foregoing methods, in exemplary aspects, the subject is a human patient having or suspected of having multiple myeloma, refractory multiple myeloma, or relapsed multiple myeloma.

In exemplary embodiments, the method further comprises administering to the subject one or more chemotherapeutic agents other than a proteasome inhibitor (e.g., carfilzomib, bortezomib or oprozomib). In some embodiments, the subject is a participant in a clinical trial. In alternative embodiments, the method further comprises administering to the subject one or more chemotherapeutic agents other than a proteasome inhibitor.

In exemplary embodiments, the difference is an increase in the level of Ig expression or FCGR2B expression in the tumor cell compared to the reference level and the increase is prognostic for an improved overall survival of the subject undergoing the therapy, compared to individuals afflicted with multiple myeloma that do not have the increase in the expression level of Ig or FCGR2B in the tumor cell compared to a reference level.

In one embodiment, the difference is a decrease in the level of Ig expression in the tumor cell in the subject compared to the reference level and the decrease indicates that the multiple myeloma is resistant to therapy with one or more proteasome inhibitors. In one embodiment, the difference is a decrease in the level of Ig expression in the tumor cell compared to the reference level and the decrease is prognostic for a diminished overall survival of the subject compared to individuals that do not have the decrease in the level of Ig expression in the tumor cell. In exemplary aspects, the difference is an decrease in the level of FCGR2B expression in the tumor cell compared to the reference level and the decrease is prognostic for an diminished overall survival of the subject undergoing the therapy, compared to individuals afflicted with multiple myeloma that do not have an decrease in the expression level of FCGR2B in the tumor cell compared to a reference level.

In exemplary embodiments, the method further includes determining whether the patient will be a candidate for therapy with one or more proteasome inhibitors, prior to the administering, wherein an increase in a level of Ig expression or FCGR2B expression in a tumor cell from the patient compared to a reference level indicates that the patient is a candidate for the foregoing therapies.

Provided herein are methods for determining whether to treat a patient having a tumor (e.g., a hematological tumor) with a proteasome inhibitor (e.g., carfilzomib) that include identifying a subject having, at risk for, having a hematological tumor, providing a sample comprising a cell from the tumor, detecting the level of Ig expression in the sample, determining to treat the patient with a proteasome inhibitor (e.g., carfilzomib) if the level of Ig expression in a cell of the tumor is greater than a predetermined reference level. In some embodiments, the hematological tumor is a myeloma. In some embodiments, the myeloma is multiple myeloma.

Provided herein are methods for determining whether to treat a patient having a tumor (e.g., a hematological tumor, such as multiple myeloma) with a proteasome inhibitor (e.g., carfilzomib, oprozomib, or bortezomib) that include identifying a subject having a tumor, or at risk for having a tumor, providing a sample comprising a cell from the tumor, detecting the level of FCGR2B expression in the sample, determining to treat the patient with a chemotherapeutic agent other than a proteasome inhibitor when if the level of FCGR2B expression in a cell of the tumor is less than a predetermined reference level. In some embodiments, the hematological tumor is a myeloma. In some embodiments, the myeloma is multiple myeloma.

Some embodiments further include assessing, or alternatively obtaining, providing, or using previously determined information regarding, the level of Ig expression or FCGR2B expression from samples taken from a control population of normal, or healthy (disease-free) subjects.

Some embodiments further include recording the results of these methods in the subject's medical records (e.g., recording the results in a computer readable medium) or performing a diagnostic test. In some embodiments, these methods can be performed by a medical professional (e.g., a physician, a physician's assistant, a nurse, a nurse's assistant, or a laboratory technician).

In one aspect, the disclosure generally provides compositions, which include therapeutic agents and pharmaceutically acceptable carriers therefor.

In this regard, the disclosure provides for one or more therapeutic agents, e.g., proteasome inhibitors, which are administered to a MM patient. The therapeutic agents can be administered to a patient prior to, during, or after other conventional chemotherapeutic treatments. In one embodiment, the therapeutic agents are administered to a patient subsequent to determining that the patient is a candidate for such treatment. In this respect, the therapeutic agents are administered to a subject, prior to, or in combination with, conventional chemotherapeutic treatments.

In one aspect, the therapeutic agents, alone or in combination, are administered to a patient in an effective amount, e.g., a therapeutically effective dose of proteasome inhibitor or other chemotherapeutic agent. A therapeutic dose may vary depending upon the type of therapeutic agent, route of administration, and dosage form. Dosage unit forms generally contain between from about 1 mg to about 500 mg of an active ingredient. The preferred composition or compositions is a formulation that exhibits a high therapeutic index. The therapeutic index is the dose ratio between toxic and therapeutic effects which can be expressed as the ratio between $LD_{50}$ and $ED_{50}$. The $LD_{50}$ is the dose lethal to 50% of the population and the $ED_{50}$ is the dose therapeutically effective in 50% of the population. The $LD_{50}$ and $ED_{50}$ are determined by standard pharmaceutical procedures in animal cell cultures or experimental animals.

Specific dosages may be adjusted depending on conditions of disease, the age, body weight, general health conditions, sex, and diet of the subject, dose intervals, administration routes, excretion rate, and combinations of drugs. Any of the above dosage forms containing effective amounts are well within the bounds of routine experimentation.

In the compositions for treating multiple myeloma described herein, the therapeutically effective amount of the proteasome inhibitor can range from about 0.001 mg/kg to about 30 mg/kg body weight of the subject. In some embodiments, the therapeutically effective amount of the agent can range from about 0.05 mg/kg to about 30 mg/kg, from about 0.1 mg/kg to about 30 mg/kg, from about 1 mg/kg to about 25 mg/kg, from about 1 mg/kg to about 20 mg/kg, or from about 1 or 2 mg/kg to about 15 mg/kg.

The methods described herein include the manufacture and use of pharmaceutical compositions, which include compounds (e.g., proteasome inhibitors and/or other chemotherapeutic agents) identified by a method described herein as active ingredients. Also included are the pharmaceutical compositions themselves.

Pharmaceutical compositions typically include a pharmaceutically acceptable carrier. As used herein the language "pharmaceutically acceptable carrier" includes saline, solvents, dispersion media, coatings, antibacterial and antifungal agents, isotonic and absorption delaying agents, and the like, compatible with pharmaceutical administration. Supplementary active compounds can also be incorporated into the compositions, e.g., chemotherapeutic agents.

Pharmaceutical compositions are typically formulated to be compatible with its intended route of administration. Examples of routes of administration include parenteral, e.g., intravenous, intradermal, subcutaneous, oral (e.g., inhalation), transdermal (topical), transmucosal, and rectal administration.

Methods of formulating suitable pharmaceutical compositions are known in the art, see, e.g., *Remington: The Science and Practice of Pharmacy,* 21st ed., 2005; and the books in the series *Drugs and the Pharmaceutical Sciences: a Series of Textbooks and Monographs* (Dekker, N.Y.). For example, solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use can include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringability exists. It should be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as mannitol, sorbitol, sodium chloride in the composition. Prolonged absorption of the injectable compositions can be brought about by including in the composition an agent that delays absorption, for example, aluminum monostearate and gelatin.

Sterile injectable solutions can be prepared by incorporating the active compound in the required amount in an appropriate solvent with one or a combination of ingredients enumerated above, as required, followed by filtered sterilization. Generally, dispersions are prepared by incorporating the active compound into a sterile vehicle, which contains a basic dispersion medium and the required other ingredients from those enumerated above. In the case of sterile powders for the preparation of sterile injectable solutions, the preferred methods of preparation are vacuum drying and freeze-drying, which yield a powder of the active ingredient plus any additional desired ingredient from a previously sterile-filtered solution thereof.

Oral compositions generally include an inert diluent or an edible carrier. For the purpose of oral therapeutic administration, the active compound can be incorporated with excipients and used in the form of tablets, troches, or capsules, e.g., gelatin capsules. Oral compositions can also be prepared using a fluid carrier for use as a mouthwash. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

In one embodiment, the therapeutic compounds are prepared with carriers that will protect the therapeutic compounds against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Such formulations can be prepared using standard techniques, or obtained commercially, e.g., from Alza Corporation and Nova Pharmaceuticals, Inc. Liposomal suspensions (including liposomes targeted to selected cells with monoclonal antibodies to cellular antigens) can also be used as pharmaceutically acceptable carriers. These can be prepared according to methods known to those skilled in the art, for example, as described in U.S. Pat. No. 4,522,811.

The pharmaceutical compositions can be included in a container, pack, or dispenser together with instructions for administration.

With regard to the inventions described in the section titled "Additional Embodiments" the following applies:

As disclosed herein, the term "immunoglobulin expression" or "Ig expression" refers to the expression level of one or more of the known immunoglobulin classes including IgA, IgG, IGM, IgE, and IgD.

As used herein, the term "immunoglobulin" refers to a protein consisting of one or more polypeptide(s) substantially encoded by immunoglobulin genes. The recognized immunoglobulin genes include the different constant region genes as well as the myriad immunoglobulin variable region genes. Immunoglobulins may exist in a variety of formats, including, for example, Fv, Fab, and F(ab)2 as well as single chains (scFv) or diabodies. Immunoglobulins can come in different varieties known as isotypes or classes. In placental mammals there are five antibody isotypes known as IgA, IgD, IgE, IgG and IgM. They are each named with an "Ig" prefix that stands for immunoglobulin, another name for antibody, and differ in their biological properties, functional locations and ability to deal with different antigens.

As used herein, the term "antibody" refers to an immunoglobulin and any antigen-binding portion of an immunoglobulin, e.g., IgG, IgD, IgA, IgM and IgE, or a polypeptide that contains an antigen binding site, which specifically binds or "immunoreacts with" an antigen. Antibodies can comprise at least one heavy (H) chain and at least one light (L) chain inter-connected by at least one disulfide bond. The term "VH" refers to a heavy chain variable region of an antibody. The term "VL" refers to a light chain variable region of an antibody. In exemplary embodiments, the term "antibody" specifically covers monoclonal and polyclonal antibodies. A "polyclonal antibody" refers to an antibody which has been derived from the sera of animals immunized with an antigen or antigens. A "monoclonal antibody" refers to an antibody produced by a single clone of hybridoma cells.

As used herein, the term "biomarker" refers to a molecule that is associated either quantitatively or qualitatively with a biological change. Examples of biomarkers include: polypeptides, proteins or fragments of a polypeptide or protein; polynucleotides, such as a gene product, RNA or RNA fragment; and other body metabolites.

As disclosed herein, the term "hematological malignancy" or "hematological tumor" refers to cancers that affect blood and bone marrow.

The term "myeloma" as used herein means any tumor or cancer composed of cells derived from the hemopoietic tissues of the bone marrow. For example, myeloma includes multiple myeloma.

The "proteasome" as used herein refers to a multimeric enzymatic complex involved in the degradation of protein.

As disclosed herein, the term "proteasome inhibitor" is intended to include compounds which target, decrease or inhibit the activity of the proteasome. Compounds which target, decrease or inhibit the activity of the proteasome include, but are not limited to, carfilzomib (Kyprolis), oprozomib and bortezomib (Velcade).

As used herein, to "inhibit" or "suppress" or "reduce" a function or activity, such as proteasomal activity, is to reduce the function or activity when compared to otherwise same conditions except for a condition or parameter of interest, or alternatively, as compared to another condition.

As used herein, the term "reference level" refers to a level of a substance which may be of interest for comparative purposes. In one embodiment, a reference level may be the expression level of a protein or nucleic acid expressed as an average of the level of the expression level of a protein or nucleic acid from samples taken from a control population of normal, or healthy (disease-free) subjects. In another embodiment, the reference level may be the level in the same subject at a different time, e.g., before the present assay, such as the level determined prior to the subject developing the disease or prior to initiating therapy. In general, samples are normalized by a common factor. For example, body fluid samples are normalized by volume body fluid and cell-containing samples are normalized by protein content or cell count. In another embodiment, the reference level may also refer to the level of expression of the same biomarker in a corresponding control sample or control group of subjects which do not respond to PI treatment (e.g., treatment with carfilzomib, oprozomib or bortezomib).

As used herein, the term "subject" refers to a mammal, preferably a human, who may or may not have cancer. Typically, the terms "subject" and "patient" are used interchangeably herein in reference to a human subject. The subject may be a patient undergoing proteasome inhibition s (e.g., carfilzomib, oprozomib, bortezomib or other related agent) therapy using a sole therapeutic agent. The subject may be a patient undergoing proteasome inhibition s (e.g., carfilzomib, oprozomib, bortezomib or other related agent) therapy using a therapeutic agent in conjunction with another agent (e.g., a chemotherapeutic agent).

As used herein, the term "sample" or "test sample" refers to any liquid or solid material, specimen or culture obtained from any source containing nucleic acids or proteins. In suitable embodiments, a test sample is obtained from a biological source, e.g., a "biological sample". Biological samples include blood products (such as plasma, serum, whole blood and peripheral blood mononuclear cells (PBMCs)), urine, saliva, blood, serum, or biopsy sample and the like. Biological samples also include tissue samples, such as biopsy tissues or pathological tissues that have previously been fixed (e.g., formalin, snap frozen, cytological processing, etc.). In an exemplary embodiment, the sample is a tumor sample.

The terms "detecting", "determining," "measuring," "assessing," and "assaying" are used interchangeably and include both quantitative and qualitative determinations. These terms refer to any form of measurement, and include determining if a characteristic, trait, or feature is present or not.

As used herein, the phrase "difference of the level" refers to differences in the quantity of a particular marker, such as a biomarker protein or nucleic acid, in a sample as compared to a control or reference level. For example, the quantity of particular protein or nucleic acid may be present at an elevated amount or at a decreased amount in samples of patients with a disease compared to a reference level. In one embodiment, a "difference of a level" may be a difference between the level of biomarker present in a sample as compared to a control of at least about 1%, at least about 2%, at least about 3%, at least about 5%, at least about 10%, at least about 15%, at least about 20%, at least about 25%, at least about 30%, at least about 35%, at least about 40%, at least about 50%, at least about 60%, at least about 75%, at least about 80% or more. In one embodiment, a "difference of a level" may be a statistically significant difference between the level of the biomarker present in a sample as compared to a control. For example, a difference may be statistically significant if the measured level of the biomarker falls outside of about 1.0 standard deviations, about 1.5 standard deviations, about 2.0 standard deviations, or about 2.5 standard deviations of the mean of any control or reference group.

The term "elevated levels", "increased levels" or "higher levels" as used herein refers to levels of a biomarker protein or nucleic acid that are higher than what would normally be observed in a comparable sample from control or normal subjects, e.g., a reference value. In some embodiments, "control levels", e.g., normal levels, refer to a range of biomarker protein or nucleic acid levels that would normally be expected to be observed in a sample from a mammal that does not have a disease. A control level may be used as a reference level for comparative purposes. "Elevated levels" refer to biomarker protein or nucleic acid levels that are above the range of reference levels (e.g, control levels). The ranges accepted as "elevated levels" or "reference levels" are dependent on a number of factors. For example, one laboratory may routinely determine the level of biomarker protein or nucleic acid in a sample that are different than the level obtained for the same sample by another laboratory. Also, different assay methods may achieve different value ranges. Value ranges may also differ in various sample types, for example, different body fluids or by different treatments of the sample. One of ordinary skill in the art is capable of considering the relevant factors and establishing appropriate reference ranges for "control values" and "elevated values" of the present disclosure. For example, a series of samples from control subjects and subjects diagnosed with cancer can be used to establish ranges that are "normal" or "control" levels and ranges that are "elevated" or "higher" than the control range. In one embodiment, expression/amount of a gene or biomarker (e.g., Ig expression levels) in a sample is at an "elevated level" compared with a reference value if the expression level/amount of the gene or biomarker in the sample is at least about 1.5×, 1.75×, 2×, 3×, 4×, 5×, 6×, 7×, 8×, 9× or 10× the expression level/amount of the gene or biomarker in reference value.

Similarly, "reduced levels" or "lower levels" as used herein refer to levels of a biomarker protein or nucleic acid that are lower than what would normally be observed in a comparable sample from control or normal subjects, e.g., a reference value. In some embodiments, "control levels", e.g., normal levels, refer to a range of biomarker protein or nucleic acid levels that would be normally be expected to be observed in a mammal that does not have a disease and "reduced levels" refer to biomarker protein or nucleic acid levels that are below the range of control levels.

As used herein, the terms "gene expression" or "expression" refer to the process of converting genetic information encoded in a gene into RNA, e.g., mRNA, rRNA, tRNA, or snRNA, through transcription of the gene, e.g., via the enzymatic action of an RNA polymerase, and for protein encoding genes, into protein through translation of mRNA. Gene expression can be regulated at many stages in the process.

As used herein, the term "diagnosis" means detecting a disease or disorder or determining the stage or degree of a disease or disorder. Usually, a diagnosis of a disease or disorder is based on the evaluation of one or more factors and/or symptoms that are indicative of the disease. That is, a diagnosis can be made based on the presence, absence or amount of a factor which is indicative of presence or absence of the disease or condition. Each factor or symptom that is considered to be indicative for the diagnosis of a particular disease does not need be exclusively related to the particular disease, e.g. there may be differential diagnoses that can be inferred from a diagnostic factor or symptom. Likewise, there may be instances where a factor or symptom that is indicative of a particular disease is present in an individual that does not have the particular disease. The term "diagnosis" also encompasses determining the therapeutic effect of a drug therapy, or predicting the pattern of response to a drug therapy. The diagnostic methods may be used independently, or in combination with other diagnosing and/or staging methods known in the medical arts for a particular disease or disorder, e.g., MM.

The term "prognosis" as used herein refers to a prediction of the probable course and outcome of a clinical condition or disease. A prognosis is usually made by evaluating factors or symptoms of a disease that are indicative of a favorable or unfavorable course or outcome of the disease. The phrase "determining the prognosis" as used herein refers to the process by which the skilled artisan can predict the course or outcome of a condition in a patient. The term "prognosis" does not refer to the ability to predict the course or outcome of a condition with 100% accuracy. Instead, the skilled artisan will understand that the term "prognosis" refers to an increased probability that a certain course or outcome will occur; that is, that a course or outcome is more likely to occur in a patient exhibiting a given condition, when compared to those individuals not exhibiting the condition. The terms "favorable prognosis" and "positive prognosis," or "unfavorable prognosis" and "negative prognosis" as used herein are relative terms for the prediction of the probable course and/or likely outcome of a condition or a disease. A favorable or positive prognosis predicts a better outcome for a condition than an unfavorable or negative prognosis. In a general sense, a "favorable prognosis" is an outcome that is relatively better than many other possible prognoses that could be associated with a particular condition, whereas an unfavorable prognosis predicts an outcome that is relatively worse than many other possible prognoses that could be associated with a particular condition. Typical examples of a favorable or positive prognosis include a better than average remission rate, a lower propensity for metastasis, a longer than expected life expectancy, differentiation of a benign process from a cancerous process, and the like.

As used herein, the term "effective amount" or "pharmaceutically effective amount" or "therapeutically effective amount" refers to is a quantity of the compound(s) in a preparation which, when administered as part of a dosage regimen (to a mammal, e.g., a human) sufficient to achieve a desired therapeutic and/or prophylactic effect, e.g., an amount which alleviates a symptom, ameliorates a condition, or slows the onset of disease conditions according to clinically acceptable standards for the disorder or condition to be treated. The amount of a composition administered to the subject will depend on the type and severity of the disease and on the characteristics of the individual, such as general health, age, sex, body weight and tolerance to drugs. It will also depend on the degree, severity and type of disease. The skilled artisan will be able to determine appropriate dosages depending on these and other factors. The compositions can also be administered in combination with one or more additional therapeutic compounds and/or treatments.

As used herein, the term "treating" or "treatment" includes reversing, reducing, or arresting the symptoms, clinical signs, and underlying pathology of a condition in manner to improve or stabilize a subject's condition.

As used herein, "microarray" or "gene expression array" or "array" or "tissue microarray" refers to an arrangement of a collection of nucleic acids, e.g., nucleotide sequences in a centralized location. Arrays can be on a solid substrate, such as a glass slide, or on a semi-solid substrate, such as nitrocellulose membrane. The nucleotide sequences can be DNA, RNA, or any combination or permutations thereof. The nucleotide sequences can also be partial sequences or fragments from a gene, primers, whole gene sequences, non-coding sequences, coding sequences, published sequences, known sequences, or novel sequences.

Exemplary embodiments of the invention include:

1. A method of treating a tumor in a subject, comprising:
   a) measuring the level of expression of (i) immunoglobulin (Ig), (ii) Fc gamma receptor 2B (FCGR2B), or (iii) both Ig and FCGR2B, in a sample obtained from the subject, wherein the sample comprises a cell from the tumor; and
   b) administering to the subject an effective amount of a proteasome inhibitor when the level of Ig expression and/or FCGR2B expression in the sample is greater than a reference level.

2. A method of treating a tumor in a subject from which a sample was obtained, wherein the level of expression of (i) immunoglobulin (Ig), (ii) Fc gamma receptor 2B (FCGR2B), or (iii) both Ig and FCGR2B, has been measured from the sample, the method comprising the step of administering to the subject an effective amount of a proteasome inhibitor when the level of expression is greater than a reference level.

3. A method of determining a treatment regimen for a subject with a tumor, comprising:
   a) measuring the level of expression of (i) immunoglobulin (Ig), (ii) Fc gamma receptor 2B (FCGR2B), or (iii) both Ig and FCGR2B, in a sample obtained from the subject, wherein the sample comprises a cell from the tumor, and
   b) selecting a treatment regimen comprising administration of a proteasome inhibitor, when the level of Ig expression and/or FCGR2B expression in the sample is greater than a reference level.

4. The method of any one of claims 1-3, wherein the proteasome inhibitor is selected from the group consisting of carfilzomib, bortezomib, disulfiram, and oprozomib.

5. The method of any one of claims 1-4, wherein the tumor is a hematological tumor, optionally, a hematological tumor derived from lymphoid cells.

6. The method of claim 5, wherein the hematological tumor is a lymphoma, optionally a non-Hodgkin's lymphoma.

7. The method of claim 6, wherein the non-Hodgkin's lymphoma is mantle cell lymphoma.

8. The method of claim 5, wherein the hematological tumor is a multiple myeloma.

9. The method of claim 8, wherein the multiple myeloma is smouldering myeloma, relapsed multiple myeloma, or refractory myeloma.

10. The method of any one of claims 1-9, wherein the level of expression of (i) Ig, (ii) FCGR2B, or (iii) both Ig and FCGR2B, is measured in CD138-positive tumor cells obtained from the subject.

11. The method of claim 10, comprising extracting RNA from the CD138-positive tumor cells.

12. The method of any one of claims 1-11, wherein the sample comprises bone marrow cells, blood, serum, or a biopsy sample.

13. The method of claim 12, comprising contacting antibodies specific for FCGR2B or for Ig with the sample comprising intact bone marrow cells.

14. The method of any one of claims 1-13, comprising measuring the level of expression of one or more gene segments of the IgH locus, IgK locus, or IgL locus, or an IgH orphon gene segment, an IgK orphon gene segment, or an IgL orphon gene segment, or a combination thereof.

15. The method of claim 14, wherein the one or more gene segments at the IgH locus or the IgH orphon gene segment is selected from the group consisting of: IGHA1, IGHA2, IGHD, IGHD1-1, IGHD1-14, IGHD1-20, IGHD1-26, IGHD1-7, IGHD2-15, IGHD2-2, IGHD2-21, IGHD2-8, IGHD3-10, IGHD3-16, IGHD3-22, IGHD3-3, IGHD3-9, IGHD4-11, IGHD4-17, IGHD4-23, IGHD4-4, IGHD5-12, IGHD5-18, IGHD5-24, IGHD5-5, IGHD6-13, IGHD6-19, IGHD6-25, IGHD6-6, IGHD7-27, IGHE, IGHEP1, IGHEP2, IGHG1, IGHG2, IGHG3, IGHG4, IGHGP, IGHJ1, IGHJ1P, IGHJ2, IGHJ2P, IGHJ3, IGHJ3P, IGHJ4, IGHJ5, IGHJ6, IGHM, IGHMBP2, IGHV1-12, IGHV1-14, IGHV1-17, IGHV1-18, IGHV1-2, IGHV1-24, IGHV1-3, IGHV1-45, IGHV1-46, IGHV1-58, IGHV1-67, IGHV1-68, IGHV1-69, IGHV1-8, IGHV1OR21-1, IGHV2-10, IGHV2-26, IGHV2-5, IGHV2-70, IGHV2OR16-5, IGHV3-11, IGHV3-13, IGHV3-15, IGHV3-16, IGHV3-19, IGHV3-20, IGHV3-21, IGHV3-22, IGHV3-23, IGHV3-25, IGHV3-29, IGHV3-30, IGHV3-30-2, IGHV3-32, IGHV3-33, IGHV3-33-2, IGHV3-35, IGHV3-36, IGHV3-37, IGHV3-38, IGHV3-41, IGHV3-42, IGHV3-43, IGHV3-47, IGHV3-48, IGHV3-49, IGHV3-50, IGHV3-52, IGHV3-53, IGHV3-54, IGHV3-57, IGHV3-6, IGHV3-60, IGHV3-62, IGHV3-63, IGHV3-64, IGHV3-65, IGHV3-66, IGHV3-7, IGHV3-71, IGHV3-72, IGHV3-73, IGHV3-74, IGHV3-75, IGHV3-76, IGHV3-79, IGHV3-9, IGHV3OR16-8, IGHV4-28, IGHV4-31, IGHV4-34, IGHV4-39, IGHV4-4, IGHV4-55, IGHV4-59, IGHV4-61, IGHV4-80, IGHV5-51, IGHV5-78, IGHV6-1, IGHV7-27, IGHV7-34-1, IGHV7-40, IGHV7-56, IGHV7-81, IGHVII-1-1, IGHVII-15-1, IGHVII-20-1, IGHVII-22-1, IGHVII-26-2, IGHVII-28-1, IGHVII-30-1, IGHVII-31-1, IGHVII-33-1, IGHVII-40-1, IGHVII-43-1, IGHVII-44-2, IGHVII-46-1, IGHVII-49-1, IGHVII-51-2, IGHVII-53-1, IGHVII-60-1, IGHVII-62-1, IGHVII-65-1, IGHVII-67-1, IGHVII-74-1, IGHVII-78-1, IGHVIII-11-1, IGHVIII-13-1, IGHVIII-16-1, IGHVIII-2-1, IGHVIII-22-2, IGHVIII-25-1, IGHVIII-26-1, IGHVIII-38-1, IGHVIII-44, IGHVIII-47-1, IGHVIII-5-1, IGHVIII-51-1, IGHVIII-5-2, IGHVIII-67-2, IGHVIII-67-3, IGHVIII-67-4, IGHVIII-76-1, IGHVIII-82, and IGHVIV-44-1, wherein the one or more gene segments at the IgK locus or the IgK orphon gene segment is selected from the group consisting of: IGKC, IGKJ1, IGKJ2, IGKJ3, IGKJ4, IGKJ5, IGKV1-12, IGKV1-13, IGKV1-16, IGKV1-17, IGKV1-22, IGKV1-27, IGKV1-32, IGKV1-33, IGKV1-35, IGKV1-37, IGKV1-39, IGKV1-5, IGKV1-6, IGKV1-8, IGKV1-9, IGKV1D-12, IGKV1D-13, IGKV1D-16, IGKV1D-17, IGKV1D-22, IGKV1D-27, IGKV1D-32, IGKV1D-33, IGKV1D-35, IGKV1D-37, IGKV1D-39, IGKV1D-42, IGKV1D-43, IGKV1D-8, IGKV1OR22-1, IGKV2-10, IGKV2-14, IGKV2-18, IGKV2-19, IGKV2-23, IGKV2-24, IGKV2-26, IGKV2-28, IGKV2-29, IGKV2-30, IGKV2-36, IGKV2-38, IGKV2-4, IGKV2-40, IGKV2D-10, IGKV2D-14, IGKV2D-18, IGKV2D-19, IGKV2D-23, IGKV2D-24, IGKV2D-26, IGKV2D-28, IGKV2D-29, IGKV2D-30, IGKV2D-36, IGKV2D-38, IGKV2D-40, IGKV2OR22-3, IGKV2OR22-4, IGKV3-11, IGKV3-15, IGKV3-20, IGKV3-25, IGKV3-31, IGKV3-34, IGKV3-7, IGKV3D-11, IGKV3D-15, IGKV3D-20, IGKV3D-25, IGKV3D-31, IGKV3D-34, IGKV3D-7, IGKV3OR22-2, IGKV4-1, IGKV5-2, IGKV6-21, IGKV6D-21, IGKV6D-41, and IGKV7-3, wherein the one or more gene segments at the IgL locus or the IgL orphon gene segment is selected from the group consisting of: IGLC1, IGLC2, IGLC3, IGLC4, IGLC5, IGLC6, IGLC7, IGLCOR22-1, IGLJ1, IGLJ2, IGLJ3, IGLJ4, IGLJ5, IGLJ6, IGLJ7, IGLL1, IGLL3, IGLON5, IGLV10-54, IGLV10-67, IGLV11-55, IGLV1-36, IGLV1-40, IGLV1-41, IGLV1-44, IGLV1-47, IGLV1-50, IGLV1-51, IGLV1-62, IGLV2-11, IGLV2-14, IGLV2-18, IGLV2-23, IGLV2-28, IGLV2-33, IGLV2-34, IGLV2-5, IGLV2-8, IGLV3-1, IGLV3-10, IGLV3-12, IGLV3-13, IGLV3-15, IGLV3-16, IGLV3-17, IGLV3-19, IGLV3-2, IGLV3-21, IGLV3-22, IGLV3-24, IGLV3-25, IGLV3-26, IGLV3-27, IGLV3-29, IGLV3-30, IGLV3-31, IGLV3-32, IGLV3-4, IGLV3-6, IGLV3-7, IGLV3-9, IGLV4-3, IGLV4-60, IGLV4-69, IGLV5-37, IGLV5-45, IGLV5-48, IGLV5-52, IGLV6-57, IGLV7-35, IGLV7-43, IGLV7-46, IGLV8-61, IGLV9-49, IGLVI-20, IGLVI-38, IGLVI-42, IGLVI-56, IGLVI-63, IGLVI-68, IGLVI-70, IGLVIV-53, IGLVIV-59, IGLVIV-64, IGLVIV-65, IGLVIV-66-1, IGLVV-58, IGLVV-66, IGLVVI-22-1, IGLVVI-25-1, and IGLVVII-41-1.

16. The method of claim 14, wherein the one or more gene segments at the IgH locus or the IgH orphon gene segment comprises a sequence selected from the group consisting of SEQ ID NOs: 1-174, wherein the one or more gene segments at the IgK locus or the IgK orphon gene segment comprises a sequence selected from the group consisting of SEQ ID NOs: 175-260, or wherein the one or more gene segments at the IgL locus or the IgL orphon gene segment comprises a sequence selected from the group consisting of SEQ ID NOs: 261-350.

17. The method of any one of claims 1-16, wherein the level of expression of Ig is the sum of the expression levels of more than one gene segment of the IgH locus, IgK locus, and/or IgL locus and/or more than one IgH orphon gene segment, IgK orphon gene segment, and/or IgK orphon gene segment.

18. The method of claim 17, wherein the level of expression of Ig is the sum of the expression levels of all the gene segments of the IgH locus and all the IgH orphon gene segments.

19. The method of claim 17, wherein the level of expression of Ig is the sum of (i) the levels of expression of all the gene segments of the IgH locus and all the IgH orphon gene segments, (ii) the levels of expression of all the gene segments of the IgK locus and all the IgK orphon gene segments, and (iii) the levels of expression of all the gene segments of the IgL locus and all the IgL orphon gene segments.

20. The method of any one of claims 1-19, comprising measuring the level of expression of Ig and the level of expression of FCGR2B in the sample.

21. The method of any one of claims 1-20, further comprising measuring the level of expression of one of more genes listed in Table 4, optionally, wherein the level of expression of two, three, four, five, six, seven, eight, nine, ten, or more genes listed in Table 4 are measured.

22. The method of any one of claims 1-21, wherein the reference level is a reference level of Ig expression.

23. The method of any one of claims 1-22, wherein the measured level of Ig expression and/or the measured level of FCGR2B expression is at least 2-fold greater than the reference level.

24. The method of any one of claims 1-23, wherein the measured level of Ig expression and/or the measured level of FCGR2B expression is at least 3-fold greater than the reference level.

25. The method of any one of claims 1-24, wherein the measured level of Ig expression and/or the measured level of FCGR2B expression is at least 4-fold greater than the reference level.

26. The method of any one of claims 1-22, wherein the reference level is a cutoff correlative with a % specificity of at least 50% and a % sensitivity of at least 50%, as determined by a receiver operating characteristic (ROC) curve, optionally, wherein the ROC curve is based on (i) the distribution of Ig expression levels and/or FCGR2B expression levels of responders and (ii) the distribution of Ig expression levels and/or FCGR2B expression levels of non-responders.

27. The method of any one of claims 1-22, wherein the reference level is a cutoff correlative with a % specificity of at least 75% and a % sensitivity of at least 75%, as determined by a receiver operating characteristic (ROC) curve, optionally, wherein the ROC curve is based on (i) the distribution of Ig expression levels and/or FCGR2B expression levels of responders and (ii) the distribution of Ig expression levels and/or FCGR2B expression levels of non-responders.

28. The method of any one of claims 1-27, wherein the subject (i) has previously been treated for multiple myeloma or (ii) has previously been diagnosed with multiple myeloma or (iii) is a human patient having or suspected of having multiple myeloma, refractory multiple myeloma, or relapsed multiple myeloma.

29. The method of any one of claims 1-28, wherein measuring the level of expression of Ig and/or FCGR2B in a sample comprises (i) amplifying a fragment of a human Ig mRNA or human FCGR2B mRNA; (ii) measuring the Ig expression level in the cell using a microarray platform that map to genes encoding Ig-related proteins; or (iii) measuring the Ig protein load in the cells with an anti-human Ig antibody.

30. The method of any one of claims 1-29, wherein the measuring comprises amplifying a fragment of a human Ig mRNA and/or human FCGR2B mRNA.

31. The method of claim 30, wherein the amplifying is by polymerase chain reaction (PCR) or RT-PCR.

32. The method of any one of claims 1-31, wherein the measuring comprises measuring the presence, absence, or amount of a human Ig protein in the sample.

33. The method of claim 32, wherein the measuring uses an antibody that specifically binds to a human Ig protein, a human FCGR2B, or a human protein encoded by a gene listed in Table 4.

34. The method of claim 33, wherein the measuring is by an ELISA assay, a western blot assay, or an immunohistochemical assay.

35. A kit comprising one or more binding agents to an Ig gene or gene product, optionally an IgH, IgK or IgL gene segment or gene segment product, or an IgH, IgK, or IgL orphon gene segment or gene segment product, and a binding agent to FCGR2B gene or gene product.

36. A kit comprising (i) one or more binding agents to an Ig gene or gene product, optionally an IgH, IgK or IgL gene segment or gene segment product, or an IgH, IgK, or IgL orphon gene segment or gene segment product, or a binding agent to FCGR2B gene or gene product and (ii) at least one binding agent to a gene or gene product listed in Table 4.

37. The kit of claim 35, further comprising at least one binding agent to a gene or gene product listed in Table 4.

38. The kit of any one of claims 35 to 37, further comprising a proteasome inhibitor.

39. The kit of any one of claims 35-38, further comprising a reagent that produces a signal indicative of a reference level.

40. The kit of any one of claims 35-39, wherein the binding agent is a compound that binds to a nucleic acid molecule, optionally, wherein the binding agent is a nucleic acid molecule.

41. The kit of any one of claims 35 to 40, wherein the binding agent is a compound that binds to a protein, optionally, wherein the binding agent is an antibody, an antigen binding fragment thereof, or an antibody derivative.

42. A method of treating a tumor in a subject, comprising:
   a) measuring the level of expression of one or more genes listed in Table 4, in a sample obtained from the subject, wherein the sample comprises a cell from the tumor; and
   b) administering to the subject an effective amount of a proteasome inhibitor, when (i) the level of expression of the one or more genes listed in Table 4 in the sample greater than a reference level, and the change in gene expression level for the one or more genes or gene products is denoted in Table 4 as "up", or (ii) the level of expression of the one or more genes or gene products listed in Table 4 in the sample is less than a reference level, and the change in gene expression level for the one or more genes or gene products is denoted in Table 4 as "down", or (iii) both (i) and (ii).

43. A method of treating a tumor in a subject from which a sample was obtained, wherein the level of expression of one or more genes or gene products listed in Table 4 has been measured from the sample, the method comprising the step of administering to the subject an effective amount of a proteasome inhibitor, when (i) the level of expression of the one or more genes listed in Table 4 in the sample is greater than a reference level, and the change in gene expression level for the one or more genes or gene products is denoted in Table 4 as "up", or (ii) the level of expression of the one or more genes or gene products listed in Table 4 in the sample is less than a reference level, and the change in gene expression level for the one or more genes or gene products is denoted in Table 4 as "down", or (iii) both (i) and (ii).

44. A method of determining a treatment regimen for a subject with a tumor, comprising:
   a) measuring the level of expression of one or more genes or gene products listed in Table 4 in a sample obtained from the subject, wherein the sample comprises a cell from the tumor, and
   b) selecting a treatment regimen comprising administration of a proteasome inhibitor, when (i) the level of expression of the one or more genes listed in Table 4 in the sample is greater than a reference level, and the change in gene expression level for the one or more genes or gene products is denoted in Table 4 as "up", or (ii) the level of expression of the one or more genes or gene products listed in Table 4 in the sample is less than a reference level, and the change in gene expression level for the one or more genes or gene products is denoted in Table 4 as "down", or (iii) both (i) and (ii).

45. The method of any one of claims 42-44, wherein the proteasome inhibitor is selected from the group consisting of carfilzomib, bortezomib, disulfiram, and oprozomib.

46. The method of any one of claims 42-45, wherein the tumor is a hematological tumor, optionally, a hematological tumor derived from lymphoid cells.

47. The method of claim 46, wherein the hematological tumor is a lymphoma, optionally, a non-Hodgkin's lymphoma.

48. The method of claim 47, wherein the a non-Hodgkin's lymphoma is mantel cell lymphoma.

49. The method of claim 46, wherein the hematological tumor is a multiple myeloma.

50. The method of claim 49, wherein the multiple myeloma is smouldering myeloma, relapsed multiple myeloma, or refractory myeloma.

51. The method of any one of claims 42-50, wherein the level of expression of the one or more genes or gene products in Table 4 is measured in CD138-positive tumor cells obtained from the subject.

52. The method of claim 51, comprising extracting RNA from the CD138-positive tumor cells.

53. The method of any one of claims 42-52, wherein the sample comprises bone marrow cells, blood, serum, or a biopsy sample.

54. The method of claim 53, comprising contacting antibodies specific for a gene product encoded by the one or more genes in Table 4 with the sample comprising bone marrow cells.

55. The method of any one of claims 42-54, further comprising measuring the level of expression of Ig and/or FCGF2B in the sample.

56. The method of claim 55, further comprising measuring the level of expression of one or more gene segments of the IgH locus, IgK locus, or IgL locus, or an IgH orphon gene segment, an IgK orphon gene segment, or an IgL orphon gene segment, or a combination thereof.

57. The method of claim 56, wherein the one or more genes of the IgH locus or the IgH orphon gene segment is/are selected from the group consisting of the group of gene segments of the IgH locus in claim 15, wherein the one or more gene segments of the IgK locus or the IgK orphon gene segment is/are selected from the group consisting of the group of gene segments of the IgK locus in claim 15, or wherein the one or more gene segments at the IgL locus or the IgL orphon gene segment is/are selected from the group consisting of the group of gene segments of the IgL locus in claim 15.

58. The method of claim 56, wherein the one or more gene segments at the IgH locus or the IgH orphon gene segment comprises a sequence selected from the group consisting of SEQ ID NOs: 1-174, wherein the one or more gene segments at the IgK locus or the IgK orphon gene segment comprises a sequence selected from the group consisting of SEQ ID NOs: 175-260, or wherein the one or more gene segments at the IgL locus or the IgL orphon gene segment comprises a sequence selected from the group consisting of SEQ ID NOs: 261-350.

59. The method of any one of claims 42 to 58, wherein the level of expression of Ig is the sum of the expression levels of more than one gene segment of the IgH locus, IgK locus, and/or IgL locus and/or more than one IgH orphon gene segment, IgK orphon gene segment, and/or IgK orphon gene segment.

60. The method of claim 59, wherein the level of expression of Ig is the sum of the expression levels of all the gene segments of the IgH locus and all the IgH orphon gene segments.

61. The method of any one of claims 42-60, wherein the level of expression of Ig is the sum of (i) the levels of expression of all the gene segments of the IgH locus and all the IgH orphon gene segments, (ii) the levels of expression of all the gene segments of the IgK locus and all the IgK orphon gene segments, and (iii) the levels of expression of all the gene segments of the IgL locus and all the IgL orphon gene segments.

62. The method of any one of claims 42 to 61, comprising measuring the level of expression of two of more genes listed in Table 4, optionally, wherein the level of expression of three, four, five, six, seven, eight, nine, ten, or more genes listed in Table 4 are measured.

63. The method of any one of claims 42-62, wherein the reference level is a reference value of expression level of the one or more genes.

64. The method of any one of claims 42-63, wherein the measured level of expression of the one or more genes is at least 2-foldless than or greater than the reference level.

65. The method of any one of claims 42-64, wherein the measured level of expression of the one or more genes is at least 3-fold less than or greater than,the reference level.

66. The method of any one of claims 42-65, wherein the measured level of expression of the one or more genes is at least 4-fold less than or greater than the reference level.

67. The method of any one of claims 42-66, wherein the reference level is a cutoff correlative with a % specificity of at least 50% and a % sensitivity of at least 50%, as determined by a receiver operating characteristic (ROC) curve, optionally, wherein the ROC curve is based on (i) the distribution of expression levels of responders, wherein the expression levels are the expression levels of the one or more genes listed in Table 4 and (ii) the distribution of expression levels of non-responders, wherein the expression levels are the expression levels of the one or more genes listed in Table 4.

68. The method of any one of claims 42-67, wherein the reference level is a cutoff correlative with a % specificity of at least 75% and a % sensitivity of at least 75%, as determined by a receiver operating characteristic (ROC) curve, optionally, wherein the ROC curve is based on (i) the distribution of expression levels of responders, wherein the expression levels are the expression levels of the one or more genes listed in Table 4 and (ii) the distribution of expression levels of non-responders, wherein the expression levels are the expression levels of the one or more genes listed in Table 4.

69. The method of any one of claims 42-67, wherein the subject (i) has previously been treated for multiple myeloma or (ii) has previously been diagnosed with multiple myeloma or (iii) is a human patient having or suspected of having multiple myeloma, refractory multiple myeloma, or relapsed multiple myeloma.

70. The method any one of claims 42-69, comprising (i) amplifying a fragment of a human mRNA encoded by the one or more genes; (ii) measuring the expression level in the cell using a microarray platform that map to the one or more genes; or (iii) measuring the protein load in the cells with an antibody specific for the protein product encoded by the one or more genes.

71. The method of any one of claims 42-70, comprising amplifying a fragment of a human mRNA encoded by the one or more genes.

72. The method of claim 71, wherein the amplifying is by polymerase chain reaction (PCR) or RT-PCR.

73. The method of any one of claims 42-72, comprising measuring the presence, absence, or amount of a human protein encoded by the one or more genes in the test sample.

74. The method of claim 73, comprising the use of an antibody that specifically binds to a gene produce encoded by a gene listed in Table 4.

75. The method of claim 74, comprising measuring by an ELISA assay, a western blot assay, or an immunohistochemical assay.

76. A kit comprising at least a first binding agent and a second binding agent, wherein the first binding agent binds to a first gene or gene product encoded by a first gene listed in Table 4, wherein the second binding agent binds to a second gene or gene product encoded by a second gene listed in Table 4, wherein the first gene is different from the second gene.

77. The kit of claim 76 further comprising a proteasome inhibitor.

78. The kit of claim 76 or 77, further comprising a binding agent to an Ig or FCGR2B.

79. The kit of any one of claims 76 to 78 further comprising a reagent that produces a signal indicative of a reference level.

80. The kit of any one of claims 76 to 79, wherein the binding agent is a compound that binds to a nucleic acid molecule, optionally, wherein the binding agent is a nucleic acid molecule.

81. The kit of any one of claims 76 to 80, wherein the binding agent is a compound that binds to a protein, optionally, wherein the binding agent is an antibody, an antigen binding fragment thereof, or an antibody derivative.

82. A computer readable-storage medium having stored thereon a plurality of reference levels or ranges of reference levels, each reference level or range of reference levels corresponding to (i) an expression level of Ig or (ii) an expression level of FCGR2B, or (iii) an expression level of a gene listed in Table 4, or (iv) a combination thereof; and a data value that is an expression level of Ig and/or an expression level of FCGR2B and/or an expression level of a gene listed in Table 4, measured from a cell from a sample from a patient.

83. The computer readable-storage medium of claim 82, wherein the data value that is the expression level of Ig is the sum of the expression levels of more than one gene segment of the IgH, IgK, and/or IgL locus, optionally, wherein the expression level of Ig is indicative of a responder or non-responder.

84. A computer readable-storage medium having stored thereon (I) a first set of data values and a second set of data values, wherein each data value of the first set is an expression level of Ig determined from a sample obtained from a responder and each data value of the second set is an expression level of Ig determined from a sample obtained from a non-responder; (II) a receiver operating characteristic (ROC) curve based on a first set of data values and a second set of data values, wherein each data value of the first set is an expression level of Ig determined from a sample obtained from a responder and each data value of the second set is an expression level of Ig determined from a sample obtained from a non-responder; or (III) a table listing (a) a plurality of cut-off points on the ROC curve of (II), (b) the % sensitivity associated with each cut-off point of (a), and (c) the % specificity associated with each cut-off point of (a).

85. A computer readable-storage medium having stored thereon (I) a first set of data values and a second set of data values, wherein each data value of the first set is an expression level of FCGR2B determined from a sample obtained from a responder and each data value of the second set is an expression level of FCGR2B deteremined from a sample obtained from a non-responder; (II) a receiver operating characteristic (ROC) curve based on a first set of data values and a second set of data values, wherein each data value of the first set is an expression level of FCGR2B determined from a sample obtained from a responder and each data value of the second set is an expression level of FCGR2B deteremined from a sample obtained from a non-responder; or (III) a table listing (a) a plurality of cut-off points on the ROC curve of (II), (b) the % sensitivity associated with each cut-off point of (a), and (c) the % specificity associated with each cut-off point of (a).

86. A computer readable-storage medium having stored thereon (I) a first set of data values and a second set of data values, wherein each data value of the first set is an expression level of a gene listed in Table 4 determined from a sample obtained from a responder and each data value of the second set is an expression level of a gene listed in Table 4 determined from a sample obtained from a non-responder; (II) a receiver operating characteristic (ROC) curve based on a first set of data values and a second set of data values, wherein each data value of the first set is an expression level of a gene listed in Table 4 determined from a sample obtained from a responder and each data value of the second set is an expression level of a gene listed in Table 4 determined from a sample obtained from a non-responder; or (III) a table listing (a) a plurality of cut-off points on the ROC curve of (II), (b) the % sensitivity associated with each cut-off point of (a), and (c) the % specificity associated with each cut-off point of (a).

87. A computer readable storage medium comprising two or more of the computer storage media of claims 84-86.

88. A system comprising: a processor; a memory device coupled to the processor, and machine readable instructions stored on the memory device, wherein the machine readable instructions, when executed by the processor, cause the processor to:
   i. receive a data value, α, relating to a test level of Ig expression from a sample obtained from a test subject; and
   ii. display an output relating to treating the subject for multiple myeloma with a proteasome inhibitor, when α is greater than β, a cutoff correlative with a % specificity of at least 50% and a % sensitivity of at least 50%, as determined by a receiver operating characteristic (ROC) curve.

89. A system comprising: a processor; a memory device coupled to the processor, and machine readable instructions stored on the memory device, wherein the machine readable instructions, when executed by the processor, cause the processor to:
   i. receive a data value, α, relating to a test level of FCGR2B expression from a sample obtained from a test subject; and
   ii. display an output relating to treating the subject for multiple myeloma with a proteasome inhibitor, when α is greater than β, a cutoff correlative with a % specificity of at least 50% and a % sensitivity of at least 50%, as determined by a receiver operating characteristic (ROC) curve.

90. A system comprising: a processor; a memory device coupled to the processor, and machine readable instructions stored on the memory device, wherein the machine readable instructions, when executed by the processor, cause the processor to:
   i. receive a data value, α, relating to a test level of expression of a gene listed in Table 4, wherein the change in gene expression level for the gene is denoted in Table 4 as "up", from a sample obtained from a test subject; and
   ii. display an output relating to treating the subject for multiple myeloma with a proteasome inhibitor, when α is greater than β, a cutoff correlative with a % specificity of at least 50% and a % sensitivity of at least 50%, as determined by a receiver operating characteristic (ROC) curve.

91. A system comprising: a processor; a memory device coupled to the processor, and machine readable instructions stored on the memory device, wherein the machine readable instructions, when executed by the processor, cause the processor to:
   i. receive a data value, α, relating to a test level of expression of a gene listed in Table 4, wherein the change in gene expression level for the gene is denoted in Table 4 as "down", from a sample obtained from a test subject; and
   ii. display an output relating to treating the subject for multiple myeloma with a proteasome inhibitor, when α is less than β, a cutoff correlative with a % specificity of at least 50% and a % sensitivity of at least 50%, as determined by a receiver operating characteristic (ROC) curve.

92. A computer-readable storage medium having stored thereon machine-readable instructions executable by a processor, comprising:
   i. instructions for receiving a data value, α, relating to a test level of Ig expression from a sample obtained from a test subject; and
   ii. instructions for displaying an output relating to treating the subject for multiple myeloma with a proteasome inhibitor, when α is greater than β, a cutoff correlative with a % specificity of at least 50% and a % sensitivity of at least 50%, as determined by a receiver operating characteristic (ROC) curve.

93. A computer-readable storage medium having stored thereon machine-readable instructions executable by a processor, comprising:
   i. instructions for receiving a data value, α, relating to a test level of FCGR2B expression from a sample obtained from a test subject; and
   ii. instructions for displaying an output relating to treating the subject for multiple myeloma with a proteasome inhibitor, when α is greater than β, a cutoff correlative with a % specificity of at least 50% and a % sensitivity of at least 50%, as determined by a receiver operating characteristic (ROC) curve.

94. A computer-readable storage medium having stored thereon machine-readable instructions executable by a processor, comprising:
   i. instructions for receiving a data value, α, relating to a test level of expression of a gene listed in Table 4 from a sample obtained from a test subject, wherein the change in gene expression level for the gene is denoted in Table 4 as "up"; and
   ii. instructions for displaying an output relating to treating the subject for multiple myeloma with a proteasome inhibitor, when α is greater than β, a cutoff correlative with a % specificity of at least 50% and a % sensitivity of at least 50%, as determined by a receiver operating characteristic (ROC) curve.

95. A computer-readable storage medium having stored thereon machine-readable instructions executable by a processor, comprising:
   (i) instructions for receiving a data value, α, relating to a test level of expression of a gene listed in Table 4 from a sample obtained from a test subject, wherein the change in gene expression level for the gene is denoted in Table 4 as "down"; and
   (ii) instructions for displaying an output relating to treating the subject for multiple myeloma with a proteasome inhibitor, when α is less than β, a cutoff correlative with a % specificity of at least 50% and a % sensitivity of at least 50%, as determined by a receiver operating characteristic (ROC) curve.

96. A method implemented by a processor in a computer, the method comprising the steps of:
   i. receiving a data value, α, relating to a test level of Ig expression from a sample obtained from a test subject; and
   ii. displaying an output relating to treating the subject for multiple myeloma with a proteasome inhibitor, when α is greater than β, a cutoff correlative with a % specificity of at least 50% and a % sensitivity of at least 50%, as determined by a receiver operating characteristic (ROC) curve.

97. A method implemented by a processor in a computer, the method comprising the steps of:
   i. receiving a data value, α, relating to a test level of FCGR2B expression from a sample obtained from a test subject; and
   ii. displaying an output relating to treating the subject for multiple myeloma with a proteasome inhibitor, when α is greater than β, a cutoff correlative with a % specificity of at least 50% and a % sensitivity of at least 50%, as determined by a receiver operating characteristic (ROC) curve.

98. A method implemented by a processor in a computer, the method comprising the steps of:
   i. receiving a data value, α, relating to a test level of expression of a gene listed in Table 4 from a sample obtained from a test subject, wherein the change in gene expression level for the gene is denoted in Table 4 as "up"; and
   ii. displaying an output relating to treating the subject for multiple myeloma with a proteasome inhibitor, when α is greater than β, a cutoff correlative with a % specificity of at least 50% and a % sensitivity of at least 50%, as determined by a receiver operating characteristic (ROC) curve.

99. A method implemented by a processor in a computer, the method comprising the steps of:
   (i) receiving a data value, α, relating to a test level of expression of a gene listed in Table 4 from a sample obtained from a test subject, wherein the change in gene expression level for the gene is denoted in Table 4 as "down"; and
   (ii) displaying an output relating to treating the subject for multiple myeloma with a proteasome inhibitor, when α is less than β, a cutoff correlative with a % specificity of at least 50% and a % sensitivity of at least 50%, as determined by a receiver operating characteristic (ROC) curve.

The following examples serve only to illustrate the invention or provide background information relating to the invention. The following examples are not intended to limit the scope of the invention in any way.

EXAMPLES

Several therapies for multiple myeloma (MM) are now approved and many more are in development, promising improved outcomes for patients with this incurable cancer. With expanding treatment options, however, comes a pressing need to pair each patient with the most efficacious and safe treatment. Proteasome inhibitors (PIs), such as carfilzomib and bortezomib, have become a standard therapy across all lines of MM therapy. Despite extensive study, the mechanism of selective tumor cell death following proteasome inhibition is poorly understood. However, the uniquely high sensitivity of myeloma cells to PI, the uniquely high burden of protein (immunoglobulin) secretion these cells experience, and the key role of the proteasome in maintaining protein homeostasis, together point toward a unifying model in which protein load drives PI sensitivity. This simple model is supported by published studies of murine and human myeloma cell lines (Meister et al. & Bianchi et al.). As part of company-sponsored Phase II & III clinical trials of PIs, CD138+ tumor cells collected during patient screening were banked for comprehensive genomic analyses. Patient samples banked on bortezomib trials were utilized in now-published microarray-based RNA studies (Mulligan et al.), while samples from carfilzomib trials are currently being used for NGS-based DNA and RNA studies. Here, examining the early carfilzomib data along with publically-available bortezomib data, the inventors demonstrate a strong association between higher immunoglobulin expression and sensitivity to each compound (Wilcoxon P-value=$3\times10^{-3}$ and P-value=$2\times10^{-4}$, respectively). In fact, using IGH expression alone, the inventors were able to classify response with 55% sensitivity and 91% specificity for the carfilzomib training data set. As expected for a bona fide predictive biomarker of PI, an association between IG expression and response was not found in patients treated with single agent dexamethasone (Wilcoxon P-value=0.82). Median time to progression for IGH-high carfilzomib patients was 6-fold longer than for IGH-low carfilzomib patients (7.6 months vs. 1.4 months; log-rank P-value=0.003). This is the first report that high levels of IG expression correlate with response to PIs and therefore IG expression represents, to our knowledge, the first validated biomarker for this important class of anti-tumor agents.

Example 1: Bortezomib Data Analysis

Publicly available RNA microarray data in tab-delimited text format were downloaded from the Gene Expression Omnibus (GEO ID: GSE9782). These data, originally reported in a publication by Mulligan et al., represent normalized, probe-level measurements of mRNA abundance in multiple myeloma tumor cells (CD138+ selected) collected from patients prior to treatment with either single-agent bortezomib or single-agent dexamethasone on Millennium's Phase 2 and Phase 3 clinical trials.

A list of 55 probes from this Affymetrix microarray platform that map to genes encoding immunoglobulin (Ig)-related proteins was obtained from Rody et al. Addition File 5. This example tested for an association between normalized intensity of each of these 55 probes and bortezomib response, which was labeled as "PGx_Responder=R" in the dataset. Of these, 13 showed a significant correlation (Wilcoxon P-value<=0.05) between higher expression values and response on the bortezomib arms of the studies: 211798_x_at, 211881_x_at, 216365_x_at, 216560_x_at, 217148_x_at, 217179_x_at, 217227_x_at, 217258_x_at, 211639_x_at, 216491_x_at, 211649_x_at, 216510_x_at, and 211637_x_at. The finding of 13 significant associations is far more than expected by chance (Binomial P-value=$2\times10^{-6}$). None of the 55 probes showed the opposite effect. It is not surprising that many probes are not associated, given that some map to rarer, patient-specific portions of the Ig loci and that others map to regions that are unusually highly-expressed, and therefore not well-measured with microarray technology (i.e., their fluorescence is likely to be saturated).

Figure 1B:
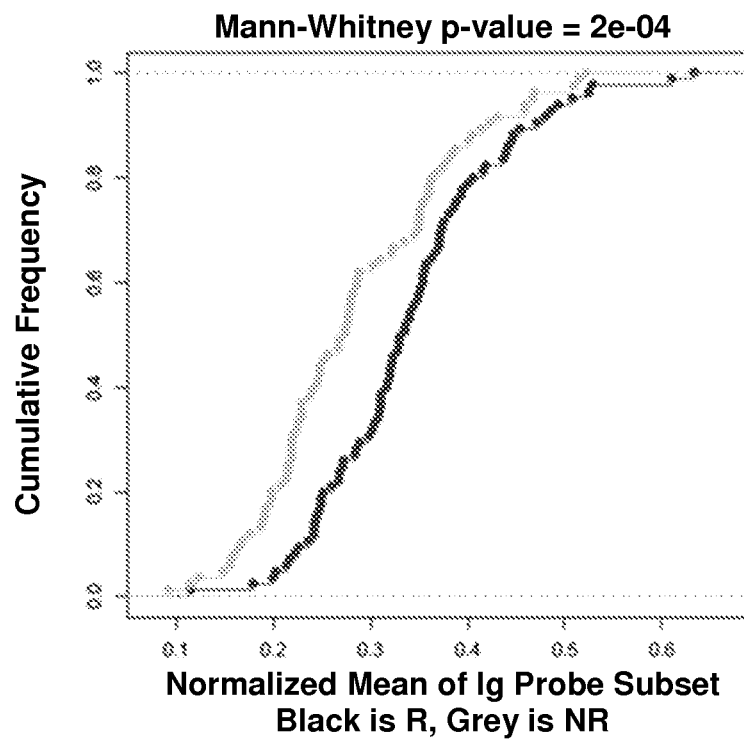
Figure 2A:
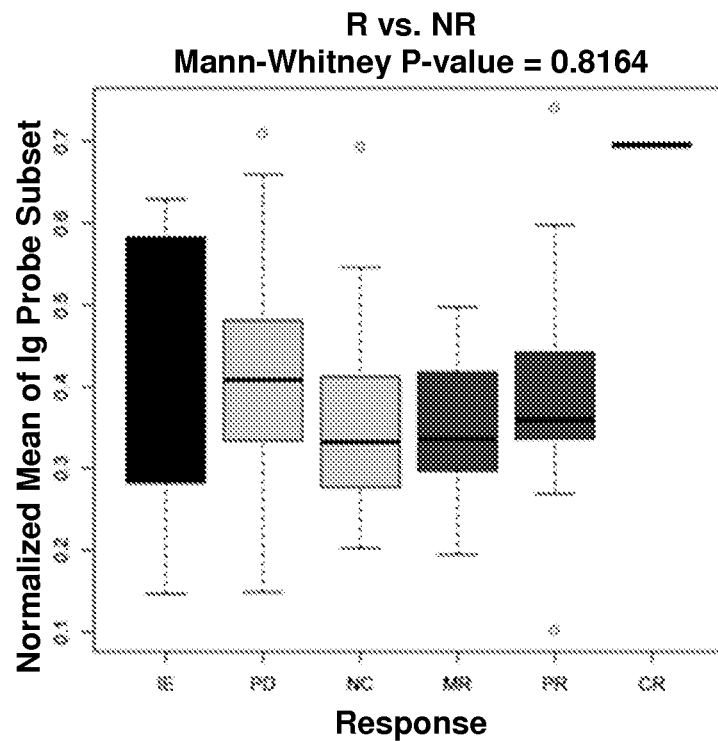
FIGS. 2A and 2B are graphs demonstrating the lack of association between IG expression and dexamethasone response. IE, response not evaluable; PD, progressive disease; no change, NC; minimal response, MR; partial response, PR; complete response, CR.
Figure 2B:
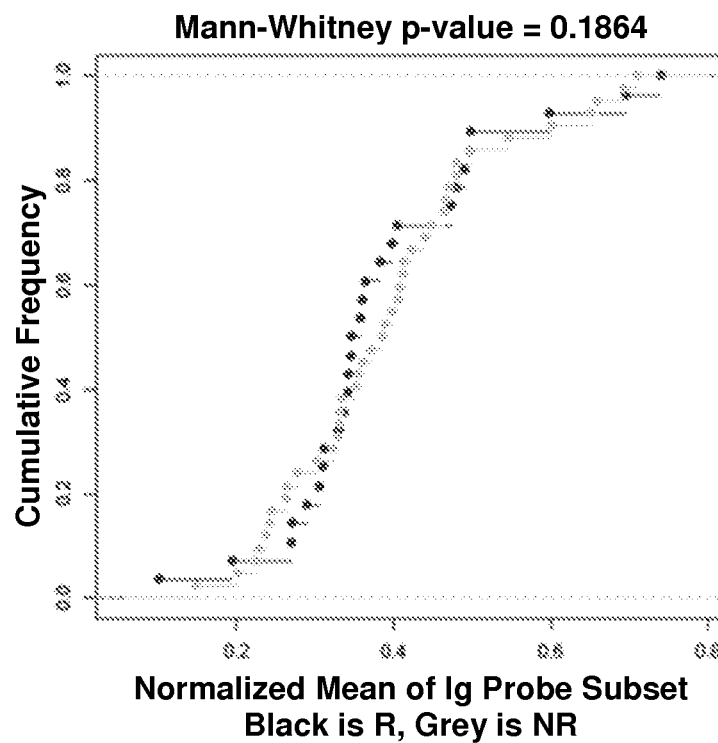

The 13 significantly-associated probes were each normalized to a [0, 1] scale and the mean was computed, yielding our combined Ig expression score. The combined score is very strongly associated with bortezomib response (Wilcoxon P-value=$2\times10^{-4}$; FIGS. 1A and 1B), but exhibits no association with response to dexamethasone (Wilcoxon P-value=0.82; FIGS. 2A and 2B). Patients were classified as achieving complete response (CR), partial response (PR), minimal response (MR), no change (NC), or progressive disease (PD), using European Group for Bone Marrow Transplantation criteria. In brief, PD requires 25% increase in paraprotein, whereas MR, PR, and CR require at least 25%, 50%, and 100% decreases, respectively. Further illustrating the specificity of this marker for predicting PI response, of the 55 Ig probes selected, only one showed an association with dexamethasone response (which is roughly what is expected by chance; Binomial P-value=0.23) and the P-value itself was only marginally significant (Wilcoxon P-value=0.0495).

Various mean IG expression cutoffs were considered to maximize the clinical utility of a potential diagnostic test. Ultimately, a cutoff of 0.29 (defining "IG-High">=0.29 and "IG-Low"<0.29) was chosen, predicting response in the training data with 71% sensitivity and 62% specificity. This same cutoff was then applied to time-to-progression (TTP) data for these patients, finding that IG-High patients in this cohort have a 1.4-fold longer median TTP than IG-Low patients (8.4 months vs. 6.0 months; log-rank P-value=0.025).

Example 2: Carfilzomib Data Analysis

Bone marrow samples were aspirated from patients enrolled on Onyx-sponsored Phase 2 trials (NCT00511238, NCT00530816, and NCT00721734) prior to treatment with single-agent carfilzomib. Myeloma tumor cells were isolated by EasySep® immunomagnetic bead-based CD138+ selection (StemCell Technologies), re-suspended in TRIzol (Life Technologies) and frozen at −80° F. RNA was extracted from these samples with the PureLink RNA kit from Life Technologies (Cat #12183018A), following the recommended protocol for cells in TRIzol suspension, including the optional on-column DNase treatment. Elution volumes ranged from 75 µl-30 µl depending on the total number of cells going into isolation. ERCC control sequences from Life Technologies (ERCC ExFold RNA Spike-In Mix; Cat #4456739) were spiked in to all total RNA samples of sufficient quantity (Nanodrop yield>=150 ng) and quality (Bioanalyzer RIN>=7.0). For 500 ng input libraries, 1 µl of a 1:100 dilution of Mix 1 was added to each total RNA sample and for 150 ng input libraries, 3 µl of a 1:1000 dilution of Mix 1 was added to each total RNA sample. The resulting material was used to construct RNA-Seq libraries with Illumina's TruSeq RNA sample prep kit v2 (Cat #RS-122-2001), with PolyA selection included as the first step. Libraries were sequenced on Illumina's HiSeq 2000 with a target of 70 million fragments using 100×100 bp paired-end sequencing to generate 140 million reads per sample and the resulting raw data was QC-ed with metrics implemented in OmicSoft Array Studio v6.1.

Raw sequence reads were aligned and expression of genes & isoforms were quantified with a customized pipeline also built in Array Studio v6.1 [Jun]. This pipeline accepts Illumina adapter-stripped, paired-end reads that are trimmed at the 5' end if a base reaches PHRED quality score Q2 or lower. All reads are aligned to the transcriptome, which consists of the RefGene annotation of human hg19 supplemented with the more rich Ig loci annotations available from ENSEMBL. Reads aligned with mismatches and unaligned reads are subsequently aligned to the entire human genome, searching for novel exon junctions. Reads that remain unaligned are then aligned to the newly identified exon junctions. Alignments to the different references are compared and the highest scoring alignment is retained, or in the event of a tie, the transcriptome alignment is preferentially kept. Finally, all transcriptome alignment locations are translated to genomic coordinates to estimate the expected number of mappings per gene/isoform using the EM algorithm [Dempster]. The EM algorithm assigns reads with multiple alignment locations to an isoform by calculating the conditional probability of a read aligning to a specific isoform, given all other alignments. Weighting the total number of aligned reads with this probability yields posterior expected read counts for each transcript. The EM counts are normalized by the length of the genes/isoforms and number of reads in a library to yield FPKM values (Fragments Per Kilobase per Million reads). Between-sample normalization is achieved by $75^{th}$ quantile normalization, where each sample is scaled by the median of $75^{th}$ quantiles from all samples to yield quantile-normalized FPKM or "FPKQ" values.

The FPKQ values corresponding to each "gene" of the three Ig loci, IGH (immunoglobulin heavy locus), IGK (immunoglobulin kappa locus) and IGL (immunoglobulin lambda locus), were summed to produce locus-level expression estimates.

For IGH, this included the following genes: IGHA1, IGHA2, IGHD, IGHD1-1, IGHD1-14, IGHD1-20, IGHD1-26, IGHD1-7, IGHD2-15, IGHD2-2, IGHD2-21, IGHD2-8, IGHD3-10, IGHD3-16, IGHD3-22, IGHD3-3, IGHD3-9, IGHD4-11, IGHD4-17, IGHD4-23, IGHD4-4, IGHD5-12, IGHD5-18, IGHD5-24, IGHD5-5, IGHD6-13, IGHD6-19, IGHD6-25, IGHD6-6, IGHD7-27, IGHE, IGHEP1, IGHEP2, IGHG1, IGHG2, IGHG3, IGHG4, IGHGP, IGHJ1, IGHJ1P, IGHJ2, IGHJ2P, IGHJ3, IGHJ3P, IGHJ4, IGHJ5, IGHJ6, IGHM, IGHMBP2, IGHV1-12, IGHV1-14, IGHV1-17, IGHV1-18, IGHV1-2, IGHV1-24, IGHV1-3, IGHV1-45, IGHV1-46, IGHV1-58, IGHV1-67, IGHV1-68, IGHV1-69, IGHV1-8, IGHV1OR21-1, IGHV2-10, IGHV2-26, IGHV2-5, IGHV2-70, IGHV2OR16-5, IGHV3-11, IGHV3-13, IGHV3-15, IGHV3-16, IGHV3-19, IGHV3-20, IGHV3-21, IGHV3-22, IGHV3-23, IGHV3-25, IGHV3-29, IGHV3-30, IGHV3-30-2, IGHV3-32, IGHV3-33, IGHV3-33-2, IGHV3-35, IGHV3-36, IGHV3-37, IGHV3-38, IGHV3-41, IGHV3-42, IGHV3-43, IGHV3-47, IGHV3-48, IGHV3-49, IGHV3-50, IGHV3-52, IGHV3-53, IGHV3-54, IGHV3-57, IGHV3-6, IGHV3-60, IGHV3-62, IGHV3-63, IGHV3-64, IGHV3-65, IGHV3-66, IGHV3-7, IGHV3-71, IGHV3-72, IGHV3-73, IGHV3-74, IGHV3-75, IGHV3-76, IGHV3-79, IGHV3-9, IGHV3OR16-8, IGHV4-28, IGHV4-31, IGHV4-34, IGHV4-39, IGHV4-4, IGHV4-55, IGHV4-59, IGHV4-61, IGHV4-80, IGHV5-51, IGHV5-78, IGHV6-1, IGHV7-27, IGHV7-34-1, IGHV7-40, IGHV7-56, IGHV7-81, IGHVII-1-1, IGHVII-15-1, IGHVII-20-1, IGHVII-22-1, IGHVII-26-2, IGHVII-28-1, IGHVII-30-1, IGHVII-31-1, IGHVII-33-1, IGHVII-40-1, IGHVII-43-1, IGHVII-44-2, IGHVII-46-1, IGHVII-49-1, IGHVII-51-2, IGHVII-53-1, IGHVII-60-1, IGHVII-62-1, IGHVII-65-1, IGHVII-67-1, IGHVII-74-1, IGHVII-78-1, IGHVIII-11-1, IGHVIII-13-1, IGHVIII-16-1, IGHVIII-2-1, IGHVIII-22-2, IGHVIII-25-1, IGHVIII-26-1, IGHVIII-38-1, IGHVIII-44, IGHVIII-47-1, IGHVIII-5-1, IGHVIII-51-1, IGHVIII-5-2, IGHVIII-67-2, IGHVIII-67-3, IGHVIII-67-4, IGHVIII-76-1, IGHVIII-82 and IGHVIV-44-1.

For IGK, this included the following genes: IGKC, IGKJ1, IGKJ2, IGKJ3, IGKJ4, IGKJ5, IGKV1-12, IGKV1-13, IGKV1-16, IGKV1-17, IGKV1-22, IGKV1-27, IGKV1-32, IGKV1-33, IGKV1-35, IGKV1-37, IGKV1-39, IGKV1-5, IGKV1-6, IGKV1-8, IGKV1-9, IGKV1D-12, IGKV1D-13, IGKV1D-16, IGKV1D-17, IGKV1D-22, IGKV1D-27, IGKV1D-32, IGKV1D-33, IGKV1D-35, IGKV1D-37, IGKV1D-39, IGKV1D-42, IGKV1D-43, IGKV1D-8, IGKV1OR22-1, IGKV2-10, IGKV2-14, IGKV2-18, IGKV2-19, IGKV2-23, IGKV2-24, IGKV2-26, IGKV2-28, IGKV2-29, IGKV2-30, IGKV2-36, IGKV2-38, IGKV2-4, IGKV2-40, IGKV2D-10, IGKV2D-14, IGKV2D-18, IGKV2D-19, IGKV2D-23, IGKV2D-24, IGKV2D-26, IGKV2D-28, IGKV2D-29, IGKV2D-30, IGKV2D-36, IGKV2D-38, IGKV2D-40, IGKV2OR22-3, IGKV2OR22-4, IGKV3-11, IGKV3-15, IGKV3-20, IGKV3-25, IGKV3-31, IGKV3-34, IGKV3-7, IGKV3D-11, IGKV3D-15, IGKV3D-20, IGKV3D-25, IGKV3D-31, IGKV3D-34, IGKV3D-7, IGKV3OR22-2, IGKV4-1, IGKV5-2, IGKV6-21, IGKV6D-21, IGKV6D-41, and IGKV7-3.

For IGL, this included the following genes: IGLC1, IGLC2, IGLC3, IGLC4, IGLC5, IGLC6, IGLC7, IGLCOR22-1, IGLJ1, IGLJ2, IGLJ3, IGLJ4, IGLJ5, IGLJ6, IGLJ7, IGLL1, IGLL3, IGLON5, IGLV10-54, IGLV10-67, IGLV11-55, IGLV1-36, IGLV1-40, IGLV1-41, IGLV1-44, IGLV1-47, IGLV1-50, IGLV1-51, IGLV1-62, IGLV2-11, IGLV2-14, IGLV2-18, IGLV2-23, IGLV2-28, IGLV2-33, IGLV2-34, IGLV2-5, IGLV2-8, IGLV3-1, IGLV3-10, IGLV3-12, IGLV3-13, IGLV3-15, IGLV3-16, IGLV3-17, IGLV3-19, IGLV3-2, IGLV3-21, IGLV3-22, IGLV3-24, IGLV3-25, IGLV3-26, IGLV3-27, IGLV3-29, IGLV3-30, IGLV3-31, IGLV3-32, IGLV3-4, IGLV3-6, IGLV3-7, IGLV3-9, IGLV4-3, IGLV4-60, IGLV4-69, IGLV5-37, IGLV5-45, IGLV5-48, IGLV5-52, IGLV6-57, IGLV7-35, IGLV7-43, IGLV7-46, IGLV8-61, IGLV9-49, IGLVI-20, IGLVI-38, IGLVI-42, IGLVI-56, IGLVI-63, IGLVI-68, IGLVI-70, IGLVIV-53, IGLVIV-59, IGLVIV-64, IGLVIV-65, IGLVIV-66-1, IGLVV-58, IGLVV-66, IGLVVI-22-1, IGLVVI-25-1, and IGLVVII-41-1.

Patients with a best overall response of minimal response (MR) or better (i.e., MR, partial response [PR], very good partial response [VGPR] and complete response [CR]) were grouped into a responder category (N=27; abbreviated as "R") and patients with a best overall response of stable disease (SD) or worse (i.e., SD and progressive disease [PD]) were grouped into a non-responder category (N=33; abbreviated as "NR"). Associations between response and expression of IGH, IGK and IGL loci were then tested with the Wilcoxon test, yielding the following results (Table 1):

TABLE 1

| IG Locus | Wilcoxon P-Value |
| --- | --- |
| IGH | 0.003 |
| IGK | 0.49 |
| IGL | 0.05 |
| Max (IGK, IGL) | 0.13 |

Figure 3A:
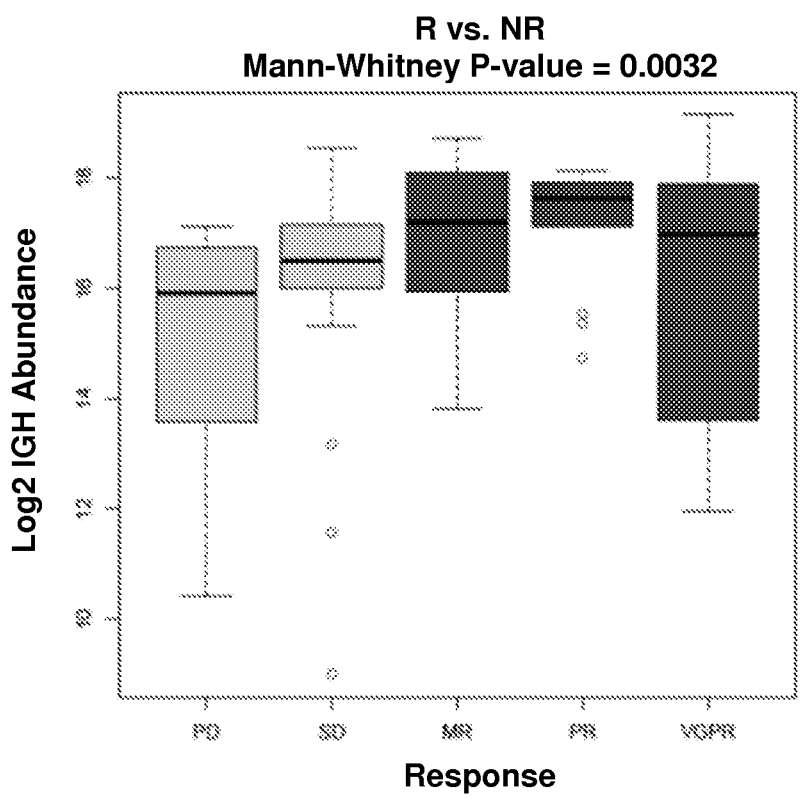
FIGS. 3A and 3B are graphs demonstrating the association between IGH expression and carfilzomib response. PD, progressive disease; stable disease, SD; minimal response, MR; partial response, PR; very good partial response, VGPR.
Figure 3B:
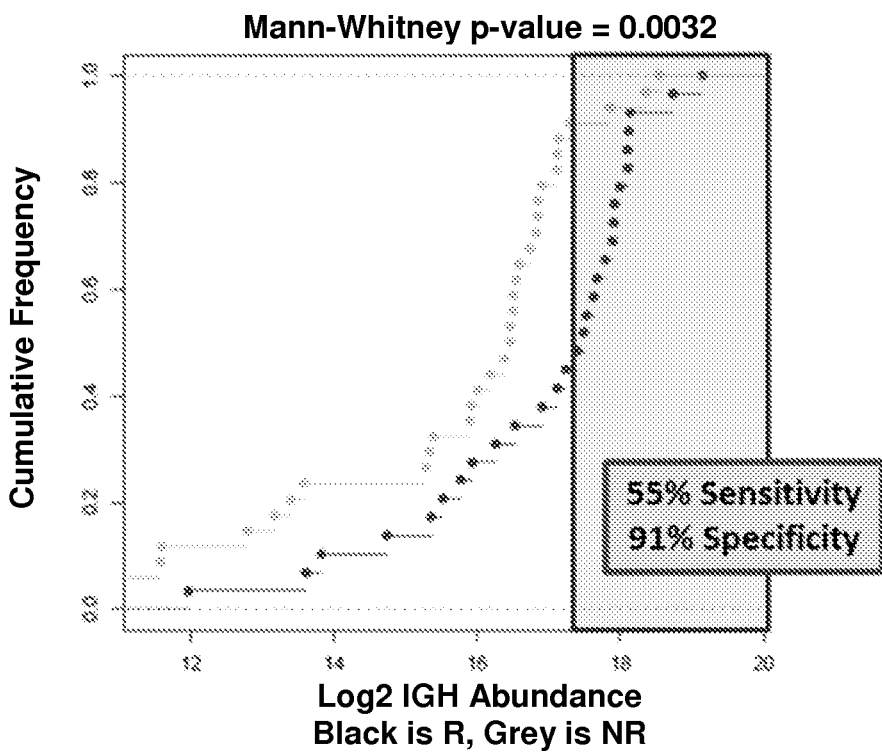
Figure 4:
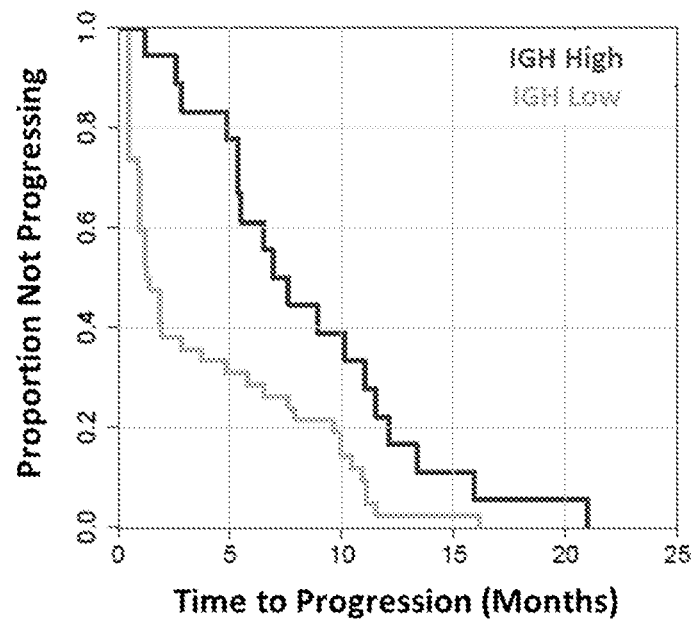
FIG. 4 is a graph demonstrating the time-to-progression (TTP) for IGH-High and IGH-Low patients treated with carfilzomib.

Due to the strength of the association, further analysis focused on IGH expression (FIGS. 3A and 3B). Various IGH locus expression cutoffs were considered and it was ultimately determined that an FPKQ cutoff of 160,000 (defining "IGH-High">=160,000 and "IGH-Low"<160,000) yielded the most clinically useful division the patients, predicting response in our training data with 55% sensitivity and 91% specificity. This same cutoff was then applied to time-to-progression (TTP) data for these patients, finding that IGH-High patients in this cohort have a 5.4-fold longer median TTP than IGH-Low patients (7.3 months vs. 1.3 months; log-rank P-value=0.003; FIG. 4).

To understand, how IG expression changes during treatment with proteasome inhibitors, the data was examined from one patient for which both a screening tumor sample and a sample collected on Cycle 1 Day 2 (C1D2) of treatment with single-agent carfilzomib were available. The results of this analysis are shown in Table 2.

TABLE 2

| | Expression | | |
| --- | --- | --- | --- |
| Gene | Screening | C1D2 | Fold-Change |
| IGHA1 | 4.2E+05 | 1.3E+05 | 3.37 |
| IGHV3-30 | 8.8E+04 | 2.4E+04 | 3.63 |
| IGHV3-33 | 7.7E+04 | 2.1E+04 | 3.77 |
| IGKC | 5.3E+05 | 1.4E+05 | 3.88 |
| ICKV3-20 | 3.9E+05 | 9.6E+04 | 4.11 |

Figure 5:
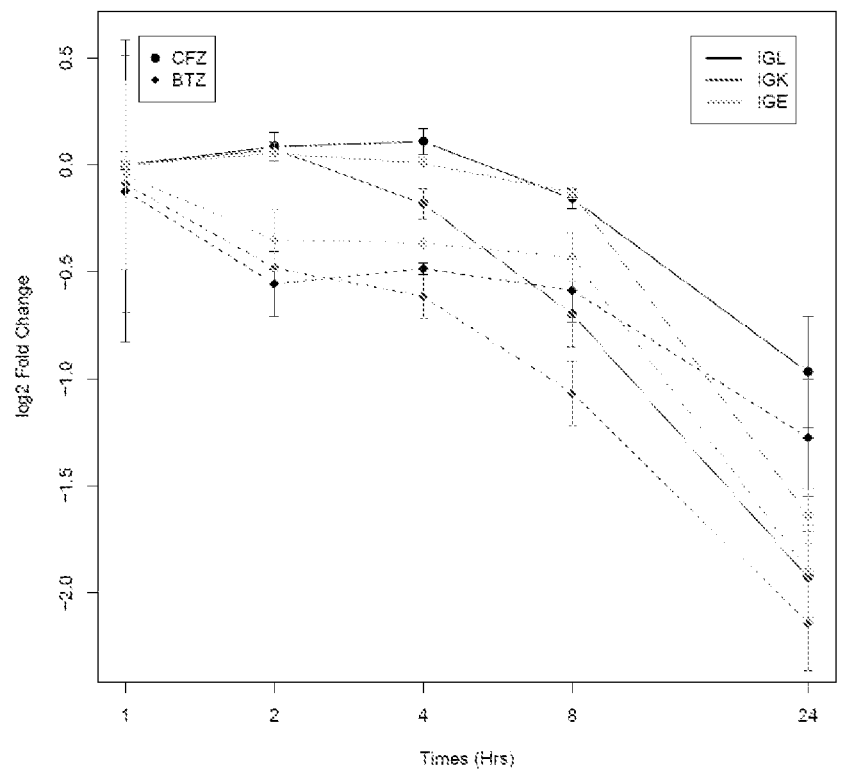
FIG. 5 is graph demonstrating the expression level of IG genes from multiple myeloma cell line (U266) continuously exposed to either bortezomib (BTZ) or carfilzomib (CFZ) for 24 hours.

As demonstrated in Table 2, IG expression is substantially (3- to 4-fold) lower in the sample collected one day after the first dose of carfilzomib. Similarly, RNA-Seq data from a multiple myeloma cell line (U266) continuously exposed to either bortezomib or carfilzomib for 24 hours was examined (FIG. 5). As in the patient samples above, expression of IG genes was substantially (3- to 4-fold) lower following exposure to either bortezomib or carfilzomib for 24 hours, which suggests that IG levels may be a proximal cause of death in cells exposed to proteasome inhibitors.

Figure 6:
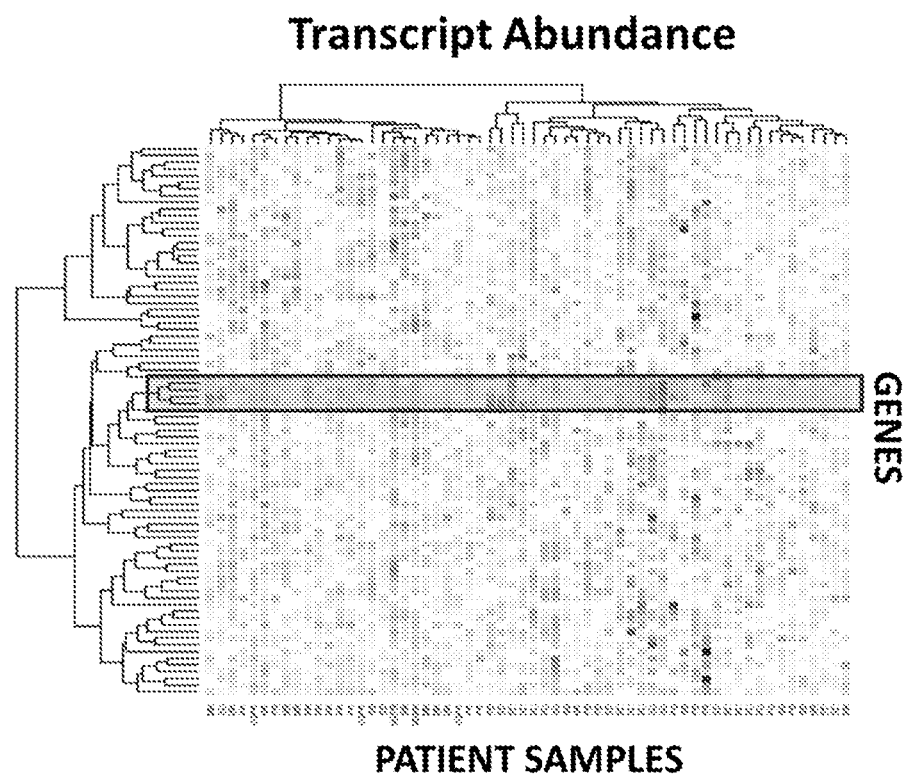
FIG. 6 is graphical representation of the transcriptional profiling data of tumors collected from patients subsequently treated with carfilzomib. Highlighted is a cluster of genes encoding proteins of the Ig structural superfamily, which includes FCGR2B
Figure 7A:
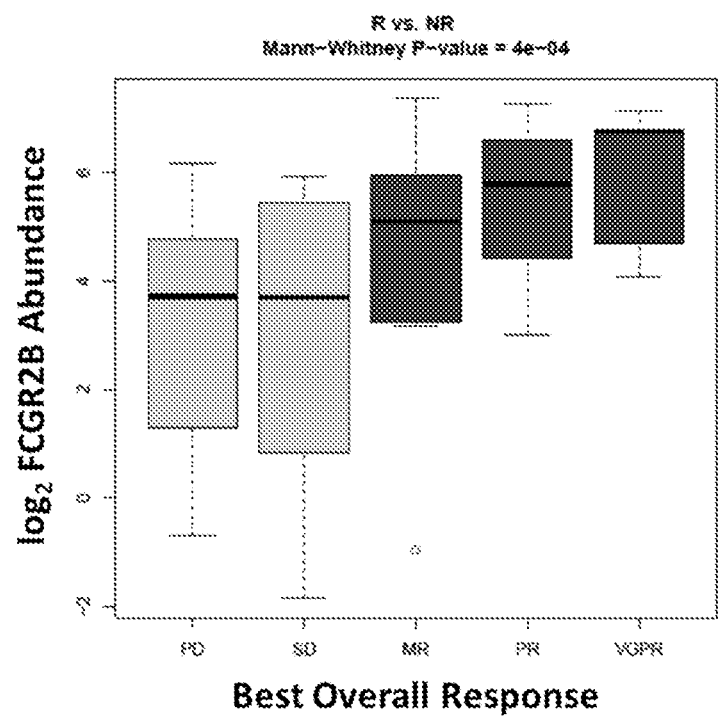
FIGS. 7A and 7B are graphs demonstrating the association between FCGR2b expression and carfilzomib response.
Figure 7B:
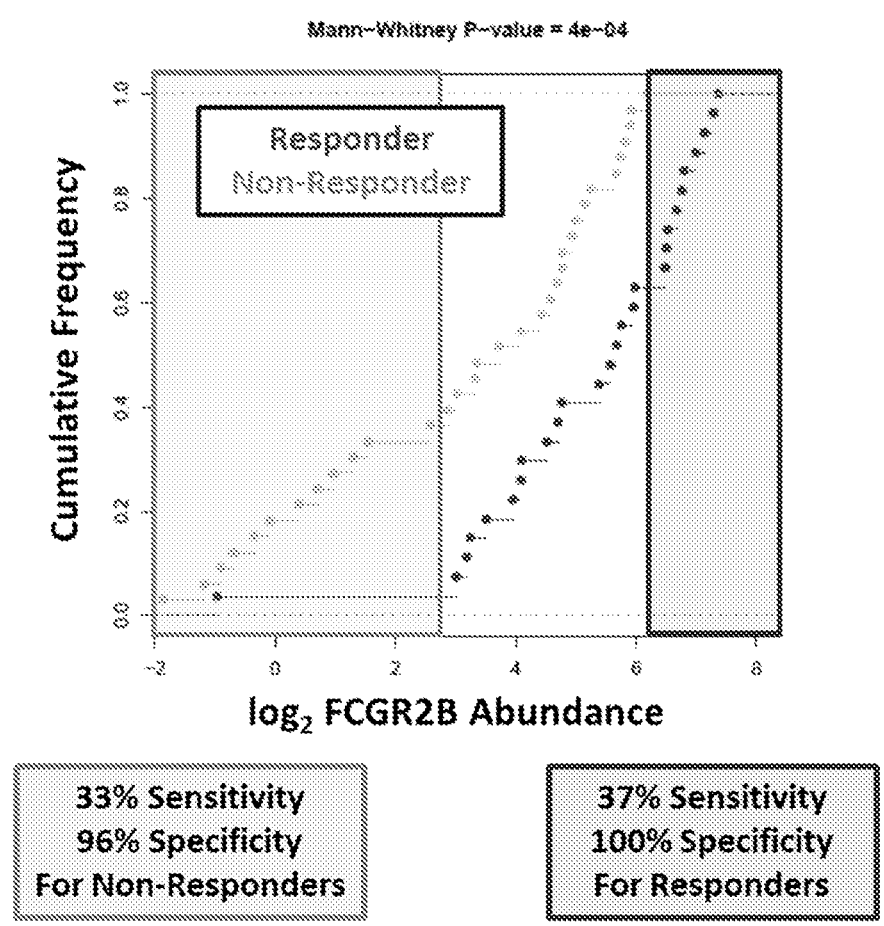

Looking more comprehensively, the inventors found a large set of genes (N=81) with expression that is significantly associated with response to carfilzomib (Wilcoxon P-value<10-3). The set includes an unexpectedly large number of genes encoding Ig folds that emerge as a small correlated cluster (FIG. 6), which implies that this class of proteins sensitizes cells to proteasome inhibition. This further suggests that high expression of immunoglobulin folds may be particularly proteotoxic to cells. A striking gene in this cluster is Fc gamma receptor 2B (FCGR2B), which is a receptor that normally binds Ig and down-modulates Ig production in B cells. Therefore, high FCGR2B expression may demarcate a tumor that is experiencing particularly high levels of proteotoxic stress from Ig production. Because of the close functional relationship between the IGH biomarker and FCGR2B, the inventors considered whether FCGR2B expression is an additional biomarker. The association between FCGR2B and response to carfilzomib (as defined above for IGH) is particularly strong (Wilcoxon P-value=4× 10−4; FIGS. 7A, 7B). Unlike for IGH, for FCGR2B it is apparent that both high and low FPKQ cutoffs are valuable for predicting responder and non-responder categories, respectively. In this case we determined that a high FPKQ cutoff of 75 (defining "FCGR2B-High">=75) and low FPKQ cutoff of 5 (defining "FCGR2B-Low"<5) yielded the most clinically useful division of our patients. The FCGR2B-High cutoff predicts responders in the training data with 37% sensitivity and 100% specificity, while the FCGR2B-Low cutoff predicts non-responders with 33% sensitivity and 96% specificity.

Combining the two FCGR2B cutoffs with a slightly lowered IGH-High cutoff of 140,000, we are able to achieve sensitivity of 70% and specificity of 94% for predicting responders in the training data. Next, these same cutoffs were applied to time-to-progression (TTP) data for these patients, finding that IGH+FCGR2B-Positive patients in this cohort have a 7.3-fold longer median TTP than IGH+ FCGR2B-Negative patients (8.9 months vs. 1.2 months; log-rank P-value=3×10−5; FIG. 8).

Additional cutoffs for each individual biomarker (IGH and FCGR2B) and cutoffs for the combination of the two biomarkers were selected and the sensitivity and specificity for each of these additional cutoffs are listed in Tables 3A and 3B.

TABLE 3A

| Biomarker | Biomarker Cutoff | Sensitivity | Specificity |
|---|---|---|---|
| FCGR2B | 0 | 1 | 0 |
| FCGR2B | 1 | 0.962962963 | 0.151515152 |
| FCGR2B | 2 | 0.962962963 | 0.242424242 |
| FCGR2B | 3 | 0.962962963 | 0.272727273 |
| FCGR2B | 4 | 0.962962963 | 0.333333333 |
| FCGR2B | 7 | 0.962962963 | 0.363636364 |
| FCGR2B | 9 | 0.925925926 | 0.424242424 |
| FCGR2B | 10 | 0.851851852 | 0.424242424 |
| FCGR2B | 20 | 0.703703704 | 0.545454545 |
| FCGR2B | 30 | 0.592592593 | 0.666666667 |
| FCGR2B | 40 | 0.592592593 | 0.787878788 |
| FCGR2B | 50 | 0.481481481 | 0.818181818 |
| FCGR2B | 60 | 0.444444444 | 0.939393939 |
| FCGR2B | 70 | 0.37037037 | 0.96969697 |
| FCGR2B | 80 | 0.37037037 | 1 |
| FCGR2B | 100 | 0.259259259 | 1 |

TABLE 3A-continued

| Biomarker | Biomarker Cutoff | Sensitivity | Specificity |
|---|---|---|---|
| FCGR2B | 150 | 0.074074074 | 1 |
| FCGR2B | 170 | 0 | 1 |
| IGH | 0 | 1 | 0 |
| IGH | 10000 | 0.962962963 | 0.151515152 |
| IGH | 20000 | 0.925925926 | 0.212121212 |
| IGH | 30000 | 0.888888889 | 0.242424242 |
| IGH | 40000 | 0.888888889 | 0.242424242 |
| IGH | 50000 | 0.814814815 | 0.242424242 |
| IGH | 60000 | 0.814814815 | 0.272727273 |
| IGH | 70000 | 0.814814815 | 0.303030303 |
| IGH | 80000 | 0.814814815 | 0.363636364 |
| IGH | 90000 | 0.777777778 | 0.454545455 |
| IGH | 100000 | 0.777777778 | 0.484848485 |
| IGH | 110000 | 0.740740741 | 0.545454545 |
| IGH | 120000 | 0.703703704 | 0.606060606 |
| IGH | 130000 | 0.703703704 | 0.666666667 |
| IGH | 140000 | 0.703703704 | 0.696969697 |
| IGH | 150000 | 0.666666667 | 0.727272727 |
| IGH | 160000 | 0.666666667 | 0.727272727 |
| IGH | 200000 | 0.592592593 | 0.878787879 |
| IGH | 250000 | 0.333333333 | 0.909090909 |
| IGH | 300000 | 0.185185185 | 0.96969697 |
| IGH | 400000 | 0.074074074 | 0.96969697 |
| IGH | 450000 | 0.074074074 | 1 |
| IGH | 500000 | 0 | 1 |

TABLE 3B

| IGH_Cutoff | FCGR2B_low_Cutoff | FCGR2B_high_Cutofff | Sensitivity | Specificty |
|---|---|---|---|---|
| 100000 | 0 | 200 | 0 | 1 |
| 400000 | 100 | 200 | 0.074074074 | 1 |
| 1000000 | 0 | 110 | 0.148148148 | 1 |
| 200000 | 100 | 200 | 0.185185185 | 1 |
| 10000 | 100 | 200 | 0.222222222 | 1 |
| 1000000 | 3 | 110 | 0.259259259 | 1 |
| 150000 | 90 | 300 | 0.296296296 | 1 |
| 90000 | 90 | 500 | 0.333333333 | 1 |
| 1000000 | 2 | 90 | 0.37037037 | 1 |
| 90000 | 70 | 500 | 0.407407407 | 1 |
| 130000 | 50 | 110 | 0.444444444 | 0.96969697 |
| 200000 | 10 | 80 | 0.481481481 | 0.96969697 |
| 150000 | 40 | 90 | 0.518518519 | 0.96969697 |
| 110000 | 40 | 100 | 0.518518519 | 0.939393939 |
| 200000 | 10 | 200 | 0.518518519 | 0.909090909 |
| 200000 | 9 | 200 | 0.555555556 | 0.909090909 |
| 200000 | 8 | 500 | 0.592592593 | 0.909090909 |
| 200000 | 10 | 80 | 0.62962963 | 0.909090909 |
| 200000 | 9 | 90 | 0.666666667 | 0.909090909 |
| 200000 | 3 | 80 | 0.703703704 | 0.909090909 |
| 200000 | 2 | 80 | 0.703703704 | 0.878787879 |
| 200000 | 4 | 60 | 0.703703704 | 0.848484849 |
| 200000 | 0 | 60 | 0.703703704 | 0.818181818 |
| 140000 | 9 | 120 | 0.703703704 | 0.787878788 |
| 140000 | 5 | 80 | 0.777777778 | 0.787878788 |
| 130000 | 5 | 70 | 0.777777778 | 0.757575758 |
| 120000 | 2 | 80 | 0.777777778 | 0.727272727 |
| 200000 | 3 | 40 | 0.814814815 | 0.727272727 |
| 200000 | 0 | 40 | 0.814814815 | 0.696969697 |
| 200000 | 2 | 30 | 0.814814815 | 0.666666667 |
| 80000 | 5 | 70 | 0.814814815 | 0.636363636 |
| 80000 | 8 | 60 | 0.814814815 | 0.606060606 |
| 120000 | 5 | 40 | 0.851851852 | 0.606060606 |
| 100000 | 5 | 40 | 0.851851852 | 0.575757576 |
| 80000 | 4 | 40 | 0.888888889 | 0.575757576 |
| 80000 | 6 | 30 | 0.888888889 | 0.545454546 |
| 30000 | 6 | 110 | 0.888888889 | 0.515151515 |
| 10000 | 9 | 200 | 0.888888889 | 0.484848485 |
| 20000 | 5 | 100 | 0.925925926 | 0.484848485 |
| 40000 | 7 | 30 | 0.925925926 | 0.454545455 |
| 30000 | 3 | 40 | 0.925925926 | 0.424242424 |
| 10000 | 5 | 120 | 0.962962963 | 0.424242424 |
| 60000 | 5 | 10 | 0.962962963 | 0.393939394 |

TABLE 3B-continued

| IGH_Cutoff | FCGR2B_low_Cutoff | FCGR2B_high_Cutofff | Sensitivity | Specificty |
|---|---|---|---|---|
| 140000 | 1 | 10 | 0.962962963 | 0.363636364 |
| 10000 | 2 | 60 | 0.962962963 | 0.333333333 |
| 100000 | 1 | 10 | 0.962962963 | 0.303030303 |
| 10000 | 1 | 100 | 0.962962963 | 0.272727273 |
| 70000 | 1 | 10 | 0.962962963 | 0.242424242 |
| 20000 | 0 | 100 | 0.962962963 | 0.212121212 |
| 20000 | 0 | 50 | 0.962962963 | 0.181818182 |
| 10000 | 0 | 200 | 0.962962963 | 0.151515152 |
| 40000 | 0 | 20 | 0.962962963 | 0.121212121 |
| 60000 | 0 | 10 | 1 | 0.090909091 |
| 90000 | 70 | 0 | 1 | 0 |

The % sensitivity and % specificity values shown in Tables 3A and 3B are datapoints of the response operating characteristic (ROC) curves shown in FIG. 9. FIG. 9 contains additional cutoffs (other than those in Tables 3A and 3B) as well as the corresponding % sensitivity and % specificity for each additional cutoff. The curve in FIG. 9 for IGH and FCGR2B (labeled as "IGH+FCGR2B") allows for one to evaluate different combined cutoffs in terms of % sensitivity and % specificity. The different cutoffs thus provide for a multitude of diagnostic thresholds above which are determinative of a patient's treatment regimen. Cutoffs having the desired % sensitivity/% specificity values are then applied to TTP data.

Example 3: Additional Biomarkers

As discussed in Example 2, a large set of genes demonstrated expression that is significantly associated with patient response to carfilzomib. A table listing this set of genes is set forth herein as Table 4. Table 4 includes, for each gene: (i) the HUGO gene symbol, if available, (ii) the Ensembl Gene Name, (iii) gene expression level data, and (iv) statistical data: the P-value and Q-value.

TABLE 4

| HUGO Gene Symbol | Ensembl Gene Name | log2 (R/NR) | Δ gene expression level | P-value | Q-value |
|---|---|---|---|---|---|
| ABI2 | ENSG00000138443 | 0.58949304 | up | 0.001738 | 0.1271 |
| AC004381.6 | ENSG00000005189 | -1.204670581 | down | 0.000103 | 0.090927 |
| AC005076.5 | ENSG00000224046 | -0.653150315 | down | 0.002953 | 0.154081 |
| AC005104.3 | ENSG00000223374 | 0.765035153 | up | 0.006398 | 0.199433 |
| AC005943.5 | ENSG00000267161 | -1.004306556 | down | 0.003757 | 0.167074 |
| AC006378.2 | ENSG00000236861 | 0.923095301 | up | 0.00163 | 0.125963 |
| AC007246.3 | ENSG00000231312 | 0.507143559 | up | 0.001835 | 0.1271 |
| AC007381.3 | ENSG00000228590 | 1.794650455 | up | 0.001471 | 0.125963 |
| AC007386.2 | ENSG00000237638 | 1.314108591 | up | 0.001551 | 0.125963 |
| AC009005.2 | ENSG00000267751 | -1.012595637 | down | 0.003809 | 0.167074 |
| AC108488.3 | ENSG00000234171 | -0.530514717 | down | 0.005379 | 0.185044 |
| ACAT2 | ENSG00000120437 | -0.691367312 | down | 0.001474 | 0.125963 |
| ACOT7 | ENSG00000097021 | -1.127585567 | down | 0.006514 | 0.199433 |
| ACYP1 | ENSG00000119640 | -0.679663744 | down | 0.001835 | 0.1271 |
| ADCK1 | ENSG00000063761 | -0.429549728 | down | 0.004209 | 0.174124 |
| ADIRF | ENSG00000148671 | 1.068032417 | up | 0.005074 | 0.182007 |
| AGMAT | ENSG00000116771 | -1.902702799 | down | 0.004209 | 0.174124 |
| AKAP9 | ENSG00000127914 | 0.578033255 | up | 0.005379 | 0.185044 |
| ALCAM | ENSG00000170017 | 1.998126961 | up | 1.29E-05 | 0.067115 |
| ALDH4A1 | ENSG00000159423 | -0.887790496 | down | 0.00488 | 0.180898 |
| AMDHD2 | ENSG00000162066 | -0.533471154 | down | 0.001937 | 0.129464 |
| AMH | ENSG00000104899 | -1.185346863 | down | 0.005212 | 0.184691 |
| ANKRD20A3 | ENSG00000132498 | 2.350221687 | up | 0.000209 | 0.090927 |
| ANKRD20A4 | ENSG00000172014 | 2.863800069 | up | 0.004287 | 0.175935 |
| ANKRD20A5P | ENSG00000186481 | 1.556593095 | up | 0.000788 | 0.112803 |
| ANLN | ENSG00000011426 | -1.397930353 | down | 0.000939 | 0.11973 |
| ANTXR1 | ENSG00000169604 | 2.166414183 | up | 0.004533 | 0.179635 |
| APH1B | ENSG00000138613 | 0.516819563 | up | 0.006212 | 0.196883 |
| APOBEC3H | ENSG00000100298 | -1.351138348 | down | 0.000744 | 0.112803 |
| ARHGAP11A | ENSG00000198826 | -0.655219921 | down | 0.006212 | 0.196883 |
| ARHGAP23 | ENSG00000225485 | 0.522801324 | up | 0.004647 | 0.179635 |
| ARHGAP31-AS1 | ENSG00000241155 | 0.652112201 | up | 0.000254 | 0.090927 |
| ARL8B | ENSG00000134108 | 0.292126417 | up | 0.003809 | 0.167074 |
| ARMC5 | ENSG00000140691 | -0.323867652 | down | 0.001474 | 0.125963 |
| ASB1 | ENSG00000065802 | -0.417067595 | down | 9.32E-06 | 0.067115 |
| ASF1B | ENSG00000105011 | -0.792494369 | down | 0.003622 | 0.165504 |
| ASPDH | ENSG00000204653 | 1.13291303 | up | 0.002752 | 0.149035 |
| ASPH | ENSG00000198363 | 0.552936064 | up | 0.006514 | 0.199433 |
| ATAD5 | ENSG00000176208 | -0.926161416 | down | 0.002804 | 0.149035 |
| ATG4A | ENSG00000101844 | 0.454441032 | up | 0.001474 | 0.125963 |
| ATP2C1 | ENSG00000017260 | 0.414259932 | up | 0.002044 | 0.13169 |

TABLE 4-continued

| HUGO Gene Symbol | Ensembl Gene Name | log2 (R/NR) | Δ gene expression level | P-value | Q-value |
|---|---|---|---|---|---|
| ATXN7L2 | ENSG00000162650 | −0.602432936 | down | 0.001947 | 0.12962 |
| AUNIP | ENSG00000127423 | −1.420068922 | down | 0.002804 | 0.149035 |
| B2M | ENSG00000166710 | 0.438515982 | up | 0.003272 | 0.160028 |
| B4GALT4 | ENSG00000121578 | 0.499817339 | up | 0.005922 | 0.194138 |
| BAHD1 | ENSG00000140320 | 0.521294292 | up | 0.001319 | 0.125963 |
| BBX | ENSG00000114439 | 0.442989973 | up | 0.001835 | 0.1271 |
| BCAR3 | ENSG00000137936 | 1.528931715 | up | 0.001937 | 0.129464 |
| BET1L | ENSG00000177951 | 0.544159583 | up | 0.004423 | 0.177259 |
| BEX2 | ENSG00000133134 | 1.389224675 | up | 0.001053 | 0.125345 |
| BIK | ENSG00000100290 | 0.790115837 | up | 0.002156 | 0.135243 |
| BIRC5 | ENSG00000089685 | −1.476698726 | down | 0.002526 | 0.144291 |
| BMPR1A | ENSG00000107779 | 1.417631639 | up | 0.002526 | 0.144291 |
| BRCA1 | ENSG00000012048 | −1.220603695 | down | 0.001179 | 0.125345 |
| BTD | ENSG00000169814 | 0.7332119 | up | 0.001474 | 0.125963 |
| BTLA | ENSG00000186265 | 1.270519458 | up | 0.002526 | 0.144291 |
| C12orf23 | ENSG00000151135 | 0.47094641 | up | 0.003809 | 0.167074 |
| C14orf80 | ENSG00000185347 | −0.701479303 | down | 0.000552 | 0.1043 |
| C16orf59 | ENSG00000162062 | −1.158684113 | down | 0.000622 | 0.106442 |
| C17orf53 | ENSG00000125319 | −0.565512324 | down | 0.006514 | 0.199433 |
| C19orf12 | ENSG00000131943 | 0.739111952 | up | 0.000135 | 0.090927 |
| C19orf40 | ENSG00000131944 | −0.636229388 | down | 0.002397 | 0.140035 |
| C1orf112 | ENSG00000000460 | −0.903350952 | down | 0.001835 | 0.1271 |
| C1orf132 | ENSG00000203709 | 0.77824824 | up | 0.005124 | 0.182007 |
| C22orf26 | ENSG00000182257 | −1.201787593 | down | 0.001295 | 0.125963 |
| C3orf17 | ENSG00000163608 | 0.355702903 | up | 0.001937 | 0.129464 |
| C3orf37 | ENSG00000183624 | 0.568954382 | up | 0.001319 | 0.125963 |
| CACNB1 | ENSG00000067191 | −1.119138756 | down | 0.004647 | 0.179635 |
| CAMK2B | ENSG00000058404 | 1.080919995 | up | 0.001079 | 0.125345 |
| CAPN15 | ENSG00000103326 | −0.314834712 | down | 0.003272 | 0.160028 |
| CAPN7 | ENSG00000131375 | 0.429443198 | up | 0.000661 | 0.106442 |
| CARHSP1 | ENSG00000153048 | −0.497561027 | down | 0.000661 | 0.106442 |
| CASC4 | ENSG00000166734 | 0.636516042 | up | 0.002044 | 0.13169 |
| CBX7 | ENSG00000100307 | 0.589142024 | up | 0.002804 | 0.149035 |
| CCDC101 | ENSG00000176476 | −0.295016908 | down | 0.004005 | 0.170766 |
| CCDC103 | ENSG00000167131 | −1.302299288 | down | 0.001137 | 0.125345 |
| CCDC137 | ENSG00000185298 | −0.344295242 | down | 0.001646 | 0.125963 |
| CCDC144CP | ENSG00000154898 | 1.94825361 | up | 0.001319 | 0.125963 |
| CCDC18 | ENSG00000122483 | −0.661657101 | down | 0.001835 | 0.1271 |
| CCDC34 | ENSG00000109881 | −1.207485494 | down | 0.001395 | 0.125963 |
| CCHCR1 | ENSG00000204536 | −0.487115512 | down | 0.005713 | 0.1918 |
| CCNA2 | ENSG00000145386 | −1.518792258 | down | 0.001937 | 0.129464 |
| CCNF | ENSG00000162063 | −0.797996486 | down | 0.000245 | 0.090927 |
| CCPG1 | ENSG00000260916 | 0.805364603 | up | 0.002044 | 0.13169 |
| CD200 | ENSG00000091972 | 2.296546672 | up | 0.000382 | 0.097757 |
| CD276 | ENSG00000103855 | 2.23215983 | up | 0.000202 | 0.090927 |
| CD46 | ENSG00000117335 | 0.535055566 | up | 0.005124 | 0.182007 |
| CD47 | ENSG00000196776 | 0.418206401 | up | 0.002397 | 0.140035 |
| CDC25B | ENSG00000101224 | −0.626962109 | down | 0.002397 | 0.140035 |
| CDC45 | ENSG00000093009 | −1.488486593 | down | 0.00488 | 0.180898 |
| CDC7 | ENSG00000097046 | −0.703380887 | down | 0.00488 | 0.180898 |
| CDCA2 | ENSG00000184661 | −1.693705194 | down | 0.005124 | 0.182007 |
| CDCA4 | ENSG00000170779 | −0.934167192 | down | 0.000279 | 0.092728 |
| CDCA7L | ENSG00000164649 | −0.90401625 | down | 0.003109 | 0.157059 |
| CDCA8 | ENSG00000134690 | −1.131192478 | down | 0.001474 | 0.125963 |
| CDKN3 | ENSG00000100526 | −0.866129394 | down | 0.003109 | 0.157059 |
| CDT1 | ENSG00000167513 | −1.509518103 | down | 0.000788 | 0.112803 |
| CENPC | ENSG00000145241 | 0.477584435 | up | 0.005379 | 0.185044 |
| CENPH | ENSG00000153044 | −1.059152551 | down | 0.006212 | 0.196883 |
| CENPL | ENSG00000120334 | −0.689597294 | down | 0.003622 | 0.165504 |
| CENPW | ENSG00000203760 | −1.336241011 | down | 8.35E−05 | 0.090927 |
| CEP250 | ENSG00000126001 | −0.533656922 | down | 0.001646 | 0.125963 |
| CEP55 | ENSG00000138180 | −1.336985816 | down | 0.004423 | 0.177259 |
| CEP78 | ENSG00000148019 | −0.713457762 | down | 6.76E−05 | 0.086188 |
| CFLAR-AS1 | ENSG00000226312 | 0.787576615 | up | 0.001474 | 0.125963 |
| CHAF1A | ENSG00000167670 | −0.516246117 | down | 0.001646 | 0.125963 |
| CHAF1B | ENSG00000159259 | −1.117439741 | down | 0.000155 | 0.090927 |
| CHTF18 | ENSG00000127586 | −0.923356052 | down | 6.21E−05 | 0.086188 |
| CIT | ENSG00000122966 | −1.008818794 | down | 0.001179 | 0.125345 |
| CLIC2 | ENSG00000155962 | 2.236011571 | up | 0.000245 | 0.090927 |
| CLIC5 | ENSG00000112782 | 1.869491174 | up | 0.001806 | 0.1271 |
| CLPTM1 | ENSG00000104853 | 0.466267313 | up | 0.000788 | 0.112803 |
| CLSPN | ENSG00000092853 | −1.383198126 | down | 0.000788 | 0.112803 |
| CNTN1 | ENSG00000018236 | 2.897399147 | up | 0.002156 | 0.135243 |
| COPZ2 | ENSG00000005243 | 2.563354592 | up | 0.000135 | 0.090927 |
| CRBN | ENSG00000113851 | 0.479237667 | up | 0.003809 | 0.167074 |
| CREB3L2 | ENSG00000182158 | 1.297905196 | up | 9.60E−05 | 0.090927 |

TABLE 4-continued

| HUGO Gene Symbol | Ensembl Gene Name | log2 (R/NR) | Δ gene expression level | P-value | Q-value |
|---|---|---|---|---|---|
| CRELD2 | ENSG00000184164 | 0.431307815 | up | 0.004209 | 0.174124 |
| CRYBG3 | ENSG00000080200 | 0.744498557 | up | 0.001319 | 0.125963 |
| CRYBG3 | ENSG00000233280 | 1.330532021 | up | 0.000519 | 0.103273 |
| CSPG4P11 | ENSG00000259726 | 1.650979674 | up | 0.000849 | 0.118158 |
| CSPG4P12 | ENSG00000259295 | 1.31746016 | up | 0.000744 | 0.112803 |
| CTD-2013N24.2 | ENSG00000244513 | 0.416073076 | up | 0.004647 | 0.179635 |
| CTD-2545G14.7 | ENSG00000262526 | 1.864150843 | up | 0.001937 | 0.129464 |
| CTD-2574D22.2 | ENSG00000247735 | −1.395823366 | down | 0.003752 | 0.167074 |
| CTIF | ENSG00000134030 | 0.507094853 | up | 0.006212 | 0.196883 |
| CTNNA1 | ENSG00000044115 | 0.445702107 | up | 0.000177 | 0.090927 |
| CXorf40B | ENSG00000197021 | 0.343593674 | up | 0.001558 | 0.125963 |
| CXXC5 | ENSG00000171604 | 0.520417324 | up | 0.005379 | 0.185044 |
| CYFIP1 | ENSG00000068793 | 0.603707882 | up | 0.001179 | 0.125345 |
| CYP4F35P | ENSG00000265787 | 2.131597155 | up | 0.001551 | 0.125963 |
| DAGLB | ENSG00000164535 | −0.338981228 | down | 0.003443 | 0.164705 |
| DBF4B | ENSG00000161692 | −0.536907475 | down | 0.00488 | 0.180898 |
| DBI | ENSG00000155368 | 0.437631696 | up | 0.003272 | 0.160028 |
| DCK | ENSG00000156136 | −0.710740223 | down | 0.002397 | 0.140035 |
| DDX42 | ENSG00000198231 | 0.208628409 | up | 0.002044 | 0.13169 |
| DEPDC1 | ENSG00000024526 | −1.138548661 | down | 0.002953 | 0.154081 |
| DERL1 | ENSG00000136986 | 0.629070039 | up | 0.000622 | 0.106442 |
| DERL3 | ENSG00000099958 | 0.87425742 | up | 0.000552 | 0.1043 |
| DGKI | ENSG00000157680 | 1.522742848 | up | 0.004528 | 0.179635 |
| DHFR | ENSG00000228716 | −0.596887056 | down | 0.001474 | 0.125963 |
| DLG1 | ENSG00000075711 | 0.720945313 | up | 0.003272 | 0.160028 |
| DLGAP5 | ENSG00000126787 | −1.781943562 | down | 0.002526 | 0.144291 |
| DNAJB9 | ENSG00000128590 | 0.762742522 | up | 0.000215 | 0.090927 |
| DNAJC1 | ENSG00000136770 | 0.851198135 | up | 0.003622 | 0.165504 |
| DNASE1L3 | ENSG00000163687 | 1.150573975 | up | 0.003411 | 0.164705 |
| DNMT1 | ENSG00000130816 | −0.401905618 | down | 0.001474 | 0.125963 |
| DOT1L | ENSG00000104885 | −0.440849834 | down | 0.001474 | 0.125963 |
| DQX1 | ENSG00000144045 | −1.58805775 | down | 0.005822 | 0.194138 |
| DST | ENSG00000151914 | 1.119680181 | up | 0.00488 | 0.180898 |
| DTL | ENSG00000143476 | −0.571087426 | down | 0.005458 | 0.187352 |
| DTYMK | ENSG00000168393 | −0.672857439 | down | 0.001835 | 0.1271 |
| DVL3 | ENSG00000161202 | 0.480840184 | up | 0.000622 | 0.106442 |
| E2F1 | ENSG00000101412 | −0.713005902 | down | 0.003809 | 0.167074 |
| E2F8 | ENSG00000129173 | −1.822880964 | down | 0.004647 | 0.179635 |
| ECHDC2 | ENSG00000121310 | 0.80675917 | up | 0.001319 | 0.125963 |
| EFCAB11 | ENSG00000140025 | −0.83951759 | down | 0.000316 | 0.09315 |
| EIF2AK4 | ENSG00000128829 | 0.889621607 | up | 0.004005 | 0.170766 |
| EIF2B5 | ENSG00000145191 | 0.52014902 | up | 0.001179 | 0.125345 |
| EMC7 | ENSG00000134153 | 0.527652572 | up | 0.002156 | 0.135243 |
| ENDOU | ENSG00000111405 | 0.996677877 | up | 0.000764 | 0.112803 |
| EPDR1 | ENSG00000086289 | 1.355276772 | up | 0.003109 | 0.157059 |
| EPM2AIP1 | ENSG00000178567 | 0.832768018 | up | 0.000622 | 0.106442 |
| ERBB2 | ENSG00000141736 | −0.520928902 | down | 0.000939 | 0.11973 |
| ERI1 | ENSG00000104626 | −0.601791404 | down | 0.000245 | 0.090927 |
| ESCO2 | ENSG00000171320 | −1.5468643 | down | 0.006514 | 0.199433 |
| ESPL1 | ENSG00000135476 | −0.932485167 | down | 0.003622 | 0.165504 |
| ETV5 | ENSG00000244405 | 0.880406053 | up | 0.001738 | 0.1271 |
| FAM114A1 | ENSG00000197712 | 0.986415082 | up | 0.00046 | 0.097757 |
| FAM174A | ENSG00000174132 | 0.851426172 | up | 0.005124 | 0.182007 |
| FAM219A | ENSG00000164970 | 0.431957782 | up | 0.001474 | 0.125963 |
| FAM64A | ENSG00000129195 | −1.675400995 | down | 0.000432 | 0.097757 |
| FAM72B | ENSG00000188610 | −0.874624959 | down | 0.000261 | 0.090927 |
| FAM83D | ENSG00000101447 | −0.996366514 | down | 0.000203 | 0.090927 |
| FAM95B1 | ENSG00000223839 | 1.618293895 | up | 0.004209 | 0.174124 |
| FANCA | ENSG00000187741 | −0.802052008 | down | 0.000406 | 0.097757 |
| FANCB | ENSG00000181544 | −0.733853593 | down | 0.001137 | 0.125345 |
| FBLN2 | ENSG00000163520 | 4.055675182 | up | 0.002318 | 0.139712 |
| FBXL15 | ENSG00000107872 | 0.347540494 | up | 0.00488 | 0.180898 |
| FCF1 | ENSG00000119616 | −0.367208753 | down | 0.000432 | 0.097757 |
| FCGR2B | ENSG00000072694 | 1.7069366 | up | 0.000552 | 0.1043 |
| FCGR2C | ENSG00000244682 | 1.833667492 | up | 0.001937 | 0.129464 |
| FCRL5 | ENSG00000143297 | 1.284877883 | up | 0.001179 | 0.125345 |
| FCRLA | ENSG00000132185 | 3.193292318 | up | 8.96E−05 | 0.090927 |
| FGFR1OP | ENSG00000213066 | −0.491542609 | down | 0.003272 | 0.160028 |
| FOXM1 | ENSG00000111206 | −1.131740677 | down | 0.004332 | 0.176822 |
| FUS | ENSG00000089280 | −0.352688172 | down | 0.000261 | 0.090927 |
| FXYD5 | ENSG00000089327 | 0.875760601 | up | 0.001646 | 0.125963 |
| FXYD7 | ENSG00000221946 | 1.006169767 | up | 0.003585 | 0.165504 |
| GALE | ENSG00000117308 | −0.542602271 | down | 0.002953 | 0.154081 |

TABLE 4-continued

| HUGO Gene Symbol | Ensembl Gene Name | log2 (R/NR) | Δ gene expression level | P-value | Q-value |
|---|---|---|---|---|---|
| GBF1 | ENSG00000107862 | 0.476441929 | up | 0.000279 | 0.092728 |
| GINS2 | ENSG00000131153 | −0.805724953 | down | 0.003809 | 0.167074 |
| GINS4 | ENSG00000147536 | −0.996858828 | down | 0.000661 | 0.106442 |
| GLMN | ENSG00000174842 | −0.690322855 | down | 0.001247 | 0.125963 |
| GMEB1 | ENSG00000162419 | −0.25590121 | down | 0.004423 | 0.177259 |
| GNG7 | ENSG00000176533 | 0.927431553 | up | 0.004209 | 0.174124 |
| GOLGA4 | ENSG00000144674 | 0.386722654 | up | 0.004005 | 0.170766 |
| GOLGA6L4 | ENSG00000184206 | 0.812716533 | up | 0.000189 | 0.090927 |
| GPBP1 | ENSG00000062194 | 0.242730418 | up | 0.006514 | 0.199433 |
| GPR176 | ENSG00000166073 | 2.035062721 | up | 0.001114 | 0.125345 |
| GPRASP1 | ENSG00000198932 | 1.071771461 | up | 0.003443 | 0.164705 |
| GPSM2 | ENSG00000121957 | −0.885489534 | down | 6.29E−05 | 0.086188 |
| GRIP1 | ENSG00000155974 | 1.231430795 | up | 0.004231 | 0.174124 |
| GSG2 | ENSG00000177602 | −1.394544327 | down | 0.000406 | 0.097757 |
| GTF2I | ENSG00000077809 | 0.40001011 | up | 0.000886 | 0.118955 |
| HAUS4 | ENSG00000092036 | −0.602117697 | down | 0.002397 | 0.140035 |
| HDAC9 | ENSG00000048052 | 0.684068321 | up | 0.001646 | 0.125963 |
| HELLS | ENSG00000119969 | −0.623431519 | down | 0.001558 | 0.125963 |
| HENMT1 | ENSG00000162639 | −0.624504013 | down | 0.001474 | 0.125963 |
| HERPUD1 | ENSG00000051108 | 0.778585363 | up | 0.001646 | 0.125963 |
| HLA-DOB | ENSG00000241106 | 1.443362687 | up | 3.51E−05 | 0.067115 |
| HMGB1P5 | ENSG00000132967 | −0.489741805 | down | 0.005645 | 0.190341 |
| HMGN2 | ENSG00000198830 | −0.343343082 | down | 0.004647 | 0.179635 |
| HNRNPCP1 | ENSG00000258900 | −0.953716452 | down | 0.004743 | 0.180898 |
| HSDL2 | ENSG00000119471 | −0.610519971 | down | 0.006212 | 0.196883 |
| ICAM5 | ENSG00000105376 | −1.044794924 | down | 0.004209 | 0.174124 |
| IDUA | ENSG00000127415 | 0.955710969 | up | 0.001646 | 0.125963 |
| IFT20 | ENSG00000109083 | 0.302770683 | up | 0.003109 | 0.157059 |
| ITPRIPL1 | ENSG00000198885 | −2.2280116 | down | 0.000586 | 0.106442 |
| ITSN1 | ENSG00000205726 | 0.905232008 | up | 0.002804 | 0.149035 |
| KATNA1 | ENSG00000186625 | −0.391521115 | down | 0.001179 | 0.125345 |
| KCNAB1 | ENSG00000169282 | 1.001128869 | up | 0.000359 | 0.097757 |
| KCNAB3 | ENSG00000170049 | −1.056336096 | down | 0.002273 | 0.138647 |
| KIAA0226 | ENSG00000145016 | 0.617682853 | up | 0.002953 | 0.154081 |
| KIAA0586 | ENSG00000100578 | −0.431753645 | down | 0.006212 | 0.196883 |
| KIAA1147 | ENSG00000257093 | 0.482751184 | up | 0.006514 | 0.199433 |
| KIAA1522 | ENSG00000162522 | 1.035387539 | up | 0.005124 | 0.182007 |
| KIAA1731 | ENSG00000166004 | −0.469427264 | down | 0.000788 | 0.112803 |
| KIF14 | ENSG00000118193 | −1.705333985 | down | 0.001474 | 0.125963 |
| KIF18A | ENSG00000121621 | −0.692732773 | down | 0.001179 | 0.125345 |
| KIF20B | ENSG00000138182 | −0.628519438 | down | 0.001053 | 0.125345 |
| KIF2C | ENSG00000142945 | −1.365646338 | down | 0.000432 | 0.097757 |
| KIF4A | ENSG00000090889 | −1.904610649 | down | 0.003622 | 0.165504 |
| KMT2C | ENSG00000055609 | 0.228004365 | up | 0.005645 | 0.190341 |
| KPNB1 | ENSG00000108424 | −0.394700087 | down | 0.001835 | 0.1271 |
| L2HGDH | ENSG00000087299 | −0.921327169 | down | 0.000836 | 0.117391 |
| LAMTOR5-AS1 | ENSG00000224699 | −0.981944468 | down | 0.002047 | 0.13169 |
| LINC00337 | ENSG00000225077 | −1.120082576 | down | 0.005676 | 0.19098 |
| LINC00662 | ENSG00000261824 | 0.773101729 | up | 0.005922 | 0.194138 |
| LINC00883 | ENSG00000243701 | 0.810773121 | up | 0.004005 | 0.170766 |
| LMF1 | ENSG00000103227 | 0.814937221 | up | 0.000622 | 0.106442 |
| LPCAT3 | ENSG00000111684 | −0.559209562 | down | 0.004005 | 0.170766 |
| LRRC4B | ENSG00000131409 | 0.793959329 | up | 0.004213 | 0.174124 |
| LRRN2 | ENSG00000170382 | 1.865843931 | up | 0.005922 | 0.194138 |
| MAGED2 | ENSG00000102316 | 0.720903224 | up | 0.001179 | 0.125345 |
| MAP4 | ENSG00000047849 | 0.724838313 | up | 0.002662 | 0.147631 |
| MAP4K3 | ENSG00000011566 | 0.589878912 | up | 0.004209 | 0.174124 |
| MAPRE3 | ENSG00000084764 | 0.784298761 | up | 0.000261 | 0.090927 |
| MBD4 | ENSG00000129071 | 0.276423792 | up | 0.000788 | 0.112803 |
| MCM10 | ENSG00000065328 | −1.334114767 | down | 0.001674 | 0.1271 |
| MCM2 | ENSG00000073111 | −1.247745579 | down | 0.001474 | 0.125963 |
| MCM4 | ENSG00000104738 | −0.927747184 | down | 0.001646 | 0.125963 |
| MEF2A | ENSG00000068305 | 0.506720645 | up | 0.000744 | 0.112803 |
| MEI1 | ENSG00000167077 | 1.179961962 | up | 0.000118 | 0.090927 |
| MEMO1 | ENSG00000162959 | −0.281226311 | down | 0.004209 | 0.174124 |
| MFN1 | ENSG00000171109 | 0.332545316 | up | 0.006212 | 0.196883 |
| MGAT1 | ENSG00000131446 | 0.290644604 | up | 0.006514 | 0.199433 |
| MGME1 | ENSG00000125871 | −0.433132545 | down | 0.003809 | 0.167074 |
| MGST3 | ENSG00000143198 | 0.659094058 | up | 0.005124 | 0.182007 |
| MICA | ENSG00000204520 | 0.620119411 | up | 0.000939 | 0.11973 |
| MID2 | ENSG00000080561 | 0.756163973 | up | 0.005645 | 0.190341 |
| MIR4435-1HG | ENSG00000172965 | −1.062297175 | down | 0.00488 | 0.180898 |
| MKX | ENSG00000150051 | 2.704795186 | up | 0.000382 | 0.097757 |
| MLF1IP | ENSG00000151725 | −0.868339353 | down | 0.005645 | 0.190341 |
| MMRN2 | ENSG00000173269 | 1.180392072 | up | 0.002662 | 0.147631 |

TABLE 4-continued

| HUGO Gene Symbol | Ensembl Gene Name | log2 (R/NR) | Δ gene expression level | P-value | Q-value |
|---|---|---|---|---|---|
| MOXD1 | ENSG00000079931 | 1.559687372 | up | 0.004647 | 0.179635 |
| MRAS | ENSG00000158186 | 1.52251306 | up | 0.00488 | 0.180898 |
| MSH2 | ENSG00000095002 | −1.009515534 | down | 0.006514 | 0.199433 |
| MTFR2 | ENSG00000146410 | −0.846036223 | down | 0.000489 | 0.099767 |
| MXD4 | ENSG00000123933 | 0.515542459 | up | 0.004423 | 0.177259 |
| MYBL2 | ENSG00000101057 | −1.035211825 | down | 0.001247 | 0.125963 |
| MYEF2 | ENSG00000104177 | 1.112353906 | up | 0.005124 | 0.182007 |
| MZB1 | ENSG00000170476 | 0.965983178 | up | 0.002662 | 0.147631 |
| NAA30 | ENSG00000139977 | −0.341182009 | down | 0.002662 | 0.147631 |
| NBEA | ENSG00000172915 | 1.297503689 | up | 0.005124 | 0.182007 |
| NCAPH | ENSG00000121152 | −1.60849361 | down | 0.005379 | 0.185044 |
| NDFIP1 | ENSG00000131507 | 0.620791298 | up | 0.000202 | 0.090927 |
| NDUFA3 | ENSG00000170906 | 0.577079384 | up | 0.002662 | 0.147631 |
| NEDD4L | ENSG00000049759 | 1.124026207 | up | 0.001247 | 0.125963 |
| NOL12 | ENSG00000256872 | −0.5896443 | down | 0.00046 | 0.097757 |
| NPRL3 | ENSG00000103148 | −0.392961317 | down | 0.00046 | 0.097757 |
| NR1D2 | ENSG00000174738 | 0.455919632 | up | 0.003622 | 0.165504 |
| NR3C1 | ENSG00000113580 | 0.731585314 | up | 0.005124 | 0.182007 |
| NSUN5 | ENSG00000130305 | −0.478595971 | down | 0.00488 | 0.180898 |
| NUDT1 | ENSG00000106268 | −0.852740182 | down | 0.000155 | 0.090927 |
| NUF2 | ENSG00000143228 | −1.103956787 | down | 0.001558 | 0.125963 |
| NXPE4 | ENSG00000137634 | 4.468868564 | up | 0.003745 | 0.167074 |
| OIP5 | ENSG00000104147 | −1.202560379 | down | 0.00488 | 0.180898 |
| ORC1 | ENSG00000085840 | −1.065526966 | down | 0.001835 | 0.1271 |
| P4HTM | ENSG00000178467 | 0.696412296 | up | 0.003272 | 0.160028 |
| PAIP2B | ENSG00000124374 | 0.608423558 | up | 0.003443 | 0.164705 |
| PAM | ENSG00000145730 | 0.736380555 | up | 0.001835 | 0.1271 |
| PAQR4 | ENSG00000162073 | −1.249506432 | down | 0.000316 | 0.09315 |
| PARL | ENSG00000175193 | 0.385732857 | up | 0.000519 | 0.103273 |
| PARPBP | ENSG00000185480 | −1.127390341 | down | 0.001319 | 0.125963 |
| PATZ1 | ENSG00000100105 | −0.613716272 | down | 0.002044 | 0.13169 |
| PC | ENSG00000173599 | −2.196281547 | down | 0.001835 | 0.1271 |
| PCBP3 | ENSG00000183570 | 1.620969616 | up | 0.001558 | 0.125963 |
| PCBP4 | ENSG00000090097 | 1.027008279 | up | 1.76E−05 | 0.067115 |
| PCDHB10 | ENSG00000120324 | 1.367015984 | up | 0.002959 | 0.154081 |
| PCDHB16 | ENSG00000196963 | 2.272079546 | up | 0.001461 | 0.125963 |
| PCDHB9 | ENSG00000177839 | 1.659119974 | up | 0.000156 | 0.090927 |
| PCDHGA10 | ENSG00000253846 | 1.761871736 | up | 0.001852 | 0.12771 |
| PCYT1A | ENSG00000161217 | 0.388019625 | up | 0.006514 | 0.199433 |
| PDCD1LG2 | ENSG00000197646 | 1.007150591 | up | 0.005645 | 0.190341 |
| PDE6G | ENSG00000185527 | −2.06520501 | down | 0.001474 | 0.125963 |
| PDE8A | ENSG00000073417 | 0.898071797 | up | 0.000661 | 0.106442 |
| PDIA3 | ENSG00000167004 | 0.599823335 | up | 8.96E−05 | 0.090927 |
| PDXDC2P | ENSG00000196696 | 0.390023823 | up | 0.002156 | 0.135243 |
| PDZK1IP1 | ENSG00000162366 | 2.059953642 | up | 0.005845 | 0.194138 |
| PFN2 | ENSG00000070087 | 1.726786978 | up | 0.002804 | 0.149035 |
| PGP | ENSG00000184207 | −0.394712174 | down | 0.001738 | 0.1271 |
| PHF19 | ENSG00000119403 | −0.59874177 | down | 0.000432 | 0.097757 |
| PKMYT1 | ENSG00000127564 | −1.403609452 | down | 0.001937 | 0.129464 |
| PLCB4 | ENSG00000101333 | 1.358514715 | up | 0.006212 | 0.196883 |
| PLK1 | ENSG00000166851 | −0.980915772 | down | 0.002804 | 0.149035 |
| PLK4 | ENSG00000142731 | −0.863342434 | down | 0.000215 | 0.090927 |
| POLA2 | ENSG00000014138 | −0.356587586 | down | 0.005645 | 0.190341 |
| POLD3 | ENSG00000077514 | −0.649754527 | down | 3.02E−05 | 0.067115 |
| PON2 | ENSG00000105854 | 1.064018977 | up | 3.25E−05 | 0.067115 |
| POPDC2 | ENSG00000121577 | 0.507108724 | up | 0.004647 | 0.179635 |
| POU2F2 | ENSG00000028277 | 0.829755089 | up | 0.001319 | 0.125963 |
| PPFIBP2 | ENSG00000166387 | 0.701578337 | up | 0.004209 | 0.174124 |
| PPIB | ENSG00000166794 | 0.480516293 | up | 0.002804 | 0.149035 |
| PPID | ENSG00000171497 | −0.266755933 | down | 0.002804 | 0.149035 |
| PPIP5K1 | ENSG00000168781 | 0.808884722 | up | 0.000939 | 0.11973 |
| PPP1R16B | ENSG00000101445 | −1.201260806 | down | 0.003809 | 0.167074 |
| PRIM1 | ENSG00000198056 | −0.995746296 | down | 0.000297 | 0.092779 |
| PRKAA1 | ENSG00000132356 | 0.401998563 | up | 0.001738 | 0.1271 |
| PRKAR1B | ENSG00000188191 | −0.660679976 | down | 0.002397 | 0.140035 |
| PRKCA | ENSG00000154229 | 1.369576279 | up | 0.001474 | 0.125963 |
| PSENEN | ENSG00000205155 | 0.368704282 | up | 0.002662 | 0.147631 |
| PTHLH | ENSG00000087494 | 2.864363043 | up | 0.000427 | 0.097757 |
| PTPRM | ENSG00000173482 | 1.799116837 | up | 0.003443 | 0.164705 |
| RAB3B | ENSG00000169213 | 1.817774395 | up | 0.005124 | 0.182007 |
| RABAC1 | ENSG00000105404 | 0.682722137 | up | 0.004005 | 0.170476 |
| RAC3 | ENSG00000169750 | −0.783424905 | down | 0.00488 | 0.180898 |
| RAD18 | ENSG00000070950 | −0.388012916 | down | 0.005922 | 0.194138 |
| RAD51B | ENSG00000182185 | −0.647226192 | down | 0.004866 | 0.180898 |
| RAPGEF3 | ENSG00000079337 | 1.460778486 | up | 0.001835 | 0.1271 |
| RASGRP3 | ENSG00000152689 | 1.361593186 | up | 0.000886 | 0.118955 |

TABLE 4-continued

| HUGO Gene Symbol | Ensembl Gene Name | log2 (R/NR) | Δ gene expression level | P-value | Q-value |
|---|---|---|---|---|---|
| RBBP8 | ENSG00000101773 | −0.420670803 | down | 0.006514 | 0.199433 |
| RBKS | ENSG00000171174 | −0.607072797 | down | 0.002273 | 0.138647 |
| RBL1 | ENSG00000080839 | −0.651514248 | down | 0.003109 | 0.157059 |
| RECQL4 | ENSG00000160957 | −1.055176871 | down | 0.002273 | 0.138647 |
| REEP5 | ENSG00000129625 | 0.483198621 | up | 0.00046 | 0.097757 |
| RFC3 | ENSG00000133119 | −0.845003493 | down | 0.005379 | 0.185044 |
| RFC5 | ENSG00000111445 | −0.488787867 | down | 0.002804 | 0.149035 |
| RHOQ | ENSG00000119729 | 0.981684777 | up | 0.001319 | 0.125963 |
| RIC3 | ENSG00000166405 | 2.061495289 | up | 0.000622 | 0.106442 |
| RMDN3 | ENSG00000137824 | 0.687762803 | up | 0.000661 | 0.106442 |
| RMI2 | ENSG00000175643 | −1.105998037 | down | 0.000701 | 0.111769 |
| RNASEH2A | ENSG00000104889 | −0.588788676 | down | 0.003272 | 0.160028 |
| RNF13 | ENSG00000082996 | 0.430500699 | up | 0.000406 | 0.097757 |
| RNF168 | ENSG00000163961 | 0.789370661 | up | 0.001835 | 0.1271 |
| RP11-110I1.12 | ENSG00000255121 | −1.089180897 | down | 0.001053 | 0.125345 |
| RP11-1277A3.1 | ENSG00000247679 | 0.494691737 | up | 0.005124 | 0.182007 |
| RP11-145F16.2 | ENSG00000261050 | 1 | up | 0.001558 | 0.125963 |
| RP11-22P6.3 | ENSG00000260442 | −1.218957746 | down | 0.000305 | 0.09315 |
| RP11-23N2.4 | ENSG00000260600 | 0.599669898 | up | 0.006212 | 0.196883 |
| RP11-295D4.1 | ENSG00000262712 | −0.543310808 | down | 0.004227 | 0.174124 |
| RP11-382J12.1 | ENSG00000246366 | 0.476637496 | up | 0.005645 | 0.190341 |
| RP11-386G11.10 | ENSG00000258017 | −0.732892348 | down | 0.002273 | 0.138647 |
| RP11-417F21.1 | ENSG00000250116 | 0.874469118 | up | 0.002044 | 0.13169 |
| RP11-680G24.5 | ENSG00000260872 | 0.813273679 | up | 0.001646 | 0.125963 |
| RP11-690I21.1 | ENSG00000237641 | 0.982445377 | up | 0.001045 | 0.125345 |
| RP11-81H14.2 | ENSG00000251301 | 1.154574974 | up | 0.002273 | 0.138647 |
| RP1-290I10.6 | ENSG00000229950 | 1.515905482 | up | 0.006057 | 0.196883 |
| RP3-412A9.11 | ENSG00000198832 | 1.332016018 | up | 5.86E−05 | 0.086188 |
| RP4-742C19.8 | ENSG00000233899 | 0.631077104 | up | 0.002526 | 0.144291 |
| RPL7AP10 | ENSG00000240522 | −1.230279468 | down | 0.002679 | 0.148063 |
| RPN1 | ENSG00000163902 | 0.384107056 | up | 0.003622 | 0.165504 |
| RPS11P5 | ENSG00000232888 | 0.666696911 | up | 0.004645 | 0.179635 |
| RSPH3 | ENSG00000130363 | −0.543360762 | down | 0.005922 | 0.194138 |
| RTKN | ENSG00000114993 | 0.84231452 | up | 0.002273 | 0.138647 |
| RTN4IP1 | ENSG00000130347 | −0.635965627 | down | 0.004005 | 0.170766 |
| S100Z | ENSG00000171643 | 1.755116374 | up | 0.000586 | 0.106442 |
| SAPCD1 | ENSG00000228727 | −0.731740287 | down | 0.006514 | 0.199433 |
| SAPCD2 | ENSG00000186193 | −1.176135844 | down | 0.005922 | 0.194138 |
| SASS6 | ENSG00000156876 | −0.232149316 | down | 0.005124 | 0.182007 |
| SBNO1 | ENSG00000139697 | −0.315910334 | down | 0.003622 | 0.165504 |
| SCAMP5 | ENSG00000198794 | 0.861087469 | up | 0.000836 | 0.117391 |
| SDHAP1 | ENSG00000185485 | 0.572219514 | up | 0.000489 | 0.099767 |
| SDHAP3 | ENSG00000185986 | −0.83746263 | down | 0.006514 | 0.199433 |
| SEC13 | ENSG00000157020 | 0.55661178 | up | 0.001053 | 0.125345 |
| SEC22C | ENSG00000093183 | 0.355646837 | up | 0.001738 | 0.1271 |
| SEC61A1 | ENSG00000058262 | 0.610846513 | up | 0.000886 | 0.118955 |
| SEC62 | ENSG00000008952 | 0.788131385 | up | 0.00011 | 0.090927 |
| SELK | ENSG00000113811 | 0.619756413 | up | 0.000432 | 0.097757 |
| SENP2 | ENSG00000163904 | 0.491242791 | up | 0.002273 | 0.138647 |
| SERP1 | ENSG00000120742 | 0.427941701 | up | 0.000886 | 0.118955 |
| SERPINI1 | ENSG00000163536 | 1.401734038 | up | 0.004423 | 0.177259 |
| SGOL1 | ENSG00000129810 | −1.315415063 | down | 0.001179 | 0.125345 |
| SGOL2 | ENSG00000163535 | −1.04754504 | down | 0.005379 | 0.185044 |
| SH3BP5-AS1 | ENSG00000224660 | 0.61664396 | up | 0.000489 | 0.099767 |
| SH3PXD2A | ENSG00000107957 | 0.855689288 | up | 0.000441 | 0.097757 |
| SHCBP1 | ENSG00000171241 | −0.653402279 | down | 0.005379 | 0.185044 |
| SHMT1 | ENSG00000176974 | −0.916266061 | down | 0.005379 | 0.185044 |
| SIT1 | ENSG00000137078 | 1.491042511 | up | 0.003622 | 0.165504 |
| SKA1 | ENSG00000154839 | −1.388698342 | down | 0.002156 | 0.135243 |
| SKA3 | ENSG00000165480 | −1.49596618 | down | 0.001179 | 0.125345 |
| SLAMF1 | ENSG00000117090 | 2.637174504 | up | 0.000552 | 0.1043 |
| SLC22A5 | ENSG00000197375 | 0.364043198 | up | 0.005379 | 0.185044 |
| SLC29A2 | ENSG00000174669 | −2.117487943 | down | 0.003109 | 0.157059 |
| SLC35B1 | ENSG00000121073 | 0.54289746 | up | 0.001558 | 0.125963 |
| SLC35G2 | ENSG00000168917 | 2.36121245 | up | 0.000417 | 0.097757 |
| SLC51A | ENSG00000163959 | 0.619956943 | up | 0.003272 | 0.160028 |
| SLIT1 | ENSG00000187122 | 2.454001823 | up | 0.005971 | 0.195061 |
| SLX4 | ENSG00000188827 | −0.309372634 | down | 0.005922 | 0.194138 |
| SMPD1 | ENSG00000166311 | 0.685554031 | up | 0.003622 | 0.165504 |
| SOGA3 | ENSG00000214338 | 2.141127737 | up | 0.004321 | 0.176822 |
| SOWAHB | ENSG00000186212 | 2.27080955 | up | 0.001624 | 0.125963 |

TABLE 4-continued

| HUGO Gene Symbol | Ensembl Gene Name | log2 (R/NR) | Δ gene expression level | P-value | Q-value |
|---|---|---|---|---|---|
| SOX5 | ENSG00000134532 | 1.658450619 | up | 0.003578 | 0.165504 |
| SRGAP3 | ENSG00000196220 | 1.029665782 | up | 0.000215 | 0.090927 |
| SRI | ENSG00000075142 | 0.37152875 | up | 0.000744 | 0.112803 |
| SSR3 | ENSG00000114850 | 0.4896736 | up | 0.001319 | 0.125963 |
| ST6GAL1 | ENSG00000073849 | 0.766044282 | up | 0.000939 | 0.11973 |
| ST8SIA4 | ENSG00000113532 | 0.850904988 | up | 0.001247 | 0.125963 |
| STARD4 | ENSG00000164211 | 0.367759238 | up | 0.006212 | 0.196883 |
| STARD5 | ENSG00000172345 | 0.709779447 | up | 0.003272 | 0.160028 |
| STIL | ENSG00000123473 | −0.577961832 | down | 0.003622 | 0.165504 |
| STMN1 | ENSG00000117632 | −0.958006821 | down | 0.005124 | 0.182007 |
| TANC2 | ENSG00000170921 | 2.470345102 | up | 0.004645 | 0.179635 |
| TBC1D31 | ENSG00000156787 | −0.55473257 | down | 0.005379 | 0.185044 |
| TBL3 | ENSG00000183751 | −0.371607611 | down | 0.00488 | 0.180898 |
| TCEAL3 | ENSG00000196507 | 1.039621308 | up | 0.000215 | 0.090927 |
| TCF12 | ENSG00000140262 | 0.573433117 | up | 0.003272 | 0.160028 |
| TCHP | ENSG00000139437 | −0.394692495 | down | 0.006212 | 0.196883 |
| TEX19 | ENSG00000182459 | −1.232891533 | down | 0.005548 | 0.189988 |
| TEX30 | ENSG00000151287 | −0.741242721 | down | 0.000997 | 0.125345 |
| TFG | ENSG00000114354 | 0.52087412 | up | 0.004647 | 0.179635 |
| THOC6 | ENSG00000131652 | −0.412866319 | down | 0.000261 | 0.090927 |
| TICAM2 | ENSG00000243414 | 0.757722382 | up | 0.002044 | 0.13169 |
| TIMELESS | ENSG00000111602 | −0.624056848 | down | 0.000661 | 0.106442 |
| TK1 | ENSG00000167900 | −1.120895213 | down | 0.002804 | 0.149035 |
| TMCO6 | ENSG00000113119 | −0.446075861 | down | 0.002662 | 0.147631 |
| TMED7 | ENSG00000134970 | 0.506103886 | up | 0.006514 | 0.199433 |
| TMEM108 | ENSG00000144868 | 1.262393672 | up | 0.005335 | 0.185044 |
| TMEM115 | ENSG00000126062 | 0.360490115 | up | 0.001179 | 0.125345 |
| TMEM150A | ENSG00000168890 | 0.292194 | up | 0.006514 | 0.199433 |
| TMEM243 | ENSG00000135185 | 0.771028169 | up | 0.005379 | 0.185044 |
| TMEM50B | ENSG00000142188 | 0.479584127 | up | 0.003443 | 0.164705 |
| TMEM57 | ENSG00000204178 | 0.382913174 | up | 0.005124 | 0.182007 |
| TMEM63C | ENSG00000165548 | 2.463768871 | up | 0.002526 | 0.144291 |
| TMOD2 | ENSG00000128872 | 1.778485679 | up | 0.006212 | 0.196883 |
| TMPO-AS1 | ENSG00000257167 | −0.726697259 | down | 0.003851 | 0.168443 |
| TPX2 | ENSG00000088325 | −1.221950415 | down | 0.003809 | 0.167074 |
| TRGV5 | ENSG00000211697 | 0.933839652 | up | 0.004528 | 0.179635 |
| TRIM52 | ENSG00000183718 | 0.558151646 | up | 0.004209 | 0.174124 |
| TROAP | ENSG00000135451 | −1.70863633 | down | 0.000297 | 0.092779 |
| TSKU | ENSG00000182704 | 1.51653736 | up | 0.005976 | 0.195061 |
| TSPAN3 | ENSG00000140391 | 0.841070593 | up | 0.002156 | 0.135243 |
| TTC17 | ENSG00000052841 | 0.342525973 | up | 0.003622 | 0.165504 |
| TTK | ENSG00000112742 | −0.988321296 | down | 0.003109 | 0.157059 |
| TTLL5 | ENSG00000119685 | −0.327071817 | down | 0.000406 | 0.097757 |
| TUB | ENSG00000166402 | 1.767676597 | up | 0.002317 | 0.139712 |
| TUBA1B | ENSG00000123416 | −0.538417101 | down | 0.001646 | 0.125963 |
| TXNDC15 | ENSG00000113621 | 0.575328234 | up | 0.003809 | 0.167074 |
| TXNDC5 | ENSG00000239264 | 0.756015355 | up | 0.003443 | 0.164705 |
| TYMS | ENSG00000176890 | −1.081232402 | down | 0.002397 | 0.140035 |
| UBA7 | ENSG00000182179 | 0.856044718 | up | 0.001395 | 0.125963 |
| UBE2C | ENSG00000175063 | −1.269467358 | down | 0.001179 | 0.125345 |
| UBE2E2 | ENSG00000182247 | 0.870140435 | up | 2.40E−05 | 0.067115 |
| UBXN4 | ENSG00000144224 | 0.38181031 | up | 0.006514 | 0.199433 |
| UHRF1 | ENSG00000034063 | −1.469473531 | down | 0.001738 | 0.1271 |
| USP32P3 | ENSG00000189423 | 3.195455286 | up | 0.001473 | 0.125963 |
| VAPB | ENSG00000124164 | −0.257533585 | down | 0.004423 | 0.177259 |
| VIMP | ENSG00000131871 | 0.687773457 | up | 0.003809 | 0.167074 |
| VPS37D | ENSG00000176428 | 1.550120285 | up | 0.005095 | 0.182007 |
| WASL | ENSG00000106299 | 0.492658686 | up | 0.004647 | 0.179635 |
| WBP5 | ENSG00000185222 | 1.50717312 | up | 0.000297 | 0.092779 |
| WDHD1 | ENSG00000198554 | −1.152433926 | down | 0.001632 | 0.125963 |
| WDR62 | ENSG00000075702 | −1.166051204 | down | 0.000245 | 0.090927 |
| WEE1 | ENSG00000166483 | −1.043540913 | down | 0.000359 | 0.097757 |
| XRCC2 | ENSG00000196584 | −0.775604531 | down | 0.005922 | 0.194138 |
| XRCC3 | ENSG00000126215 | −0.655292946 | down | 0.000939 | 0.11973 |
| YIPF2 | ENSG00000130733 | 0.686984318 | up | 0.003109 | 0.157059 |
| ZBTB4 | ENSG00000174282 | 0.59662837 | up | 0.005124 | 0.182007 |
| ZC2HC1A | ENSG00000104427 | 0.629482721 | up | 0.003622 | 0.165504 |
| ZGLP1 | ENSG00000220201 | −0.463720366 | down | 0.005124 | 0.182007 |
| ZHX1-C8ORF76 | ENSG00000259305 | 0.431039293 | up | 0.001835 | 0.1271 |
| ZMAT3 | ENSG00000172667 | 0.647710648 | up | 0.002397 | 0.140035 |
| ZNF101 | ENSG00000181896 | −0.605225083 | down | 0.001474 | 0.125963 |
| ZNF14 | ENSG00000105708 | −0.800698079 | down | 0.002662 | 0.147631 |
| ZNF204P | ENSG00000204789 | 3.260061269 | up | 0.002317 | 0.139712 |
| ZNF358 | ENSG00000198816 | 0.767920473 | up | 0.003109 | 0.157059 |
| ZNF565 | ENSG00000196357 | 0.615820899 | up | 0.005922 | 0.194138 |

TABLE 4-continued

| HUGO Gene Symbol | Ensembl Gene Name | log2 (R/NR) | Δ gene expression level | P-value | Q-value |
|---|---|---|---|---|---|
| ZNF609 | ENSG00000180357 | 0.312449173 | up | 0.001114 | 0.125345 |
| ZNF706 | ENSG00000120963 | 0.465206779 | up | 0.004005 | 0.170766 |
| ZNF738 | ENSG00000172687 | −1.270195442 | down | 0.006256 | 0.197853 |
| ZNF827 | ENSG00000151612 | 0.722894271 | up | 0.006212 | 0.196883 |
| ZNF829 | ENSG00000185869 | −1.490325627 | down | 0.001114 | 0.125345 |
| ZNF852 | ENSG00000178917 | 0.526992277 | up | 0.00488 | 0.180898 |
| ZNF880 | ENSG00000221923 | −2.04089136 | down | 0.004423 | 0.177259 |
| ZNF93 | ENSG00000184635 | −1.691498564 | down | 0.003943 | 0.170766 |
| Not available | ENSG00000233488 | −1.126553625 | down | 1.76E−05 | 0.067115 |
| Not available | ENSG00000259850 | 0.317164674 | up | 0.00488 | 0.180898 |
| Not available | ENSG00000165406 | 0.486776476 | up | 0.000135 | 0.090927 |
| Not available | ENSG00000233165 | 1.051483435 | up | 0.00488 | 0.180898 |
| Not available | ENSG00000266348 | 1.615869627 | up | 0.002819 | 0.149305 |

Log2 (R/NR), gene expression level of responders relative (R) to non-responders (NR). The terms "responder" and "non-responder" used in this example have the same meanings as those in Example 2.
Δ Gene expression level indicates the change in gene expression level of responders (R) relative to non-responders (NR); "up" means that the gene expression level was upregulated in R vs. NR and "down" means that the gene expression level was downregulated in R vs. NR.
Not available, HUGO gene name is not available.

Expression data was determined as essentially described in Example 2. Associations between response and expression of the indicated gene were tested with the Wilcoxon test yielding the P values indicated in Table 4. Q was determined as essentially described in Storey and Tibshirani, "Statistical significance for genome-wide experiments, *Proceedings of the National Academy of Sciences* 100:9440-9445 (2003).

Genes demonstrating strength of association between expression and response to carfilzomib are further analyzed by considering different expression cutoffs. An ROC curve for each gene is made so that each cutoff may be evaluated in terms of % specificity and % sensitivity. The cutoff is then applied to time-to-progression (TTP) data for the patients and clinical relevance is considered.

Example 4: Validation Studies

The analysis of bone marrow samples from carfilzomib (CFZ) Phase 2 clinical studies has shown that high IGH and FCGR2B [0] gene expression levels are predictive of response to the proteasome inhibitor carfilzomib in relapsed and refractory multiple myeloma patients [1]. Bone marrow samples from the carfilzomib Phase 3 clinical studies are analyzed to confirm these analysis results. Additionally, it is determined whether high IGH and FCGR2B gene expression levels are predictive of response to other therapeutic regimens such as corticosteroids plus optional cyclophosphamide (best supportive care; BSC) in patients with relapsed and refractory multiple myeloma and lenalidomide plus dexamethasone (Rd) in patients with multiple myeloma who have received one to three prior lines of therapy.

RNA sequencing data from CD138+ selected bone marrow samples from the carfilzomib Phase 3 clinical studies are analyzed with the goal of confirming that high IGH and/or FCGR2B gene expression levels are predictive of response to the proteasome inhibitor CFZ and not predictive of response to other therapeutic regimens, such as corticosteroids plus optional cyclophosphamide (BSC) and lenalidomide plus dexamethasone (Rd). At the time of patient screening during the trials, bone marrow samples were collected and aspirated. These samples were used to obtain RNA sequencing data. RNA sequencing of these samples are performed at the Translational Genomics Research Institute (TGen).

The RNA samples are divided across the trial arms as follows: There were a total of 192 samples collected as part of the Phase 3 trial from patients treated either with CFZ or according to best supportive care (BSC) that were successfully sequenced. There were 424 samples collected as part of the Phase 3 trial from patients treated either with CFZ, lenalidomide, and dexamethasone (CRd) or with lenalidomide and dexamethasone (Rd) that were successfully sequenced.

Raw sequence reads are aligned and expression of genes and isoforms are quantified with a customized pipeline built in Array Studio v6.1. This pipeline [3] accepts Illumina adapter stripped, paired-end reads that are trimmed at the 5' end if a base reaches PHRED quality score Q2 or lower. All reads are mapped to the transcriptome, as defined by the Ensembl annotation R.70 [4]. Reads mapped with mismatches and unmapped reads are subsequently aligned to the entire human genome, searching for novel exon junctions. Mappings of a particular read pairs to the genome and transcriptome are compared and the highest scoring mapping is kept, with transcriptome mappings preferred in the case of a tie. Reads that remain unmapped at this point are aligned against the newly identified exon junctions. Finally, all transcriptome mapping locations are translated to genomic coordinates to estimate the expected number of mappings using the EM algorithm [5]. The EM algorithm assigns reads with multiple mapping locations to a transcript isoform by calculating the conditional probability of a read mapping to a specific isoform, given all other mappings. Weighting the total number of mapped reads with this probability yields posterior expected read counts for the transcript. The EM counts are normalized by the length of the genes and number of reads in a library to yield FPKM values (Fragments Per Kilobase per Million reads). An additional normalization, referred to as quantile normalization, is applied to correct for biases introduced by the presence of one or two dominant transcripts (e.g., IGH, IGK, & IGL) in many of the samples. In the quantile normalization step each FPKM value in a sample is scaled by the 85th percentile FPKM value of that same sample to yield quantile normalized FPKM, referred to as FPKQ values.

IGH consists of many separately annotated genes in the ENSEMBL annotation. Therefore, estimates of IGH expression are calculated by summing the corresponding FPKQ of each gene of the IGH locus (cf. U.S. Patent No. 61/863,809 'Immunoglobulin Expression Levels as Biomarker for Proteasome Inhibitor', 9/2013, for details). Expression cutoffs for IGH and FCGR2B determined as described above, are employed to quantify enrichment of responders, PFS, and OS on the four clinical trial arms in the biomarker positive versus negative subsets. For this analysis responders are defined as patients achieving a best overall response as determined by the PI of MR, PR, VGPR, or CR and non-responders as SD and PD.

The determined thresholds are then used to select the biomarker positive and negative samples for the biomarker subgroup analysis. In each group, comparison between treatments arms are performed and reported in tables accompanied by survival plots. A Cox regression model including the treatment group is fit and the hazard ratio for the CFZ arm and BSC (Rd) arm and their corresponding 95% confidence intervals are reported. A hazard ratio smaller than 1 implies that an extension of PFS in the CFZ arm compared to the BSC (Rd) arm was observed within the biomarker positive or negative subgroup of patients. The ratio of biomarker positive and biomarker negative hazard ratios are determined to fulfill the key Go criteria. A Wald interaction test is performed and a p-value reported as an indication whether the treatment effect varies according to biomarker status.

Example 5: qPCR

The RNA-Seq analysis of bone marrow samples from carfilzomib (CFZ) Phase 2 clinical studies has shown that high IGH and FCGR2B [0] gene expression levels are predictive of response to the proteasome inhibitor carfilzomib in relapsed and refractory multiple myeloma patients [1]. Bone marrow samples from the carfilzomib Phase 2 and Phase 3 clinical studies are analyzed using an alternative method to confirm these analysis results.

RNA from CD138+ selected bone marrow samples from the carfilzomib Phase 2 and Phase 3 clinical studies are analyzed with the goal of confirming that high IGH and/or FCGR2B gene expression levels can be measured using an RT-qPCR assay and can be used to determine predictiveness of response to the proteasome inhibitor CFZ and non predictiveness of response to other therapeutic regimens, such as corticosteroids plus optional cyclophosphamide (BSC) and lenanlidomide plus dexamethasone (Rd). At the time of patient screening during the trials, bone marrow samples were collected and aspirated.

There were a total of 75 samples collected as part of the Phase 2 study. There were a total of 192 samples collected as part of the Phase 3 trial from patients treated either with CFZ or according to best supportive care (BSC). There were 424 samples collected as part of the Phase 3 trial from patients treated either with CFZ, lenalidomide, and dexamethasone (CRd) or with lenalidomide and dexamethasone (Rd).

First, reverse transcription of RNA previously used for RNA-Seq data is performed. Then RT-qPCR (quantitative polymerase chain reaction) [2][3] is performed to determine the amount of Ig and/or FCGR2B in a sample by measuring the threshold cycle (Ct) or crossing point value. The Ct reflects the cycle at which the measured signal exceeds a defined background threshold. The flourescence signal is measured at the end of each amplification cycle and the Ct value results from the interpolation of the two signal measurements between which the threshold was crossed [2]. Negative specimens do not yield a Ct value. The quantitative Ct value is negatively associated with the (log) concentration of nucleic acids detected, i.e. the higher the Ct value the lower the input concentration.

Targeted primers are used to amplify the IgH locus and/or the FCGR2B gene of each sample. The expression levels of these two targets are normalized using house-keeping genes. A correlation between Ig and/or FCGR2B expression levels as measured using the RNA-Seq data (cf. Example 4) and as measured using the RT-qPCR method is established. RT-qPCR being representative of the amount of Ig and/or FCGR2B in a patient sample is validated. A pilot study performed on 19 samples from the Phase 3 trials has shown a good correlation ($R^2=0.919$) between RNA-Seq and RT-qPCR expression leves of the FCGR2B gene.

After this correlation is established for the Ig locus, an optimal cutoff to distinguish between responders and non-responders is determined by calculating sensitivity and specificity for all possible cut-off combinations within the range of the assay. An ROC analogous to the method described above is used to find an optimal cutoff to enrich for responders in the data.

The determined thresholds are then used to select the biomarker positive and negative samples for the biomarker subgroup analysis. In each group, comparisons between treatments arms are performed and reported in tables accompanied by survival plots. A Cox regression model including the treatment group is fitted and the hazard ratio for the CFZ arm and BSC (Rd) arm and their corresponding 95% confidence intervals are reported. A hazard ratio smaller than 1 implies that an extension of PFS in the CFZ arm compared to the BSC (Rd) arm was observed within the biomarker positive or negative subgroup of patients. A Wald interaction test is performed and a p-value reported as an indication whether the treatment effect varies according to biomarker status.

Example 6: Immunofluorescence Assay

An immunofluorescence (IF) based assay [2] is used to quantify the amount of Ig and/or FCGR2B protein in a sample. The IF technique comprises of two phases: (1) slide preparation (specimen fixation and permeabilization) and immunoreaction (in order: antigen retrieval, non-specific site block, primary antibody incubation, secondary incubation, couterstaining with a nuclear dye, and mounting the slide); (2) employment of systems of detection, interpretation and quantification of the obtained expression. As part of the clinical Phase 2 and 3 trials, cyto spin slides of bone marrow aspirates were prepared from each sample. To visually confirm the presence of plasma cells, a CD138+ antibody was used to stain the sample. Specific antibodies against Ig and/or FCGR2B antigens that can also be visualized by staining are employed. The amount of staining is quantified using a flourescence microscope and standard image processing tools.

A correlation between Ig and/or FCGR2B expression levels as measured using the RNA-Seq data (cf. Example 4) and as measured using the IF method is establsed. The IF assay being representative of the amount of Ig and/or FCGR2B in a patient sample is validated.

After this correlation is established, an optimal cutoff to distinguish between responders and non-responders is determined by calculating sensitivity and specificity for all possible cut-off combinations within the range of the assay. An ROC analogous to the method described above is used to find an optimal cutoff to enrich for responders in our data.

The determined thresholds are then used to select the biomarker positive and negative samples for the biomarker subgroup analysis. In each group, comparison between treatments arms are performed and reported in tables accompanied by survival plots. A Cox regression model including the treatment group is fitted and the hazard ratio for the CFZ arm and BSC (Rd) arm and their corresponding 95% confidence intervals are reported. A hazard ratio smaller than 1 implies that an extension of PFS in the CFZ arm compared to the BSC (Rd) arm was observed within the biomarker positive or negative subgroup of patients. A Wald interaction test is performed and a p-value reported as an indication whether the treatment effect varies according to biomarker status.

Example 7: Validation

This example demonstrates that sensitivity to carfilzomib correlates with level of expression of immunoglobulin.

Figure 11A:
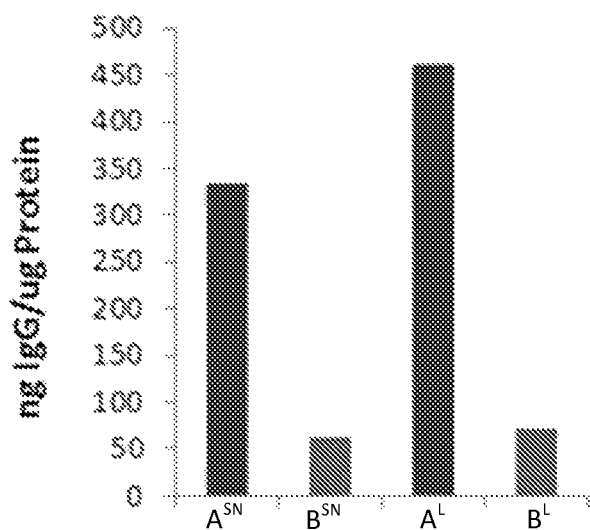
FIG. 11A is a graph of the immunoglobulin expression (ng IgG protein per μg total cellular protein) by cells of Line A or Line B, as measured by ELISA. SN, supernatant of cell culture; L, cell lysate.

Two hybridoma cell lines, Line A and Line B, were tested for immunoglobulin (Ig) gene expression levels by ELISA assay. Either hybridoma cell culture supernatant or hybridoma cell lysates were added to wells containing antibody specific for mouse IgG (Cat. No. E99-131; Lot No. E99-131-130419 Bethyl Laboratories Inc). As shown in FIG. 11A, hybridoma cells of Line A expressed Ig to a greater extent, relative to the Ig expression levels exhibited by Line B. Line A accordingly was considered as a high Ig-expressing (high Ig) hybridoma cell line, and Line B was considered a low Ig-expressing (low Ig) hybridoma cell lines.

Figure 11B:
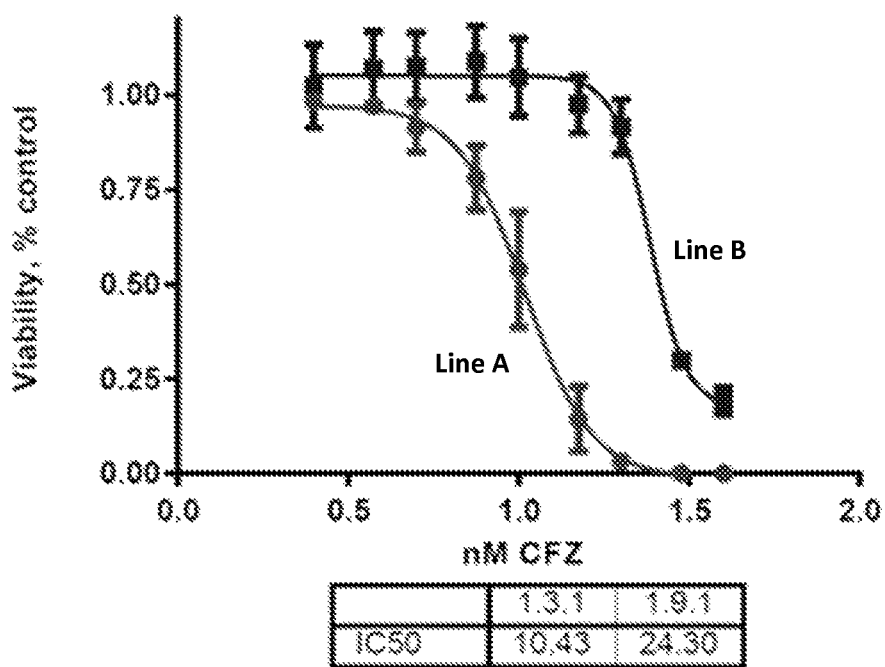
FIG. 11B is a graph of the viability of cells of Line A and Line B upon treatment with carfilzomib (CFZ). Viability is expressed as % viable cells relative to untreated control.

The two hybridoma cell lines were tested for sensitivity to carfilzomib. Cells of each of Line A (high Ig) and Line B (low Ig) were treated with various doses (40 nM, 30 nM, 20 nM, 15 nM, 10 nM, 7.5 nM, 5 nM, 3.75 nM and 2.5 nM) of carfilzomib for 72h. The viability of the cells were then measured by CellTiter-Glo® Luminescent Cell Viability Assay (Cat. No. G7570; Promega Corporation) and compared to no treatment control. As shown in FIG. 11B, cells of Line A were more sensitive to carfilzomib, relative to cells of Line B. The inhibitory concentration (IC50) of carfilzomib on the cells of Line A was 10.43 nM, whereas the IC50 of carfilzomib on the cells of Line B was 24.30.

The drug sensitivity assay performed on two additional pairs of hybridoma cell lines, each pair consisted of a high and a low Ig-expressing hybridoma cell line produced similar results to those achieved with Line A and Line B. For each pair, the cells of the high Ig-expressing hybridoma cell lines demonstrated a greater sensitivity to carfilzomib, relative to the cells of the low Ig-expressing lines.

Example 8: Quantitative RT-PCR

Taqman primers and probes for PCR amplification of FCGR2B was purchased from Life Technologies (Cat#4331182).

CD138 positive cells were collected from bone-marrow aspirates obtained from patients. Total RNA was then isolated from these cells using Trizol reagent (Cat.#15596-026; Life Technologies). The cDNAs were made using QuantiTect Reverse Transcription kit from Qiagen (Cat.#205310) and qRT-PCR assays were performed using Taqman assay reagents (Cat.#4440042; Life Technologies).

Figure 12:
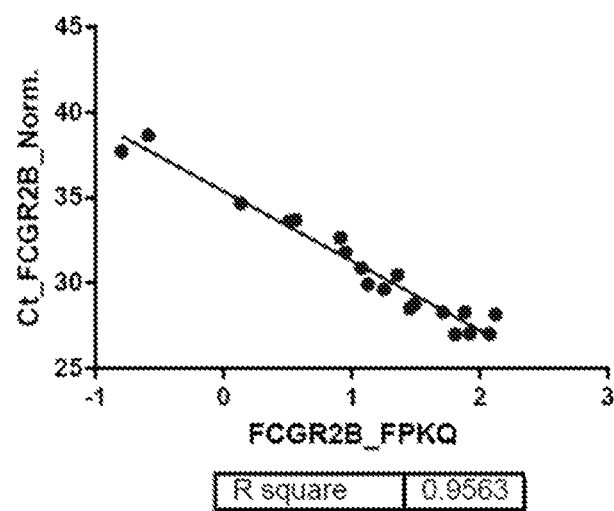
FIG. 12 is a graph of the amount of FCGR2B RNA as measured by qPCR. The FCGR2B RNA amount is expressed as normalized threshold cycle (Ct).

As shown in FIG. 12, the amplification and quantification of the expression of FCGR2B using the above primer pairs were successful. A strong correlation between RNA Seq data (FPKQ) and qRT-PCR data ($R^2$=0.9563) indicate that the Taqman assay can be reliably used to determine FCGR2B transcript level from patient samples. Development of similar assays for IGH genes are in progress.

Once the assays are developed patient samples from a Phase II clinical trial will be subjected to the same quantitative RT-PCR measurements to establish a qRT-PCR based cut-off that will separate the responders from the non-responders.

Patient samples from a Phase III clinical trial will then be subjected to the same qRT-PCR assays and the cut-off established from Phase II study will be applied to parse responder from non-responder.

REFERENCES

References Cited in Examples 1 and 2

Dempster, A. P.; Laird, N. M., Rubin, D. B. (1977). Maximum Likelihood from Incomplete Data via the EM Algorithm. Journal of the Royal Statistical Society, Series B 39 (1): 1-38

Jun Hu, Huanying Ge, Matt Newman and Kejun Liu. OSA: a fast and accurate alignment tool for RNA-Seq. Bioinformatics (2012) 28 (14): 1933-1934.

Mulligan G, Mitsiades C, Bryant B, Zhan F, Chng W J, Roels S, Koenig E, Fergus A, Huang Y, Richardson P, Trepicchio W L, Broyl A, Sonneveld P, Shaughnessy J D Jr, Bergsagel P L, Schenkein D, Esseltine D L, Boral A, Anderson K C. Gene expression profiling and correlation with outcome in clinical trials of the proteasome inhibitor bortezomib. Blood. 2007 Apr. 15; 109(8):3177-88.

Rody A, Holtrich U, Pusztai L, Liedtke C, Gaetje R, Ruckhaeberle E, Solbach C, Hanker L, Ahr A, Metzler D, Engels K, Karn T, Kaufmann M. T-cell metagene predicts a favorable prognosis in estrogen receptor-negative and HER2-positive breast cancers. Breast Cancer Res. 2009; 11(2):R15.

References Cited in Example 4

[0] Gray, K. A., Daugherty, L. C., Gordon, S. M., Seal, R. L., Wright, M. W., Bruford, E. A. 'genenames.org: the HGNC resources in 2013'
Nucleic Acids Res. 2013 January; 41(Database issue):D545-52. doi: 10.1093/nar/gks1066. Epub 2012 Nov. 17 PMID: 23161694
[1] Tuch, B. B., Löhr, A., Degenhardt, J. D., Kwei, K. A., Lowe, E., Keats, J. J., Kirk, C. J.
U.S. Patent No. 61/863,809 'Immunoglobulin Expression Levels as Biomarker for Proteasome Inhibitor', September 2013
[2] Robert Hajek, Richard Vryce, Sunhee Ro, Barbara Klencke, Heinz Ludwig
'Design and rationale of FOCUS(PX-171-011): A randomized, open-label, phase 3 study of carfolzomib versus best supportive care regimen in patients with relapsed and refractory multiple myeloma' BMC Cancer 2012, 12:415
[3] Jun Hu, Huanying Ge, Matt Newman and Kejun Liu
'OSA: a fast and accurate alignment tool for RNA-Seq' Bioinformatics (2012) 28 (14): 1933-1934.
[4] Paul Flicek, Ikhlak Ahmed, M. Ridwan Amode, Daniel Barrell, Kathryn Beal, Simon Brent, Denise Carvalho-Silva, Peter Clapham, Guy Coates, Susan Fairley, Stephen Fitzgerald, Laurent Gil, Carlos Garcia-Giron, Leo Gordon, Thibaut Hourlier, Sarah Hunt, Thomas Juettemann, Andreas Kahari, Stephen Keenan, Monika Komorowska, Eugene Kulesha, Ian Longden, Thomas Maurel, William McLaren, Mattieu Muffato, Rishi Nag, Bert Overduin, Miguel Pignatelli, Bethan Pritchard, Emily Pritchard, Harpreet Singh Riat, Graham R. S. Ritchie, Magali Ruffier, Michael Schuster, Daniel Sheppard, Daniel Sobral, Kieron Taylor, Anja Thormann, Stephen Trevanion, Simon White, Steven P. Wilder, Bronwen L. Aken, Ewan Birney, Fiona Cunningham, Ian Dunham, Jennifer Harrow, Javier Herrero, Tim J. P. Hubbard, Nathan Johnson, Rhoda Kinsella, Anne Parker, Giulietta Spudich, Andy Yates, Amonida Zadissa and Stephen M. J. Searle 'Ensembl 2013' Nucleic Acids Research 2013 41 Database issue:D48-D55
[5] Dempster, A. P.; Laird, N. M., Rubin, D. B. (1977) 'Maximum Likelihood from Incomplete Data via the EM Algorithm' Journal of the Royal Statistical Society, Series B 39 (1): 1-38
[6] Soreide, K. (2009) 'Receiver-operating characteristic curve analysis in diagnostic, prognostic and predictive biomarker research', Journal of Clinical Pathology 62:1-5
[7] Jiang, W., Freidlin, B., Simon, R. (2007) 'Biomarker-adaptive threshold design: a procedure for evaluating treatment with possible biomarker-defined subset effect' Journal of the National Cancer Institute 99(13):1036-43

References Cited in Example 5

[0] Gray, K. A., Daugherty, L. C., Gordon, S. M., Seal, R. L., Wright, M. W., Bruford, E. A.
'genenames.org: the HGNC resources in 2013'
Nucleic Acids Res. 2013 January; 41(Database issue):D545-52. doi: 10.1093/nar/gks1066. Epub 2012 Nov. 17 PMID: 23161694
[1] Tuch, B. B., Löhr, A., Degenhardt, J. D., Kwei, K. A., Lowe, E., Keats, J. J., Kirk, C. J.
U.S. Patent No. 61/863,809 'Immunoglobulin Expression Levels as Biomarker for Proteasome Inhibitor', September 2013
[2] Caraguel, C. G. B., Stryhn, H., Gagne, N., Dohoo, I. R., Hammell, K. L., "Selecting a Cutoff Value for Real-Time Polymerase Chain Reaction Results to Fit a Diasgnostic Purpose", J VET Diagn Invest 2011, 32:2
[3] Mackay I M, Arden K E, Nitsche A: 2002, "Real-time PCR in virology". Nucleic Acids Res 30:1292-1305.

References Cited in Example 6

[0] Gray, K. A., Daugherty, L. C., Gordon, S. M., Seal, R. L., Wright, M. W., Bruford, E. A.
'genenames.org: the HGNC resources in 2013'
Nucleic Acids Res. 2013 January; 41(Database issue):D545-52. doi: 10.1093/nar/gks1066. Epub 2012 Nov. 17 PMID: 23161694
[1] Tuch, B. B., Löhr, A., Degenhardt, J. D., Kwei, K. A., Lowe, E., Keats, J. J., Kirk, C. J.
U.S. Patent No. 61/863,809 'Immunoglobulin Expression Levels as Biomarker for Proteasome Inhibitor', September 2013
[2] Odell, I. D., Cook D., 'Immunofluorescence Techniques', J of Investig. Dermatology, 2013, 133 e4

A number of embodiments of the invention have been described. Nevertheless, it will be understood that various modifications may be made without departing from the spirit and scope of the invention. Accordingly, other embodiments are within the scope of the following claims.

SEQUENCE LISTING (846 sequences)

SEQ ID NO: 1 - DNA, 36761 bp, Homo sapiens
gcgaaccgcgtgcgtaacgcacgggcccggcggggaacaccggtccgctgtaacaccggcccggcgcagaagcgggacgtcggcttctaggggcccaggccggcggcggcgatggcctcggcagctgtggagagcttcgtgaccaagcaactggacctgctggagcttgagagagacgcggaggtggaggagcgcaggtacgggaggccgccggcgccgctccctcgcggtcggtcccgccgtgtcccgggcagagtctccgaggggctcggcctcatagtctggggcgggaatttcgtctccgacccttcgagtcaggggcagggatcgtccgtcccctgcttggccacctcccgagttgtcagtctcatcacttcctgggcagcgcgttccgtttggggacccttaagaagcactttgatttcccgacccgagaccccccactaagcttacactcctgggccctggccccgaccccagttccacccgcagcgagttagcagccctttcccttattcattcagtaaacatggtttgcgcccattctcagtcaggccccggcagcatgagtcaggtgcactggctgcccccgatccggccagcggcgggctgggcataagcagagagtcccttcccctccagtgcgtccagggccggctgcgtgcgtgtcgcggggaaagagcctggaggaggaaggcccttccctggggagggtcatggtggcttcaaggagggagtggtgcctgaaggaaaattggagttaagctggtgggtgcggagtagggtggggagccgtcctgagaggtgtggggagccatgtgagagccgggcttgtttccgaatgggactatttacttgtccaaaacaatcagagctaacacttacgtactttccatgcgttaattcttttacacctcatcccatgccaaccctacagtgtaagtttcttttttttctttttcttttttttttttttagacagagtctctctctgtcgcccaggctggagtgcagtggcacgatctcggcttactgcagcttccatctcccgggttcaagcgattctcctgcctcagcctcctgagtggctgggactacaggcgcgccaccacgtcctgctaattttttgtatttttagtagagacagggtttcaccatgttggccaggatggtctcgatctcctgacctcgtggtctgcccgccttggcctcccaaagtgttgggattacaggcgtgagccaccgtgcccggccgcagtgtaggtttctgttactgtcattttccgtctaaggagatggagacagagaggggttaagtaacttgccccggggtgacacagtgtagcccgatttgctgtcaggcagtctgcttccagagtttgcagtcagccatatgtgggtaggatttgtctgagatgcttttgatcatggcaatggagagcttttgcagttatgttgagtttcttagaatcccagctgtttcatttatggctgtgtgactttgcaggttctgtctctgagccttacttacttcatctgtaaaactgggatgattcccacctcacaggcttgctctgagaatgaaacgatcccctgtcagtcaggtgctcagcgtggtgccaaggacagagtcagcccccatggcagtggctctttctgaggatgctgagcagactggcagggcgagcctgggaagggcctggctaaggagctagtcttctgttctgtgtatgaaggatgggccatcagcggggttaagcaggtgagggaggcgaatagctttgcattttaggaggatttcttgggtctcctgcttttgattggacgtggagaggccagaggtaaggtagttgagaggctctgtttagtccaggtgagcagtgatgtggatttgaaccggggctgtggcagccaggatgagaggcagagaagtccaggtagaaatgggaggggcctgataggacttagtgacagatgggaggagagaggggaatgctgattgaaagatctgtctcaggtaactgagagaagggttgtggcattaactgccctagggggatgtaggaggagcgggattgggagtggagccaattcggagttccattgggacatatttagtgcctgtgagtagatctttatctatgtttctttctcttttacttttcctgggtgggtggaagtagaaactagtaaaaatcctgaagcatcaataccgggtgtcttccaggtcctggcaggagaacatctctctgaaagagctccagagccgaggcgtgtgtttgctgaagctgcaggtatccagccagcgcactgggctgtacggacggctgctggtcacctttgagcccaggcgatacgggtccgcggcagctcttcccagtaacagctttacttctggtgtgtgcgtattgacctagacagacattgaaatttactggcattcagaccgtgacttgtaccctcgtaaagactggattaaaatgaccagttggagaataaagcgttgcaatgaagaactcttaatcagaagtccaacaattgatgtgggttttagttgtctagatcagcgttgtccaaaatggtagccattagccatgcgtggtcatcaaatgtttgaagtgtggcttgtaattgccgcagatacagaatacacaccaaatttggaagattatgttaaaaaaacaattgggaatatcttgagtaatttttctgaatactgattacatgttgaaataatatttttcatatattgggttaaataaaaaatatcttattaaaataatttacccatttcttttctttttttttttttttttttgagacagagtttcgctcttattgcccagtctggagtgcagtggcatgatctcggctcactgcaacctccgcctccggggttcaagtgattctcctgcctcagcctcccgagtagctgggattagaggcatgcgccaccgtgcctggctaattttgtatttttagtagagacggggtttctccatgttgttcaggctggtctcgaactcccaacttcaggtgatccgcctgctttggcctcccaaagtgctgggattacaggtgtgagccagtgcacccagcctcttttaaatttcttaatatggctactagaaaacttaaaactacacgtgactgggtgcctgtaatcctagcactttgggaggccgaggtgggtggatcacttgatctcaggagttcgagaccagcctgggcaacgtggcaaaaccccatctctgcaaaaaaatagaaaaattagccagatgtggtggtgtgtgcctgtagttcctgctacttgatgggctgaggcaggaggatcgcttgaacctgggaggttgaggctgcagtgagctgaaatcacgccactgcactctagcttgggggcaaagtgagaccctctctcaaaacagacaaaaacaaaagaaaaactacatgtgactctctttatgtttctatgtaatgggcagccttggtccagctggtaaacatgcaggatgtgtacttctgtattcccaaccctttcttgtgccaagcatgctttggctaaacttgtgccagcctggttggaaaggagggacagttagaagaagcttcttaaccacacgcctgggatgcttgtgttagacaaccacagccttggaagcctggaggaagcagcgttgccagggctgtactttttactatggaagtgtctctgccttgttttggtggtgacggagttttaaatttcatattttgatttcgtagactttagcccaacaattactggaatactggctggatttggagaagatgagatgagggtattgagagaggagagggccaggaggggaacctgtaggttggagtcagacctgagcagagtttgagattttttttttctgagatggagtctcactctgtcgctcaggccggagtgcagtggtgcaatcttggctcactgcagcctcagcctcccgagtagctgggaccacaggtgcccgccaccacgcctggctaattttttgtatttttagtagagacgggctttcactgtgttagccaggatggtctcaatctcctgacctcgtgatctgcccacctctgcctcccaaagtactgggattacaggcgtgagccaccgtgcccggcctaacttactttctttttttttttttaactgttactgattgcatttactaaagaaagtaacaaagataaaatatttgaagtatagtggattttattacagaaaatgatattgaagctttccccagtgtcttgtgtcactgagtctttgtttttgcaggtgatatcgtgggcctgtacgatgctgctaatgagggcagtcagctggccactgggatcttgacccgggtcacccagaagtcggtcacggtggcctttgatgagtcccacgatttccagttgagcttggaccgagagaattcctacagactgttaaaacttgccaatgatgtcacttacaggcgactgaaaaagtaagtggatgggactggaaatcctaagtaccatcttccttcaacacagctaatccattcttacatgcctgtcgcacaaaagagagcaacaagtcatggtgtgggtgtggccctcatgggagttggtggcagcattggggcagaggctcgggcactgaattgcaggtgttctaattttagttttctcccttggcagagccctgattgctctaaagaagtatcattctggcccagcctcctcactcatagaagtgctctttggcagatctgctcccagtcctgccagtgaaatacgtaagaacttctgagttttcttttttggttgaaatcactactgaaagtatagagaacagtgtgaccttgggccgttttaataagagtttgagaaagtatgactagaagaagtctccctgaacatctttgtaggagtgtctcggagggccttgcatgaactggaccgtcctccttgtactcagtcctaatgaactggctcgttccattgaggttttttttttttttttgagacagaatcttgctctgttgcccaggctggagtgcagtggcgcgatctcagctcattgcaaactccgcctcccgggttcaagtgattcttttgcctcaacctcccaagtagctgggactacaggcatgcaccaccacgcctggctaatttctgtacttttagtagagatgaggtttcaccatattgaccaggctggtctcgaactcctgacctcatgatccacccgccttggcctcccaaagtgctgggattacaggcgtgagccaccgtgcgcctggccccattgagtttttagttaaaaaaatttttttttggcggggggggtggagggggggggcggatggagtctcgctctgtcacccagactggagtatagtggcatgatcttggctcactgcaacctccgcctcccgggctcaagtgattctcatgcctcagcctcctgaatagctgggattacaggcacacgccaccacgcctggctaatttttgtatttttagtggagacagggttttgccatcttggccaggctgttctcaaactcctgatctcaagtgatctactcacctcagcctcccaaagtgttgggattacaggcatgagctaccgtgcctagcctccattgagttttaaaataatgttctttttagtgtatataaatcttttattttgaaatgtaatgatatttcttttagcttagtactttgtgaaaatagaggaaagctgatcatactttatgcttgatagcaattttaggttggaaaaatcttttttttttttttttgagacggagacttgctctgtcaccaagagtggggtgcagtggtgcgacctcggctcactgcaacctccgcctcctgggttcaagtgactctcctgcctcagcctcccaagtagttgggattacaggtgcccgccaccatgcccggctaatttttgtattttttagtagagacaacatggtttcaccatgttggtcgggccggtcttgaactcctgacctcaggtgatctacctgcctcggcctcccaaagtgctgggattacaggcgtgagccaccgtgcccggtctgtgcactttttatgtcctttgctgttcttggagaacgtcatttttgggaggagtttgttgtctcatccagtcactgcccatgatttaacagtcctgtgagtattggacttggcccatttgtaaagcggtggctttggccaagcctcatgcaagggttaccccacagctattttctatcatactgtgctaggcaagccagtgttgtgttagcttcaaacacacaggacgactttgtagcactctttcagcatgcagtccctcaagatgtgttgtttttaaatactcattttctttctgcattttcctttggaaattctaaatgcagtcacatttcagtaatgctttatttctatgaaatatttactgaagggctcctatgcgtcacaaactgaattagaaatgtatttactgtgtcttagggactctggaatggcttggctagagcacgggaacgtggggttcaatggcctgttactagctgcacaccctgccgtcttccatgttggcttcagtctcacaagtcagggtcagcaaacaccctttgcttatgagctgctccttatccgataggcgtctctgtgtagtgggcaccatgtagcgaatgccatggctgcagggctgagcacagcaccacctgctctcaagagcacagcataagaagcaggtcttggccaggcgcggtggctcacacctttagtcccagcactttgggaggctgaggccggcagatcatgaggtcaggagatcaagaccatcctggccaacacggtgaatccccgtctctactaacaacacaaaaaattagctgggcatggtggcactcacctgtagtcccagctactctggaggctgaggcaggagaatcgcttgaacccaggaggcggatgttgcagtgagctgagatcatgccattgcactccagcctgggtgacaagcaagactccatctcaaaaaaaaaaaaaaaaaagaagcagatctttagtcttggtcgtggaagattcaaaatagaaacacgatcctagaatttgttaatcattgtttttgtcatttgtctttatcattttatgggcactttaaagagggacattatgttagaaaggaatatgctctaggaaacatttccttcattcctgttactctagagcaggggtttttcctgtaaagggatggattgtgaatgttttgactctgtgggccatatcatacgtaccgtctacagctgcctgctgtagacggtatgtaaatcaatgggtgtggctgtgctccagtaaaactcaccaaaaccggcagctgactggatgtggcccacagtttgccgattcctgttcaaggagaaaccttgtgaaaataaagcagacttaattttgtgttgattgggttgcccctggggaggtccggcgtgttcctgacaggcatcactcatcccccggggcacacactctctgaggaggaacacccacagagctccccagagcacctgagcctcacgctgctgcttcttccacagacccgctgacattcttcaacacctgcctggacacctcccagaaagaagcggttttatttgcgctgtctcagaaagaacttgccatcatccatggacctcctggcactgggaaaaccacgactgtggttgagatcattcttcaagctgtgaaacaaggcttaaaggtgggcagtgcatgccacttccctgtcagagcccgtccgctcctggtctgttgtgttcagtgggtgctcagcgacctttcagcctcagttctggtgggatgggtcaggaacattactgagcatttattgattgagccttggactgcccctgtttgatttccagcatccccgtgagtcttggggagcacgcgcaggagccgtagcctgggttgttgaggaaggctcctggagccctttgaggcgtggcagccttcgtgtcggccaggccctgggtcagggtttatttgttcaccacgcttgctgtgctcgtgctcctccgtgtgcacgcccgtgcaggggcctggagttggcctgggcccggtctgtgcccgtcaggagctcagcgtctggttgaggtgttaacagctaatcagatagtctggttaatggatacgatgcacatgtccagtgcacagatgaatgattttctgagatgtggaatataacattgtacattattattcacttacattttaaattttttttatttttattttttggagacggagcctcactctgtcacccaggctagagtctggagtgcaggggcgggatcttggctccctgcaacctccgcctcccgggtttaagtgattctcctacctcagcctcccgaacagctgggattataggcgtgcgccaccatgcctggctaatttttgtatttttagtagagatggagtttcaccacattggccagtctggtctcactcctgacttcagttgatctgcctgcctcagcctcccaaagtgctacgattacaggcatgagccactgtgcccggcccagttacatttttaatggctgaaaaaggatcttttatcatcatctgcatcagcttgagtcattgtggatcttggcacatggagagtttttttttttttaatttatttatttatttttaattatactttaagttctagagctttttgaaaaaactttctggtttataaaaatgttggataatgatgagaattggaataatggccagttttgtagtttgatgtttactgggtgctgcctaccaccaggcatcgttctgagcacccatttaatcctcactgaaaccctgtgccaaggcaggtggttagtggccccagtttgtagacaaggaagccgggtgtggtggctcacacctgtattctcagtactttgggaggctgaggcgggtgggtcacctgaggtcaggagttcgagaccagcctggctaacatggtgaaaccccgtctctactaaaaatacaaaacaattagccgggtgtggtggcacacacctgcaatcccagctacttgggaggctgaggcaggagaattgcttgaacctgggaggtggaggttgcagtgaactgagatcgcaccattgcactccagcctgggcaataagagcaaaactccatctccaaaaaaaaaaaaaaaaaaaaaaaaaccaaaaaaaccacgaggaaactgagaaacaaggtcaaatgcccagcactcagagtggcagagccagcaatggaactcgggcagagcgcagggaagcctgtcacttgcttaaaagattacgtccagcggttttccaatgtgtgagtgtctttgcacatgtttgaaaactggtaagaaaagatgacttattggaagggagcagattggtggttttaattgggtgccgactattcactaaaagtgagccaagacacacctgtgtgcacgctttggtggagatatgcctttggacatgccagtggggttggaggcgatgctgggcatagagagtgggtggctgagcctccttcctgagctgctgtttgttttgagcttaagggcctgtagagactctgcctcctctgctggttgccacctcctcttttttttttcctcagagatggggtctcactatgttgtccagggtggtcttaaactcctgacctcgcaccttggcctcccaaagtgctgggattacaggcatgagccaccgtacttggccagcgtctcacttttaatagtggagctgtggctgggtgcagcggctcatgtctgttatcctagcgctttgggaggccaaggggggaggatcacttgaacccaggagtttgaggtcagtctgggcaacatagcaagacccagtctctacaaaaaatagaagaaattagctgggcatggtgatgcatgcctgcagtctcagctacttgggaggctgagccaggaagatagcttgagcccagaaagtcacgaaacaccaggagtgtggtctaggtcttgctgctcgccacacagaaagccagttactgaggacaagtattgccaaggaagaggctttataatcagatggtgcagccgaggagatgagagctcatcctcaaacccatctccctgactaaaactaggggtttatataacagggaagaaatgtagcaatgtgtaaaaaacaggaactagggagggcaaggaggcacctgtagtggtctggtgattttcagatctttgatatttttttgagaggcctcaatgtccttttctgaggaagaaactcacataaataagtttgaagctttaacagcagatggtcaatttctctttatccaaaaacaactgtccatgggactattgagccggtttctccatgatcctgccactgcgctccagcctgggccatagagcaatttgtttcaaaaaaaaaaaagaaagaaagaaaaatatagtggagctacagtgttcgggagacaactgtgagtccatttgaaacgggaagggttcccttgtccccctcgcagggcgtgggatgggggagtggctcgcttcttcagtgtcctgctgctcagacctgcaggggagcatacagatgggcaggctgtgggctctgacctcatggcagtgtctaggggtgaatgtttacagctctgtgagttacagggtgctctcttagtttgccgtctataggtggcttatgttaaccaactcaattagatccccttccttgtcacaaggacagagggctttctgtatcctgggttcttgccttggggtaccggaagaatcggatcacacgtgggcttggaaaatgaatgcaagatttgattgagagcacgtgtgtacatgccttgtgcttctttctacctttaaggctttttgttgttttagtgtcaacttcagtggtttgattacaaagtaaatgaccagatcctaacttgcggttcccaggttctgtgctgcgccccctccaacatcgccgtggacaatctggtggagcgcctggctctgtgtaagcagcggattctgcgcctgggacaccctgcccgcctcctggagtccattcagcagcactccctggatgcggttttagcgcggagcgacagtgcccagattgttgcagatatcaggaaggacatcgaccaggtctttgtaggtgtcatggccagtgtccatgtggggcgtgggcttctgatctgcagtctttttaaggagcaaatttatctgtctgcattcctcttgaccttctcttgcttctgtcgattcctttaataattttaaaaattgggctgcccttttttttttttttttttttttttttttttgtgacagagttttgctctcattgctcaggctggagtgcagtggtgcaatctcggctcactgcaacctctgcctcctgggttcaagcgattctcctgcctcagcctccctagtagctgggactgcaggtgcgtgtcaccacgcctggctaatttttctatttttagttgagacagggtttcatcatactggtcaggctggtcttgaattcctgacctcaggtgctctgcccgcctcggcctctcaaagtgctgggattacaggcgtgagccaccatgcctggcctttgtttttgtttttttttttgagatggagtctcgctctgtcacccaggccggagtgtagtgctgctgtcttggctcactgcaggctccgcctcccggggtcaagtgattcttgtgcctcaccctcccaagtagctaggactacaggcatgtgccaccacacccaaccaatttttttatttttagtagagacgggggtttcgccatgtgggccaggctggtctcgaactcctaacctcaagtgatccacccgcctcagcctcccaaagtgctggattacaggtgtgagctactgtacccagccagggctgcccatttttgatagagaactatacttagcatttaacagagtctcaactgtcttcagagcacttggttagtaggtgtgaggaattgtaaagaaaacattttccggccggatacagtggctcacacgtgcaatcccagcactttgggaggccgaggtgggcggaacagttgaggtcaggagttcgagaccagcctggcccacatggtgaaaccccgtctctactaaaaatacaaaaattagctgagcatggtggcgggcacctgtattcccagccacttgggaggctgaggcaggagaatctcttgaacctgggaggtggaggttgcagtgagccatggtcactccactgcactccagcctcggtgacaaagcaagactccgtctcaaaaaaaaaaccaaacattttcctgggtgtctttctgtctggtcctgttgtcttgctagtagtggcaatgggagaaaagtagcctgaacataaacattgaaaaaattggcatcctcctagagctttccgtccattccaccttctccttgtgaaagaggacaccagtcggctggagaagtagggtggtggtaggtttcttccatttgagagggccttttccccccagcccgacactccgacacttttgagctctttggttctcccgtggacgctttgttgtagtgtctgtgctcacgtcctgtcctgtgtgctcactgtcggtactggtactccttggtgtcttagtctcagaggagtgatggcagcagggagggtgctggagccagtctttgctctaatgtctgtgctcacatcttgtcctgtgtgcttacggtcagcacctgcaccctcggtgtcctaacctcggaggagtggcggcagcagagagggtgctgggagccagtctttgctatgggcccgtggcatcgaggctgcttgcgtggctgcttgcatggcagcgtggggatgggccgcctgctgggagggggaggaaggatagatgcatgtcatgcaggttcgaggtggtggaggaatatgcatgatgtttgctcatcacaaatgtgggtgatttcatttcctgttgaaattggtgcttttgaggattttctttctctgtaaattatacacagtaaaatacctcctgtcacccctgctaaaactccatcccccaaagtagaaatcacaaataaggaaaggttacatcttttttttttttttttttttttttttaaagaatcttgctctgtcgcccaggctggagtgcagtggtgcaatctcggctcactgcaacctccgcctcctgggttcaagcaattctcctgcctcagcctcccgagtagctgggattacaggcacacaccatgcccagctaattttttgtatttttagtagagacagcgtttcactgtgttggccaggctggtctcgatttcctgagctcgtgatctgcctgcctcgggctcccaaagtgctgggattacaggcatgagccaccgcgcctgaccagttccatctttttgagatattaaagtaagttgaggttttgattatgggttgaaaaaattttttttaatctcttgaaaaatgtagaataatatgtgaagctcagtctctctattcgtaagctcctacaacccaaatcctggggcgggcaagcgctttttcttccccaagatcaaatgcctgtgtgcagggcagggctggtccaatttctggtctcctctgagttaaaaacgtggtctctttccaggacttaaaatgtctcttcctgtgacttcaaggcaagtgaggatgtaaggtgcttagttgcgtgtgtgtatctgtgtctctttcaaggaagatttctgagtgttttttacggagtttattgaactggactgaatgatagaagcacttcataaatagagttgaagaagtacaaagttggactgaagtaagtgtatctcctttgtttttctttataggtgaaaaacaaaaagacccaggataagagagagaaaagtaattttcgaaatgaaattaagctgttaagaaaagaactgaaggagagggaagaagcagctatgctcgagagcctcacttcggcaaacgtggtccttgcaacaaacacaggtgagggggcgtctccatcctgcctgtgtggcctcgaagaaggagttggggtgtgttccctcttctgttttctggaagagtttgtttagaattggtatttctttcttaaaagttgggtagggttcactagggaaggcctccgtacctgcagttttcttcatggagaggttttgaactacaaattcaacttcttcaatagataaagggctgttcaggttgtttttcttccatgagcttgtagctttcaagaagtttgtccattttatctaaacggttgaatttagaggcatgaagtggttcctaatatgcccttattcttcttttactgtctgcaggatctgtcatgatataacctgtattattcctgatactggtttgtgtgctcttttttttcctgctcttctggctggagggtttttttttttaaatttagattttatatatacatacatatatattttaagagacagggtctctgccaggcgcagtggctcacacctgtaatcccagcattttgggatgccaatgcgggtggatcacctgaggtcaggagtttgagacctgcctagccaacatggtgaaaccccatctctactaaaaatacaaaaattagccaggagttgtggtatgcacctgtaattccagctacttgggaggctgaggtaggagaattgcttgaatcctggaggtggaggttgcagtgaaccaagatcgcgccactgcactccagcctgggtgacagagcaagactccgcctcaaaaaaataaaaaccccaaaaccaaaaaaacaaagcaaaacaaaaaaagagacagggtctcactatgttgcccaggctggtctcaaactcctgggctcaagggatccccctgcctcagcctcctaaagtgctaggattacaggtggacccaccgcgcccggcctggctgcaggtttcaattgatcttcccaaagaaccagcttttgctttttctctattgtttttctgtttcatgtatttccacattgatctttatcgttttctgttttcttgggcttgttctttttcttgcttcttaatgtagaagctgagatcattgatttgagacctttctttttttctgatacgagcatttagctccataaatgtctccctaagtactgcttttgtggcatcccacaaattctgatctgttatatttcattcatttcaaaatgctatctcatttgccttttggttttttagaagtgttatatagtttctagatagttgggaaatgtccagatatctttctgttgttgatctctcctctcctctcccctcccctccccgtccccgtccccgtcctgtgtgggatctcactgtgttgctcctctcctctcctctcctctcttcttctctcctctcctcatccctgtccccatccccatccccgtcgccttccctatccccatccccatatgggatctcactatgttgcccaggctggactcaaactcctgggctcaggtgattctcccagctcagcctcctgaggagctggggctccctgcatgtgccactgcacctggcttactttctgttattggtttctaatttagttccatgtggtcagaggacatactctcatgacttggatagttcatcgagacttactttatggtccagaatctggtctctgtctttgtgagtgttccatgcacacttgatagaacgtgtgttctgattttattgagtgttctgtaagtagtcagatcatgatggttgatgatgtggttcaagtctgctgtattgagagagggacgttgaaatctctgaatataactggacatgtctgtttttcctgcagttctattggtttttgcttcatatctttggaaactcttttactggggtcataaatgtggggctatgttttcttgattaattaacaaatttatcattatgaaatgaccttctttatccctgataatattctttttttgaaatctactttgtctgacattaaaataatcatttcagcatttcagcttgcttttcttttcattatggtcaaaaacctgtaaaatttaccatcgtaaccctttttaagtctgtagtacagtagcattaattgtatgcatgttgttgtacagcagatctctagaacattttcatcttgcagacctgaagctctggatctgttgaacagcaattccctttttccctgtcccagatcctggcagtcaccattctcctgtctgtttctaagaattttattattttacatacctcaagtaagtggaaccatgcaggatttgtcgtcttgtgactggcttgttttatttagtgtaatgccctcatggttcatccatgttgtccagctttctttttatttttaagagacagggtcccaatctgtcacctaggctggagtacagtggtgcggtcaaagctgtactccagccttaaccatgaatgtgggacctccagcaatcctcccacattgacctcctgagttgctgggattaacaggcgtgagccattgcacccagcccccacctttctttcaactagtgttagtgtgatctatctttatcctttttcttagaacctatttgtgtctttatgtttaaagtgatcttttaaaaaatatttgagacacggtctcactgtgttacccctaactggagttgcagtggtgcaatcatggctccctgcagcctcaacctcctgggctgaagtgattctcccacctcagcctcctgagtagctgggacaacagacacgtgctatcacaccctgctcatttttttgatttttaatagagacaagatctcactgtgttgcccaggctggtctggagttcctggactcaagtagtccttccacctctgcctcccacagtgctaggattacaagtgtaagccactgtgcctggcctgtttatttctttttaaagagagagtcttgctctgttgctcagactggagtgcagaggcgtgatcataacttgctgtagccttgcattctttggctcaagtaatcctcccacctcagcttcccgagtagctagtactgtaggcatgagccattacacctggctaattttaaaaatgttcttttcttttttccttttagagatggggtcttgcaatgttgcccaggctggtctcaaactcctggcctcaagtgatcctcccactttggcctaaagtgaatttttttgtagatagcatatagctgggccttgctttattatccagtttgacagtttctgccgtttgttctttgttatattttcctcctcttctgctttcttttaattaattaattgaacatttctttttttttttacataagttctcactatgccccatgattgaagatttcttaggaatttatttttatttatttatttatttttaaaagataatttatagagacaaggtcttgctgttttgcccaggctggtctcgaactcctggactcaggggatcctcccaccttggccaccttggtgctgggattataggcatgaaccatcactcctggcctatttttgtttttgttggcttgttagctatatatctgtatttgattctttcagtggttactttaggccttacagtatgtgtcttcaactcatcatagtctgttcatatgccacctcacatatagcataagggctttatgattgcaagctgacatttctctcctcttagcatttatgcttttgtcatatatttttcttatacgcatattctaagacttacaatgcttgttcttgttttaatggtgaattatctttaaagagatctaaataataagaaaaatgtcttcgtatttgcccgtgtagttaccacttttggcgctttgttttcttttggtttaggtcgtgtatttccacgtggcatcattttccttccacctgaaaggcatccatgatcatttcttgtagtgtgggtcagccggtgatgcagtccagtagcttttgtatgtctgaaaatatcttgtttcacctgcagttttgaaagatatttttgctgcgtgagaattctagattaacacttttccttgcaatattttaaagatgttgtccactgtcatctgcctgagtatttctgaagagaaattggtcatccttatccttgttcctttgtatgtaacgtgtcttttttcttctgtctgcatttaagattttttcagccaggtgtggtggctcatgcctgtaatctcagcactttgggaggcttaaggcgagtggatcacctgaggtcaggagtccgagaccagcctggcccacatgtactaaaaatacaaaaaaattagcagggtgtggtggtgggcacctgtaatcccagatgctcaggaggctgaggcaggagactcgcttgaacccggaggcggagattgcagtgagctgagattgcaccactgtactccaacctggacgacagagccagactccgtctcaaaaaaaaaaagaaagaaaatgatgctttctttatcactggttttaagcaatttgactatgatttgccctggtgctatttgcttcatgtttttttttgagacagagtctcactctgtcacccagactggagtgccgtggcgcaatcttggctcactgcaacctctgcctcctgggttcaagcgattcttctgtctcagcctctggaatagctgggagtacagatgcacaccaccacgcctggctaatttttgtatttttagtagagacggggtttcaccacattggccaggctgctctcgaactcctgacctcgtgatccgcctgccttggcctcccagagtggtgggattacaggtgtgagccaccgcacccggcctcatgttttttaacattgtggtgagaacacaacatgagatctaccctcttaaatgtttaagtgtactatataatattgttaactatagacgtcgtgttgtgcagcagatctatagaatttatcttgcacagctgaacctttatacttgcttattgctgagttcactaatttccttctttcatgcctaatctcacatctgtcccatccagtgtaactttcatctgacatccagaaataagagtctttttatatctttgatgttcttatttaatttttttaacatttggaatacaactataataactgttttgaatattctagactattatttctctatcacctgtgtcatttttggtctctttcgatgaactgttccccttgagtggttgtgttttcctacctttttgtaggcctgctaatgtttgtttggataccggacattgaggattttacgttgttgcatgctgaatattgaatatttttgtattcctataatctttttttttgtttttttgttttgtttttttgagacagcgtcttgctctgtcacccatgctggagtgcagtggtgcgatcttggctcactgcaacctctgcctcctggattcaagtgattcttttgactcagtctcccgagtagctgggactacaggcatgcgctaccatgcccggctaatttttgtatttttagtagaggcgaggtttcaccatgttggccaggctggtctcaaactcctgacctcaagtgatctgcctgcctcggcctcccagagtgctgggattggtgtgagccaccacgcccagtctcctataatattcttgtgcttggttttgggaagcagtaaagttacttgtaaacagtttaatccttttgagtcttgcttttgagatgtgttagggtctggatcagtgcttagtccagggttaatattcccctgtactgaggtaagaccctttgagctttctacccaatgcaccctgtatcatgagatttttgagtttgactggtgggattaggtgctgttcccggccttgtgtgagcactgggcacttttctctcattgttttggatggtatttttcccaggcctggagtagttttctcctaagcatgtgctaatcacaatacccaagggaatctcgcagcagatctctggggttttttctctctgtgtagcagtctctttggcattttgtcctggaaactctgcctgcattggtcgccacagattctcagccttgtctcctcaactcagggagccttctaggttctacctggctgccccttctctgtactctctcctggaaactctcaaggcagaaagctggggtaaccccagggctcacctcctttgtctctcgttattcaggggttacttttctttgttacctgttgtctagtgtcctgaagagtgtggtttcagttattttaaaaaaattttaaataactggctgggggggttgttatttgagatgggagagtaaatgcagtccctgctattccatcttgggcagaggtggaggacgcacattctctcttgtagccaggagagagcactcccgttacagagctgtgtaccttgtgactgttgtgggaatcttgtcaaccactcttttggggtttaggaatgtgtttgtgagacctctggtttgttcctgtgtgataatagtaccacaaaggtagcagctgaaaacaacccacgtttattattctacagtttatctgggcggagagcccaggcccggctgaacaaggtgctgtgctcaggatctcacaaggctgcgatcgaggtgtcagtgggggctgcagtctcatctgaaacttgcctggaaaggatctttcttcaggctcacgtggttgttggcagcattcagttccctgtgggttcttgctgggtgttggctggaggccgctcttagctgtttgcccttaggccttgccaacatggctgcttgcttcctaaaagccagcaagagacatagtctcctagcacaatgggttatcgtcttatgtaatgttatcaagggtgtcacatctcatcacctttcccctgttctgtggattagaagcaagtctcaggccccacccacatttgaggggaagggattatgcaagatgtgaataccagtggccaggatcctggggcataccttaaagcaagtttgtctaactaaaggcctgcaggccacatgtagcccaggatactttgaatgtggcccaacacaaatttataaactttcttaaaacattatgagatttttgtctctgtgttttttttttaagctcatcagctattgtcaatgttagcatattttatgtgtggcccaagacaattcttcttcttttaatatggccctgggaagccaaaagattgcacatccctgccttagagtctgtttgccacaacctctcagctggtgggctgctctaaggaacagagtccaggttctttttttttttttttttttttgagacagcatctcactctgttgcccaggctgtagtgcagtggcacaatcttgattcactgcagcctcctcctcccgggttcaagtgattcttgtgcctcagcctcctgagtagctgggattgcaggcgcatgccaccaggcccagctaattttttttgtatattttgtagagactggatttcaccatgttggccaggctggtctcgaacttctgacctcaaatgatgtgcccaccttggcctcccaaagtgctaggattacaggagtgagccaccacacctggctagattctaattggctttgtagttattgctttatccagttgtgttttaaatcagacaggagaaaaaaagggtcacaagcagaaaatacatttatggggtcttttatatctacccatgtagttgcctttatttcttcatgtagatttgagttactctctccaaaggactccctttggtatttcttgaagggcaggtttgctgtgacagattctctaagctcatctttatctgggcatgtcttagtttctccttcattttttgaaggatagtcttgctgggtatagaattcttggttgacagtctttcagccctttggacgtgtcattccattgcctgcatactttctgatgggaaagcagctattgatctcattgagggctccttatatgtgacaagttgctactctattgctgctttcaagtgtcgtcttttgtcttttgagtgtgtgattatcatgtgttaggtgtggatctctgtgagtaaattacatggagtttgtggaccttcttggatgtttagattcgtgtttttcatcaaatttggggagttttcagccattattttttcaggtattctttctgcccttattctactctcgtctccatctacaactcccattatgaatcagttgattcacttgataatgccccacagatctctgaagctctgttcattttcctccatttttttctttctgatcttcaggctggatcttctcaatggacctctcttcaagtttgctgatcattctctcctgttgaatccttctagtgaatttcagttattgtacttttcaactccagaatttctgtgtggtgcttttttttttttttttttttttttagatggagtctcgctctatcgccagactggagtgcagtggtgtgatctcggcccaccgcgacctctgcctcccaggttcaagcaattctcctgcctcagcctcccgagtagctgggtctacaggcgtctgccaccacgcccagctaatttttgtatttttagtagagactgggttttaccatgttagccaggatggtctctatctcttgacctcatgatctgcctgcctcagcctcccaaagtgctgggattacaggcatgaaccaccatgccagcctctgtgtggtactttttaaaaaattattcctgtctctttattgatattctcttatttggtgagacattattctcatattttatttctttagacttgtttcccttttgctgtttgaacatacttagaatcgctgatatttcaagtctttgtctagtaagatcagcatctgggctttctctagtatccagtttatttatttatttatttaattttttggagatggagtctcactctgttgctcaggctggagtgccgtagcgtgatctcggcctgctgcaacctccgtctcctaggttcaagcgattctcctgccttagcctcctgagtagctgggattacaggcgtccaccaccacgcctggctgatttttgtatttttagtagagatggggtcaccatgttggccaggcaggtgtcgaactcctgactcaggtgatctaccaaccttggcctcccaaagtgttgggattacaggcgtaagccactgctcctggcctcaagtatctgttgattgccttttttcccctgaatattggccatattttcctgactctctacgtgccttgtagttttttgttgaaaatggatgattttaaataatagaatgtagcaactctggaagtcaggttctcttcccaccccggggtttgttgttgttgccacttgttgtttgtttagtgacttttctggactaattctgtaaaatctgtattttttgtcttgcgtggccactaaagtctaatacaacttagtggccagctagtgattagacagaaatccccctgaactcctggagccataaatgccccagtctttgctgagtggctctgtgtgtgtgcttgggcacacctccaacacagagccaggctgtttgtgactctcagctttcacttcccgtttgtgcagtgcgttgagctgagccacagatgagagctgagggcctcccgaggtctttcctgagccctgtacatgtgtgtggccttctagattcccaggaatatgttggagcttttcaaagccccctgaggatatctcattccccagcttaaaactttggttatcctatcatttgctccgaccattattctctgtcttagaaaactgtgatgttcaacaattacctctgattgtttttgacagacaccaccagggaaaaggctgtttgtattacatgagctcagataaagtcttttgagtgtggtctaccagaggattcccagacagatgagataagcacagtttctggagtggggcttttcaggaatgccaaccctgttctgcaccccccggggctggcaggtgctggttttcaccctgacttcaggctgagggtttcaaggctgccatagggatggctgggaatagggcaggtttcagtgccaccgagctcccgtgctgacggggattcagatgcttttctggaatgaacacttccctgattgctgcagcctttggcgagtttccagagttctgagaaagttgattctgaccatttgccgatgtcttgttgctttcgtggaggagagaattctcagagcttgtgagagtctctttgctgacatccttctctggcttcaaggacagcacttgctggaaatcaggaggcatcccctgagccccacaaggtcagcttgtggcctttgtggcctttctgttccctgctggttgttggggaactagagtgagttcctggaagtgcttctccatcatgaagtctggtttctctctgtactgtgaagtcacatctgtgacctaaacatgtctcttaattatccaaagcccagccaagttctgtctcctctgtgggtgctttttctagccatctctgaagagtcaatcttgagaaatttctcagtatgtcttcatcatggcattatgtacatatcattagcataattcactcagatggaaggcagaaagggtgggaactaacattgatcacatttatggaaacctgccttctcgtgctgggcactttatatatgttatctccctttgtggtgcaatctcatgacatgcagtcattgtccatgtttgtgggtgaggaaacaggcttaggggtgggaggctcgcctgaggccccacactgttggctggagacagcgtggggcctgagtcttgctcacagcctgaacgctgcactctgctgctccgcgtcccaggaaggaaaagctgctgcagtgggtttgtgttgccaaatacatggaggcttttttctgggtgagtgcccagcagttgattgttctgtatgtccaagaaagtcaccttagaaaagaattaggttctaaatttagaaaataattgagttacaatatttagaactcagacagcatcccttgggcttggggtcacagccccgaaggggtgattaattttgccaattgaagatcagaggggcctgtggccagagtacccactgcttaagacacaggtgagctggaaccatgagttttaaaatgtcttggccaagtttttattacaagatacaaatttatcccacacagttgcaatgcaagccttgatgaaaccccagcttgatggtgtctcctctggtgtggctgcgctgttgggaagcagctgtgcccctggagactcccggctccctgtttccaccaggtgcgtctgccgatggccccctgaagttgctgcccgagagctacttcgacgtggtggtcattgacgagtgtgcccaggccctcgaggcgagctgctggatccccctgctgaaggccagaaagtgcatcctggcgggcgatcacaagcagctgccccccaccacagtctctcacaagtaagacccctttgcctcacatgcccttctctgcccccgccctcctgcggtccttccacgctcagccaggagccccaggctcaccaggagcccctgcggtgcctcctcggtttctcggcacagctcctaccccgtcttacagcattcattcatctcaacgtcgcatctgtgagatcatgtactccccgagggtggggtcgcatcaccttcatctttgtagcttcagaactggacacagggcctggcacgtttctggtgttccgtccctgcttgttgagttgaatatcccctcatgaaccaggcaggtttgatggtagagtgccgtgagagccttgggctgggctaactggcctctgggtggatgtgggttctttagtcttcaatctgtagacacatccctggatggagggcactgggcagagactcagcaaaccatggttctgccgtgcggagacaccggagccctgatgcagtggcctggcccaggctgtcctggtggagacactggagtcctgatgcggtggcctggcccaggctgtcctggtggagacactggagccctgatgcagtggcctggcccaggctgtcttggtggagaaagtgctgcccgcccccccagcccccctctcacctctccccatactacccagcactcactgcttcagccacacaggcctcgctggcccctctgcctggaccactcctgcctgggtgtggcgggcgtgccctctctccagatgaaccctctgcatggtatcccttgactgcccttacacgaggcctgtgaacagggcctggcacgtgggctgtccttggacaagtccctgttcagaaagttgtccctgaggaatgaaacacttctgagactcctgcatcctggccctcacttccaccgggggaagattgatttcttcagatttcggttgccttttgaaacacttctctgtttcactgtgggtgtgtagaagctatgaactcggaactttcgttgttttccgaggaccggaagaagatgtgcaagaaatcctgtcgagtagaatctcatcacaggggcgtgggcagcccaggagttggcgggtatgtagagagaggtgtcaaaaatagtaattgagagtgagctttgggaggaagatgttggaaataaagatggtggaagaaagaggagtgctgaggaaaggtgctctgaaagatcgtcctggtgggagacacatggggatctagagtggaaatgttacgggatctctggggtgttgatttttctggctggaaacctctgcggccgcagcacctttgcctcagttcttgtcctgcatccaggaagaatgaggtacgcagattagtgaagggtgaagaacagttttatttagtgttagaacagctcagagtagtgggtagctcctctctgtaggcaggtcatccgtcgagtgttcagctgtcagcagaggaggccctggagagggtggctcctctctgcaggcaagtcacttggacatctctgcaggtctctgaagctctcagcagagagcatagatcctctctgccctctccgtcctctggctgtcctctcgccttctctgactgagcccagggcttttatggacctcaagagggaaggaaggatgtgccaattggtccatgggtggccatgggcgggcctggaataggtaccatgagtcctcactctggtccacaggactggcagcccagctgccagccttcaggcccttcctggccttccactgtccccttccactcaggactctgtctgcctcccgctgccattcatggccctggggcttggctccaatcccactctgagatccgagtgggtgctgggagctgagagaggccaggcagtggaagcagacacccatgaccctgcagggatggtgtgggggttgtccttcctggggcgcctgagggtgcaggctgcagagtgggagggcagctacagctgcacccaagagctcccgacccaccacctcagaagaggccaggctcctgcttgttcccggctcctgcctgcttcgtggagcaggaagcccaggtctgcagccacagatctggcggctgcagctgcacgcggaaaggcagatcctacctgttcccggctcccctaagagcaccgggagacgcagatccacagctgcagtttgggcggctgtagccccgcccttctggagcaggaggcctgggtctgtagctgtgaccctgtgtctgggctgcagcggccactctacctcagaaggggcggggctcccactggcttcatggagtgtgcagccacagccagggttccctgctgcagccggcatgatggcagcagccactgccatcagaacctccctgggagcagggaggacaggcgtgggaggacgcttattcagtggcttcttccagggagaggttctcgagatgtccttaaaggaggtcttcatcctctggaaagcctttgggtggaggaagtttggaactgtgcccttgagcagggaccctgttgtgtaggagggagtaggatggtttcgggggaagacgttgggtggcgttccctgcagagagtaggatggttttgggggaagacgttgggtggcgttccctggagagagtaggatggttttgggggaagacgttgggtggtgttccctggagagagtaggatggtttcggggaaaacattgggtggcattccctggagacagtaggatggtttcggggaaaacattgggtggcgttccctggagagagtaggatggtttcgggggaagacgttgggtggcattccctggagagagtagaatggtttcgggggaagacgttgggtggcgttccctgcagagagtaggatggtttttgggggaggacgttgggtgacgttgcgctgagtgttttgggtttgcagttggtactgatcatcgcgtcctgtcctcattttgttggaattaaaaatacgttaatcacagaggtctggtaagtttccagagggaaggtctctgaagtggagctgggtactgccccagggttttggtggggttggtgagccgtagtggtgcagagggtgggctctggcaccaggtggcccgggcaggtcctggctctgcagctcacccgggcagctgtgggctggcagcctcctctgtctcacccttcttacatgtaatatgggagtcataacagtagccacctcatgaggttgttataaggatgaagggagttaatccacatctggcacacccagcagtgcctggcgcctgggcagtgctcagccgctgcagccgttcttggtgggagtggacttgactgctcacagttggagcatgttggagtgtgttcgttccctgttatggctgtgacaaatgaccacaagcttagtggctgacaacaacagattttctgacctccagaaacgacaatctgggggtcagatgtccaaaatcagactcaccggcttaaaatcaaggtgtgggtggggttgcttcttctggaggatccaggggaaaacccatctcctggtcttttccggctcctagaggccactgcttgacttgttgccctttcctctgtctatgaagccagccgtgttacgtcttcaaatctctcccctcggtgaccttctctgactgaccctcgcatgcccccttataagacccttgggttatcacctgggtcatccagggtcgcctccccatcccaggatccttaacttcatctcagctgcagcgtccctgttgtcctgtaagggaacattcacgggccttggcgattggatgtaggtgcctttggggctgtgattcagccaaacccgccccttggttacttctgggtcagaatccaggggagagttgggtcctgaggtttggggcctgtcctcctcacttgctgtggttcacacctggactctggggctcaggcctgccttccccctttctccctcctgggcgcagggctgcgctggcaggactgtcactcagcctgatggaacgcctggctgaggagtacggcgcgagggtggtgcggacactgacggtgcagtaccgcatgcaccaggctatcatgcgctgggcctcagacaccatgtaccttgggcagctcacagcccactcttccgtggcaaggcacctcctgaggtgagtagctcggcaccacccgccgccccatccttctgccctggctaatcctctgcgtcacctgtttctacgcagcaagctaaagtgaagctttctgcatgaaagtcgactctgaggctagctttttggaagagagggtggccttgccctggagagctgggtcaggcccgctccctcccttctgatgtcctgatgtgctcattgtcctcccctacctaagccttttcctcgtgggaggggtcggttctgttgggtggggcctcagtgctgcactgtggccccctgatgtgctccctctctgcctgtgtgccagggacctcccaggtgtggctgccacagaagagacgggtgtgcccctgctcttggtggacaccgccggctgcgggctgtttgagctggaggaggaggacgaacagtcgaaagggaaccctggtgagcttgcttgcagatggccagcttttttgtttaaacatacctccagctctttaaaaataaaaggcactttaattgcctaattccgggaggagctgagagcagttgttgatggccgtgaaaaaacggagccccacactgcaagaggctgagcagcatcgttttctccagggtgagcagaccgctcctgggtgagatgggcctggcagcattttacggccttctcctgaatggtggcccagctctgcctggctggtctggtgatgggaactgtcattgctcagctgacaccaccatctccccagttccacgttgaacaggatgcacggccataggagtcaaaaggccttcattgctgatgtgaaattcaagttagctgggcatggctggtcctggggccctgggacacagatgattagctcccaggaagccacctgagtggaggatcagctggccatgatagacagaaacgtgcccgaaacacgtgttggtggtggatgcccacttggggcgaccttgtgctgctcacccgttctttctttccctccaggcgaagtccgcctcgtcagtttgcacatccaggctctggtggacgctggtgttccagcccgtgacattgctgtggtctcgccatacaacctccaggtacgagggtttccttttgtccctctacagagcagctggggctcacacaacctagagggtgaaagaaaaagggtgatttgttggctgtggtgaccgaaaagttcaggggtagggctgaccttattgtgactggatccagggcccaaatgatgtcgtcaggggcccctctgcgtgttcgtctgcccgccccaccttgccccgccctgcccggtgccccagccttctgcactggcttgtgttctggccagatttgctgggtgaccccggcagcctcaggctgacacagtccttccacgggcagccctggcggaacagcctgtccttttctggcatttcccacaggagtctcagccttgagccttgctggtctggctcaggtcgtgttcccatgcgtatctcatttggtaggaaaaatgtaccttctggagtatcgggaggatctgtggaagtggccatcataccttcctggtgtgcaggcatcacacatagggctgtctgaggctggcggctgtcataagccaaaagaaatgatcaaatgccagggacagggtgtggtattggcgtgcatgcgtgcccgtgaggagggcgaacgggaagcctttccccatggggctcctgcaggctccgcttcccaggtcctggctgtttcacagcgtgaggccctctgctgagctgaagggcagggtcttgctgcgctggcatgggtgggtgaggaaaccacagcccggctggtgtttcaggtggacctgctcagacagagccttgtgcacaggcaccctgagcttgaaatcaagtctgtcgatggcttccaaggccgagagaaggaggccgtgatactgtccttcgtcagatccaacaggaaaggtacggagccctcgccagagtcctttggggacagcacagaagtgaatttattgattgaggggcatattgggtgtctgctgggtgccacactggtttctggcagtgtgctcatggtgcaccttctgtccttagtaagttcacgtcaggcaaagcacaggcaagagagtctgcagaggctcagaggcgtgagtgtgctgtcagggagcaggtggctggggtggcagctgggggcgcagggtgggctgggaatgatcaggacatcctgccgaggaggtgaagccccctgcagcccagagctggcctttagcctccatgcacggagccgcggggtgtggtggtcgtggctgtggtttctgtgctgctgtggtgtgtgggctttcccatttgggatgagcattgttcccagaagcaggtttagtgaacgggctttgtgagacattctcagaaggcagaaagcaggtgaggcctggctagaagctatgggggaaagaagggaaggtcctggaaggtttcttgtgctttctccctggtgccagctgcagccacaccccaggcggcccctgaggctgggcttagaaggaaaggagcgacagaacccagtcgggttccccagagccccactcagtcagccgtggcagccagatgccagggcaggtgtggcatcacggtgccacgcgtggccgggcacccgtgtggatggtgggccacgcgcaggggactacacttttggtggtggttactgataagggcgtaggagcctgactgtgtttcttagtctgaaacctgcttctcactcccctctggccttttgtaggtgaagttggttttcttgctgaggaccggaggatcaacgtggctgtcacccgtgcccgacgccacgtggcggtcatctgtgactcccgtactgtcaacaaccatgcatttttgaagaccctggtggagtatttcacacagcatggggaagtacgcacggcctttgagtatcttgacgatattgtcccagaaaactattcccatgagaactcccagggttccagccacgctgccaccaagccccagggacctgctacgtccaccaggaccggaagccagcggcaggagggaggccaggaggctgcagcacctgccagacagggccggaagaagccggctgggaagtctctggcctctgaagctccatctcagcccagcctcaacggaggcagcccagagggagtggagagccaagatggcgtggaccacttccgggccatgatagtggagttcatggccagcaagaagatgcagttggagtttcctccttccctcaattcccacgacaggctgcgggtccaccaaatagccgaggagcacgggctgaggcacgacagttccggggaagggaagaggaggttcatcactgtgagcaagagggccccgcgaccccgagcagccctgggacccccagcagggaccggtggcccagcccctctccagccagtgccccctacccctgcgcagacagagcagcctcccagggagcagcgtggcccagaccagcctgatctgaggacgctgcacctggagagactgcagagggtcaggagcgcgcaggggcagcccgccagcaaggagcagcaggcctcagggcagcagaaacttccagaaaagaaaaagaaaaaagccaaaggtaagtcaactaataagaacttggggcagtgtcccctcactggggtgctggccccacttggagcccacctgccaccatcaacagaaggaagggcttcctcctggtggcaccgtgcccgtgtcattttagctttattttcagtcatgccactcccagctccgtctgggctcccctaggtcggtgatcaggtcacgggcaccttcttttcccagaccctgtgtgggactcggcaagtaggcagcactcagagcatgtctgcagcagcaggaggggcctggaagagcaaacatggatggctccctggagcccctcgggaatggagcgatcacggggtcccatgcaacatgtggccctggagggtggaggtcttgcacagcgaaagggtgcactctgcctggaagttgtcctgggcaaaatgctcagaaccacaggggctggctgagcgcaaaaccattcttgcccttgggccatgtggagtccctgggtgggctctgccccgtttgccacatcctgcattgtgcccaccccgcaggagctggctaggcgtgcagtgggagttggccaggcatacgctggcagagcgtgtagcggtcttggggaactcctgctactgccattttcctcagcaagagcatgcaggagttccagcttgcattgattcattgaattcctgaagcgaagctacaccagcacatgggtggctttgaaaggggcctcccagagcctggggctccagaggaattcactccccaaacctttgttgagcagctactgtatgccacgctttgtgctagaggacaggactgatgccacccctgcccccaggcactgacagggtagcagagggaagacacatgagctgctttttaattttttttagaattaatagagacggggtctcactctgtcactatgttgcccaggctagttttgaactcctggccgcaagcagtcctcctacctcagcctcccaaaatgctgggattacaggtgtgagccaccgtgcttagccatgaattgattttaaaaccttaaatgaggggccaggtgttgtctttccgtttgcctgagtgacgcgggtcttctccaggacatccggccacagatctgcccacggaggaggactttgaggccctggtttctgccgccgttaaggctgataacacctgcggctttgccaagtgcacagccggcgtcacaaccctgggccagttctgccagctctgcagccgccgctactgcctcagccaccacctgcccgaggtatgtcggcctcccctcctgcgatcaaacagtggggaggggtggtgggttccgtctccaggaagcagaccctgggcagacttgttccagtcggaacagttagctccttacaatctccagataccttcagaaacagaaatcagacactgactcatgatcggttttcagcacatcagggcacaagcaaacaaaatgccttatttgctgagctgcagccacgttagtgggaattctgggcagagggaattttgtcccagtgtccttgggttctgtcagtggcctaatctggtctgtttggcataggggaggtgggaggcagagcctccagcccgtcatctgagctggccatggcccggctgctgtgtcattcattccttgagccggggttgatgagaaccccctgggccaggtgtgggcgcctgtggaaagccgaggtctgaaccagccttgtctctaccctggaggatgctgggcctggtgggggacctgggtaagagaccagcatacagtaccaggtgttgagtgctctgaggaagaaaacccagggccagggtggcagcagggtcacccacccagatgcagcagtcagggtgggcttcctggaggaagtaacactggagctgagacctgtgggacagaaggtgggagctgggctgggaaggacagggccgatggcgggtgggcaggcaggctatccacccttagaacatgcataaagccccaggcccagtcagagagttgggagtagagtgtgaggcagatggctagagttgaggctgggcatgtcctggcgagctgcctggaggagtcaggcctgatctgaaggcagtggggtaccctctagggtgtcagcagggctgtgatgtcaccagtcttggctgcagtgtggattaggtaggcggaggctgggaggcagtgggaagtggccgcagggaccgtgtggtcagtcagggtggtgccatttcctgtgtgcacactcgggggctcccgccacaccagggtgcagaccaccccgccgctctcccgccaggcagcctgcagggtgaaggactgacatggcgggaggagtggccttctctgttggggcgcctgtggccccccagctctttgataggcagagctgcaggatctgcctccttgcccctgtgagcccagcagtgattcttgtgtcctccccagatccatggctgcggtgagagggctcgcgcccatgcccggcagagaatcagccgggaaggggtcctctatgccggcagcgggaccaagaacggatccctggacccagccaagagggcccagctgcagaggaggctggataagaagctgagtgagctcagcaaccagaggaccagccggaggaaggagagggggacgtgaccggccgcatccttgcacgccccgcggagctctctccatggtagcccagggcgctggcagaccatgctccgcctccaccagggccacagaggagcggaggggcctatgggggaggagcggagggccctgttggggaaggttgggtttttggaccccagggataagcttttccgatgtcacaatgtggaggaaagcacctgggggacaacagtgctcgtgcaggtggggcttgggaaatgcacgtcccttccccttactccccgccaaaacccacatcccagcctctggatcctggggaaggttccagtccctggagaatacccagggcctcaaacttgaagtcactcctccaatgtctgggacttgccagctcagcccgttaggatgagggtgctgagaggaaacaggaaacaagactgcgaatggcgctcaggcagggagcagggagtggcgtttggcttgcacgttcccatgtggccagatgctggggccactttccttctgtctgctggtgactgcagtgttccccctcctcctcaccacggggctcctgtgagtctggggggcacctctttctggcctgtgcacctctctctggcttataaaggtgcctggcctgtgccagcccctccttgttgcgcctcaccgtggggaccaggtgagccggctctcccacgtggttgtcccgggaaagctgccccacagcctcagcatcttcagcacttaccgatccagagcctcccggccttctccggtgtcctgtaccaactcttctatttaagagaacctcagatgatgtacctgagcctcagggttttgtttcagagggatataaattatttaaaaattaaatgaaaacgttgcacactgc

SEQ ID NO: 2 - DNA, 446 bp, Homo sapiens
atggactggaattggaggatcctgtttttggtggtcatagctgcgggtaggataattctcagtccccaggactaaggtgactgggtccagtaaaagagggttttatccactcctgtgtcctctccacaggtgcccagtcccaggtacagctggtgcagtctggggctgaggtgaagaagcctggggcctcagtgaaggtctcctgcaaggcttctggatacaccatcaccagctactgtatgcactgggtgcaccaggtccatgcacaagggcttgagtggatgggattggtgtgccctagtgatggcagcacaagctatgcacagaagttccaggccagagtcaccataaccagggacacatccatgagcacagcctacatggagctaagcagtctgagatctgaggacacggccatgtattactgtgtgagagacacaatgtga

SEQ ID NO: 3 - DNA, 1507 bp, Homo sapiens
gcatccccgaccagccccaaggtcttcccgctgagcctcgacagcaccccccaagatgggaacgtggtcgtcgcatgcctggtccagggcttcttcccccaggagccactcagtgtgacctggagcgaaagcggacagaacgtgaccgccagaaacttcccacctagccaggatgcctccggggacctgtacaccacgagcagccagctgaccctgccggccacacagtgcccagacggcaagtccgtgacatgccacgtgaagcactacacgaattccagccaggatgtgactgtgccctgccgaggtcagagggcaggctggggagtggggcggggccaccccgtcctgccctgacactgcgcctgcacccgtgttccccacagggagccgccccttcactcacaccagagtggaccgcgggccgagccccaggaggtggtggtggacaggccaggaggggcgaggcgggggcacggggaagggcgttctgaccagctcaggccatctctccactccagttcccccacctcccccatgctgccacccccgactgtcgctgcaccgaccggccctcgaggacctgctcttaggttcagaagcgaacctcacgtgcacactgaccggcctgagagatgcctctggtgccaccttcacctggacgccctcaagtgggaagagcgctgttcaaggaccacctgagcgtgacctctgtggctgctacagcgtgtccagtgtcctgcctggctgtgcccagccatggaaccatggggagaccttcacctgcactgctgcccaccccgagttgaagaccccactaaccgccaacatcacaaaatccggtgggtccagaccctgctcggggccctgctcagtgctctggtttgcaaagcatattcccggcctgcctcctccctcccaatcctgggctccagtgctcatgccaagtacagagggaaactgaggcaggctgaggggccaggacacagcccagggtgcccaccagagcagaggggctctctcatcccctgcccagccccctgacctggctctctaccctccaggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccacctacgctgtaaccagcatactgcgcgtggcagctgaggactggaagaagggggagaccttctcctgcatggtgggccacgaggccctgccgctggccttcacacagaagaccatcgaccgcatggcgggtaaacccacccacatcaatgtgtctgttgtcatggcggaggcggatggcacctgctactgagccgcccgcctgtccccacccctgaataaactccatgctcccccaagc

SEQ ID NO: 4 - DNA, 3842 bp, Homo sapiens
gcctccacacagagcccatccgtcttccccttgacccgctgctgcaaaaacattccctccaatgccacctccgtgactctgggctgcctggccacgggctacttcccggagccggtgatggtgacctgggacacaggctccctcaacgggacaactatgaccttaccagccaccaccctcacgctctctggtcactatgccaccatcagcttgctgaccgtctcgggtgcgtgggccaagcagatgttcacctgccgtgtggcacacactccatcgtccacagactgggtcgacaacaaaaccttcagcggtaagagagggccaagctcagagaccacagttcccaggagtgccaggctgagggctggcagagtgggcaggggttgagggggtgggtgggctcaaacgtgggaacacccagcatgcctggggacccgggccaggacgcgggggcaagaggagggcacacagagctcagagaggccaacaaccctcatgaccaccagctctcccccagtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcaggtacgttcccacctgccctggtggccgccacggaggccagagaagaggggcgggtgggcctcacacagccctccggtgtaccacagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggtgagccatgggcaggccggggtcgtgggggaagggagggagcgagtgagcggggcccgggctgaccccacgtctggccacaggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcaagcccctcacagaccgtccagcgagcggtgtctgtaaatcccggtaaatgacgtactcctgcctccctccctcccagggctccatccagctgtgcagtggggaggactggccagaccttctgtccactgttgcaatgaccccaggaagctacccccaataaactgtgcctgctcagagccccaggtacacccattcttgggagcgggcagggctgtgggcaggtgcatcttggcacagaggaatgggccccccaggaggggcagtgggaggaggtgggcagggctgagtccccccaggagaggcggtgggaggaggtgggcagggctgaggtgccactcatccatctgccttcgtgtcagggttatttgtcaaacagcatatctgcagggactcatcacagctaccccgggccctctctgcccccactctgggtctaccccctccaaggagtccaaagacccaggggaggtcctcagggaaggggcaagggagcccccacagccctctctcttgggggcttggcttctacccccctggacaggagcccctgcacccccaggtatagatgggcacacaggcccctccaggtggaaaaacagccctaagtgaaacccccacacagacacacacgacccgacagccctcgcccaagtctgtgccactggcgttcgcctctctgccctgtcccgccttgccgagtcctggccccagcaccggggccggtggagccgagcccactcacaccccgcagcctccgccaccctgccctgtgggcacaccaggcccaggtcagcagccaggccccctctcctactgccccccaccgccccttggtccatcctgaatcggcccccaggggatcgccagcctcacacacccagtctcgcccactcacgcctcactcaaggcacagctgtgcacacactaggccccatagcaactccacagcaccctgtaccaccaccagggcgccatagacaccccacacgtggtcacacgtggcccacactccgcctctcacgctgcctccagcgaggctactgccaagcccttcctctgagccatacctgggccgctggatcccagagagaaatggagaggccctcacgtggtgtcctccagtccaaccctccctgtcaccctgtcagcagcagcaccccacagccaaacacaggatggatgcgtgggctccatcccccactcacccacaccggaaccccagagcaggctacgtgcccctcacagacctcaaacccacatgtgcatctgacaccccagatccaaacgctccccccggtcatgcacaccaagggcacagcacccaccaaatccacacggaaacacgggcaccgggcaccccatgagcacaaagcccctccatgtctgaagacagtccctgcacaccgtcacagccatacattcagcttcactctcacgtcccagcccacctgcacccagctctgggcctggagcagcagaaagaggtgtgagggcccgaggcgggacctgcacctgctgatgacccgggaccagcaggcagctcacggtgttggggaagggagtggagggcacccagggcaggagccagagggaccaggctggtgggcggggccgggccggggtagggccaggaggcagctctggacacccacaggcctgggctcatagtccacaccaggacagcccctcagagcacccatgcagtgagtcccaggtcttgggagccaggccgcagagctcacgcatccttccgagggccctgagtgaggcggccactgctgtgccgaggggttgggtccttctctggggagggcgtggggtctagagaggcggagtggaggtaaccagaggtcaggagagaagccgtaaggaacagagggaaaatggggccagagtcggggcgcagggacgagaggtcaggagtggtcggcctggctctgggccgttgactgactcgggacctgggtgcccaccctcagggctggctggcggctccgcgcagtcccagagggccccggatagggtgctctgccactccggacagcagcagggactgccgagagcagcaggaggctctgtcccccacccccgctgccactgtggagccgggagggctgactggccaggtcccccagagctggacgtgtgcgtggaggaggccgagggcgaggcgccgtggacgtggaccggcctctgcatcttcgccgcactcttcctgctcagcgtgag

SEQ ID NO: 5 - DNA, 1717 bp, Homo sapiens
gcttccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttggtgagaggccagcacagggagggagggtgtctgctggaagccaggctcagccctcctgcctggacgcaccccggctgtgcagccccagcccagggcagcaaggcaggccccatctgtctcctcacccggaggcctctgaccaccccactcatgctcagggagagggtcttctggatttttccaccaggctccgggcagccacaggctggatgcccctaccccaggccctgcgcatacaggggcaggtgctgcgctcagacctgccaagagccatatccgggaggaccctgcccctgacctaagcccaccccaaaggccaaactctccactccctcagctcagacaccttctctcctcccagatctgagtaactcccaatcttctctctgcagagtccaaatatggtcccccatgcccatcatgcccaggtaagccaacccaggcctcgccctccagctcaaggcgggacaggtgccctagagtagcctgcatccagggacaggccccagccgggtgctgacgcatccacctccatctcttcctcagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaaggtgggacccacggggtgcgagggccacatggacagaggtcagctcggcccaccctctgccctgggagtgaccgctgtgccaacctctgtccctacagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagagcctctccctgtctctgggtaaatgagtgccagggccggcaagcccccgctccccgggctctcggggtcgcgcgaggatgcttggcacgtaccccgtgtacatacttcccgggcgcccagcatggaaataaagcacccagcgctgccctggg

SEQ ID NO: 6 - DNA, 1739 bp, Homo sapiens
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgccctccagcaacttcggcacccagacctacacctgcaacgtagatcacaagcccagcaacaccaaggtggacaagacagttggtgagaggccagctcagggagggagggtgtctgctggaagccaggctcagccctcctgcctggacgcaccccggctgtgcagccccagcccagggcagcaaggcaggccccatctgtctcctcacccggaggcctctgcccgccccactcatgctcagggagagggtcttctggctttttccaccaggctccaggcaggcacaggctgggtgcccctaccccaggcccttcacacacaggggcaggtgcttggctcagacctgccaaaagccatatccgggaggaccctgcccctgacctaagccgaccccaaaggccaaactgtccactccctcagctcggacaccttctctcctcccagatccgagtaactcccaatcttctctctgcagagcgcaaatgttgtgtcgagtgcccaccgtgcccaggtaagccagcccaggcctcgccctccagctcaaggcgggacaggtgccctagagtagcctgcatccagggacagaccccagctgggtgctgacacgtccacctccatctcttcctcagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaaggtgggacccgcggggtatgagggccacatggacagaggccggctcggcccaccctctgccctgggagtgaccgctgtgccaacctctgtccctacagggcagccccgagaaccacaggtgtacaccctgcccccatcccgggaggagatgaccaagaaccaggtcagcctgacctgcctggtcaaaggcttctaccccagcgacatctccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgagtgccacggccggcaagcccccgctccccaggctctcggggtcgcgcgaggatgcttggcacgtaccccgtctacatacttcccgggcacccagcatggaaataaagcacccagcgctgccctgggcccctgcgagactgtgatggttctt

SEQ ID NO: 7 - DNA, 1546 bp, Homo sapiens
gcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccaggtcagagggcaggctggggagtggggcggggccaccccgtcgtgccctgacactgcgcctgcacccgtgttccccacagggagccgccccttcactcacaccagagtggaccgcgggccgagccccaggaggtggtggtggacaggccaggaggggcgaggcgggggcatggggaagtatgtgctgaccagctcaggccatctctccactccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggtgggtccagaccctgctcggggccctgctcagtgctctggtttgcaaagcatattcctggcctgcctcctccctcccaatcctgggctccagtgctcatgccaagtacagagggaaactgaggcaggctgaggggccaggacacagcccagggtgcccaccagagcagaggggctctctcatcccctgcccagccccctgacctggctctctaccctccaggaaacacattccggcccgaggtccacctgctgccgccgccgtcggaggagctggccctgaacgagctggtgacgctgacgtgcctggcacgcggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaagc

SEQ ID NO: 8 - DNA, 6729 bp, Homo sapiens
gcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttggtgagaggccagcacagggagggagggtgtctgctggaagccaggctcagcgctcctgcctggacgcatcccggctatgcagccccagtccagggcagcaaggcaggccccgtctgcctcttcacccggaggcctctgcccgccccactcatgctcagggagagggtcttctggctttttccccaggctctgggcaggcacaggctaggtgcccctaacccaggccctgcacacaaaggggcaggtgctgggctcagacctgccaagagccatatccgggaggaccctgcccctgacctaagcccaccccaaaggccaaactctccactccctcagctcggacaccttctctcctcccagattccagtaactcccaatcttctctctgcagagcccaaatcttgtgacaaaactcacacatgcccaccgtgcccaggtaagccagcccaggcctcgccctccagctcaaggcgggacaggtgccctagagtagcctgcatccagggacaggccccagccgggtgctgacacgtccacctccatctcttcctcagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaaggtgggacccgtggggtgcgagggccacatggacagaggccggctcggcccaccctctgccctgagagtgaccgctgtaccaacctctgtccctacagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgagtgccacggccggcaagcccccgctccccaggctctcggggtcgcgcgaggatgcttggcacgtaccccgtgtacatacttcccaggcacccagcatggaaataaagcacccagcgcttccctgggcccctgcgagactgtgatggttctttccacgggtcaggccgagtctgaggcctgagtggcatgagggaggcagagtgggtcccactgtccccacactggcccaggctgtgcaggtgtgcctgggccgcctagggtggggctcagccaggggctgccctcggcagggtgggggatttgccagcgtggccctccctccagcagcagctgccctgggctgggccacgagaagccctaggagcccctggggacagacacacagcccctgcctctgtaggagactgtcctgttctgtgagcgccctgtcctccgacccgcatgcccactcgggggcatgcctagtccatgtgcgtagggacaggccctccctcacccatctacccccacggcactaacccctggcagccctgcccagcctcgcacccgcatggggacacaaccgactccggggacatgcactctcgggccctgtggagagactggtccagatgcccacacacacactcagcccagacccgttcaacaaaccccgcactgaggttggccggccacacggccaccacacacacacgtgcacgcctcacacacggagcctcacccgggcgaaccgcacagcacccagaccagagcaaggtcctcgcacacgtgaacactcctcggacacaggcccccacgagccccacgcggcacctcaaggcccacgagccgctcggcagcttctccacatgctgacctgctcagacaaacccagccctcctctcacaaggtgcccctgcagccgccacacacacacaggggatcacacaccacgtcacgtccctggccctggcccacttcccagtgccgcccttccctgcagctggggtcacatgaggtgtgggcttcaccatcctcctgccctctgggcctcagggagggacacgggagacggggagcgggtcctgctgagggccaggtcgctatctagggccgggtgtctggctgagccccggggccaaagctggtgcccagggcgggcagctgtggggagctgacctcaggacattgttggcccatcccggccgggccctacatcctgggtcctgccacagagggaatcacccccagaggcccaagcccagggggacacagcactgaccacccccttcctgtccagagctgcaactggaggagagctgtgcggaggcgcaggacggggagctggacgggctgtggacgaccatcaccatcttcatcacactcttcctgttaagcgtgtgctacagtgccaccgtcaccttcttcaaggtcggccgcacgttgtccccagctgtccttgacattgtcccccatgctgtcacaaactgtctctgacactgtcccacaggctgtccccacctgtccctgacgctgtcccccatgctctcacaaactgtccctgacattgtccccaatgctgcccccacctgtccaacagtgtcccccaggctctccccacatgtccccgacactgtcccccatgctgtccccatctgtccccaacactgtcccccaccctgtccccctttgtccccaacactgtcccccacagtttccacctgtccctgacactgtcccccatgctttccccacctgtccctgacaccatcccccactctgtcccctatagttcctggccctgtcccccacgctgtcccctacagtacctggcactgtcccccatgctgtcccctcctgtatgaaaccctgtcccacatgctgtccccacctgtccgtgacaatatcccccacactgtccccacctgtccccgacactctcctccacgttgttcttacctaaacccgacactttcctccatgctgtccccacccatctccgacactgtaccccacgttgtccccacctgtcctcaacactgtcccccatgctgtccccacctgtccccaacactctcctccatgctgtccccacctgtccctgatattgtcccccatgcagtctccacctgtccccaatgctgtcccccaggctgtacctaccagtacaacactgtcccccatgctgtccccacctgtccctgacactgtcccccacgctgtcccctcctgtccccgacactgtcccccacactgtccccacctgtccccaacactatcctccatgctgtcccctcctgtccccacctgtcccctacactgtcccccatgctgtccccaccagtccccaaaactttcctccacactgtccccacctgtccccaacactgtcccccacgctatcccccctgtccccgacaatgtccccactgtttcctcctgttccctcctatccctgacactgtccgccatgctgtccccacctgtccctgacactgtctcccactctgtcccctataatccctgacactgtcccccacgccgtcccctcccgtatgcaccactgtcccccaagctgtccccacctgtcctcaacacagtcccccatgctgtccccacctgtccccaacactctcctccatgtccccacctgtccctgatattgtcccccatgcagtccccacctgtccccgatgctgtcccccgggctgtacctaccagtccaacactgtcccccacactctccccacctgtccctgatactgtcccccatgctgtccccacctgtcccggacactgttctccacgctctcccctcctgtccctgacactgtcccccacactgtccccacctgtccccaacactatcctccatcctgtcccaacctgtctcctacactgtcccccatgctgtccccaccagtccccaacactgtcctccatgctgtcccccatgtccccaacactgtcccccatgctatctcccctgtccctgacaatgtccccactgtttcctgtcccctcctatccctgacactgtcccccatgctgtccccacctgtcccccacatggtctccaccggtccctgacactgtctcccactctgtcccctataatccctgacactgtcccccacaccgtcccctcctgtatgcaccactgtcccccatgctgtccccacctgtccctgatgctgtcctccacacagtccccacctctccctgacactgtccccatctctccccaacactctcctccatgctgtccttaactgtccccaacactcttccacactctgtctccacctgtccctgacactgtcccccacactgtcctcacctgtgtctgacactgtcccccacgctgtccccacctgtccctgacgctgtcttctgtgctgtccacatgctgttggtgccctggctctgctctctatcaccaagcctcagagcaggcagtggtgaggccatggcacctgggtggcatgaggggccggatgggcctcaggggcagggctgtggcctgcgtggactgacgggtgggtgggccttgggggcagagaggtggcctcagtgccctgaggggtgggtggggctcgggggcagggctgtggcctcgctcacccctgtgctgtgccttgcctacaggtgaagtggatcttctcctcggtggtggacctgaagcagaccatcatccccgactacaggaacatgatcggacagggggcctagggccaccctctgcggggtgtccagggccgcccagaccccacacaccagccatgggccatgctcagccaccacccaggccacacctgcccccgacctcaccgccctcaaccccatgactctctggcctcgcagttgccctctgaccctgacacacctgacacgccccccttccagaccctgtgcatagcaggtctaccccagacctccgctgcttggtgcatgcagggcactgggggccaggtgtcccctcagcaggacgtccttgccctccggaccacaaggtgctcacacaaaaggaggcagtgaccggtatcccaggcccccacccaggcaggacctcgccctggagccaaccccgtccacgccagcctcctgaacacaggcgtggtttccagatggtgagtgggagcgtcagccgccaaggtagggaagccacagcaccatcaggccctgttggggaggcttccgagagctgcgaaggctcactcagacggccttcctcccagcccgcagccagccagcctccattccgggcactcccgtgaactcctgacatgaggaatgaggttgttctgatttcaagcaaagaacgctgctctctggctcctgggaacagtctcagtgccagcaccaccccttggctgcctgcccacactgctggattctcgggtggaactggacccgcagggacagccagccccagagtccgcactggggagagaaggggccaggcccaggacactgccacctcccacccactccagtccaccgagatcactcagagaagagcctgggccatgtggccgctgcaggagccccacagtgcaagggtgaggatagcccaaggaagggctgggcatctgcccagacaggcctcccagagaaggctggtgaccaggtcccaggcgggcaagactcagccttggtggggcctgaggacagaggaggcccaggagcatcggggagagaggtggagggacaccgggagagccaggagcgtggacacagccagaactcatcacagaggctggcgtccagccccgggtcacgtgcagcaggaacaagcagccactctgggggcaccaggtggagaggcaagacgacaaagagggtgcccgtgttcttgcgaaagcagggctgctggccacgagtgctggacagaggcccccacgctctgctgcccccatcacgccgttccgtgactgtcacgcagaatctgcagacaggaagggagactcgagcgggagtgcggccagcgcctgcctcggccgtcagggaggactcctgggctcactcgaaggaggtgccaccatttcagctttggtagcttttcttcttcttttaaattttctaaagctcattaattgtctttgatgtttcttttgtgatgacaataaaatatcctttttaagtcttgta

SEQ ID NO: 9 - DNA, 2304 bp, Homo sapiens
cttccaccaagggcccatcggtcttccccctggcgccctgctccaggagcacctctgggggcacagcggccctgggctgcctggtcaaggactacttcccagaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttggtgagaggccagcgcagggagggagggtgtctgctggaagccaggctcagccctcctgcctggacgcatcccggctgtgcagtcccagcccagggcaccaaggcaggccccgtctgactcctcacccggaggcctctgcccgccccactcatgctcagggagagggtcttctggctttttccaccaggctccgggcaggcacaggctggatgcccctaccccaggcccttcacacacaggggcaggtgctgcgctcagagctgccaagagccatatccaggaggaccctgcccctgacctaagcccaccccaaaggccaaactctctactcactcagctcagataccttctctcttcccagatctgagtaactcccaatcttctctctgcagagctcaaaaccccacttggtgacacaactcacacatgcccacggtgcccaggtaagccagcccaggcctcgccctccagctcaaggcgggacaagagccctagagtggcctgagtccagggacaggccccagcagggtgctgacgcatccacctccatcccagatccccgtaactcccaatcttctctctgcagagcccaaatcttgtgacacacctcccccgtgcccacggtgcccaggtaagccagcccaggcctcgccctccagctcaaggcaggacaagagccctagagtggcctgagtccagggacaggccccagcagggtgctgacgcgtccacctccatcccagatccccgtaactcccaatcttctctctgcagagcccaaatcttgtgacacacctcccccatgcccacggtgcccaggtaagccagcccaggcctcgccctccagctcaaggcgggacaagagccctagagtggcctgagtccagggacaggccccagcagggtgctgacgcatccacctccatcccagatccccgtaactcccaatcttctctctgcagagcccaaatcttgtgacacacctcccccgtgcccaaggtgcccaggtaagccagcccaggcctcgccctccagctcaaggcaggacaggtgccctagagtggcctgcatccagggacaggtcccagtcgggtgctgacacatctgcctccatctcttcctcagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggtgggacccgcggggtatgagggccacatggacagaggccagcttgacccaccctctgccctgggagtgaccgctgtgccaacctctgtccctacaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgagtgcgacggccggcaagcccccgctccccgggctctcggggtcgcgcgaggatgcttggcacgtaccccgtgtacatacttcccgggcacccagcatggaaataaagcacccagcgctgccctgggcccctgcga

SEQ ID NO: 10 - DNA, 8912 bp, Homo sapiens
cacccaccaaggctccggatgtgttccccatcatatcagggtgcagacacccaaaggataacagccctgtggtcctggcatgcttgataactgggtaccacccaacgtccgtgactgtcacctggtacatggggacacagagccagccccagagaaccttccctgagatacaaagacgggacagctactacatgacaagcagccagctctccacccccctccagcagtggcgccaaggcgagtacaaatgcgtggtccagcacaccgccagcaagagtaagaaggagatcttccgctggccaggtaggtcgcaccggagatcacccagaagggccccccaggacccccagcaccttccactcagggcctgaccacaaagacagaagcaagggctgggctgtgaggcaacccccacctccccctcagagcacgttcctcccccttcaccctgtatccacccctccggaccctccccatctcagtccctccgctccctctctctgaggcccatctcccaatacccagatcactttccttccagacccttccctcagtgtgcacggaggcagcttgcccagcaaaggtgactgtctagtgggcttcccacagccaagctcccaccccatgctgcggcccttcccttcttcctgcttggctgcctgtgccccccacctgcctgtccacaacccagcctctggtacatccatgccctctgccctcagcctcacctgcacttttccttggatttcagagtctccaaaggcacaggcctcctcagtgcccactgcacaaccccaagcagagggcagcctcgccaaggcaaccacagccccagccaccacccgtaacacaggtgagaagccccttccctgcacactccacccccacccacctgctcattcctcagccgcctcctccaggcagcccttcataactccttgtctgagtctccaagtcacactttggtaaggagagggacactgaacggacctctaacaaacacctactgccagccagccccagtctgggggccagcagatgccaaacagccagcagactcccagagcagacctgggccggctccctggcccatggacccagctctgcctcgctgagctgaggcatgggctctcagcgcagcctcacatagagccaccctgccgaggcagtccggcttgcagactcacaggtcacttgggccgcagcagcccctccccgtgaccctcgcctcccgcccgccccagcctggctctctccaagtgttggatcttggtggccagcctgcttctcaccctcaccctgcctgccacctcagaatggcaggggaaagagggccctcaccaagaactttatctgaggagtctgaggcttgtgactctgacctgcctgagatgtccatgtggccggggggacgggttcagtgttcgggagaactcgggtacgtgcctgactttctctgagtagggcaggaagctgttaggagaagcagcagtgaggtgggctggaccaacaggcagaatgactgtccctcagccaccctctgggatgtgggtcaagctctgacaaaggcatggcacagccatggtggcccctgcttggatgagtggccacggtgccctcaccctgggccagaatctgcctccactctgcaggtgcagaaacacgacattcccgtctctaaacacacctagctcctaggcttggggtgggcctatcaaatgcagggagatggacacagcacaagggccagagcttcccatgagaaaggtgagggcagctgctccctgacccgggcatctgcacttgtccctctccaccctcctcatgggcagtggagactcagcaacaaaacaagttgagtgcattagcagccagctctggagccaagtcactcaccccacggccttggctgctggtggaggggccttcccctgggcagcctccaagaagacggccaagtgctcttactcagaccacggcgctgcttcctggcacctcgatttcccacaacaacatggggtgcagacaggctagggccccctgccctggggcctggacggcatccagttaaagatgacccttcacgggcggtgcctgaggtgtgctgacctcagcagctaagccctcaggtctggtctgcactgccccacctggaggacccaactgacccagacacagccagggttatggcatgaccccgtggacggtgacccacaggccagatgcagccaggggctgttttgtgtggcctagaaatgtctttacagttgtagtgggatggaggaggaagaggaagagaggaggggagagaaaagcagggaaggggaaaaagaggagttcaatgcaaccccaaaagccagaacagttttgagctgaaagaacaaggcaggaaacatcccagtacctgacttcaaaacatactataaagcagttgtaatcaaaacaggatcataaaaacagacacacagacccatggaacagaaaagcgagcccagaaataaatctacatgcttgcagtccattgattttcaacaaaggcaccaggaaaacacaatggggagaggacagtttcctcaataaatagtgctggggaaactggatatccatgtgcagactaatgaaactacacaaaaatcaattgaaaacagtctaggccaggcgcggtggctcatgccggtaatcccagcactttgggaggccgagacaggcggatcacctgaggtcaggagttcgagaccagcttggccaacatggcgaaacccggtctccactaaaaatacaaaaattagcacatggtggcctacgtctgttatcccagcttttcaggaggctgaggcaggagaatcgcttgaatccgggaggtgaaggttgcagggagccaagattgcgccactgcattccagcctgggcaatggagcgagactgtctcaaaaaaaaaaaaaaaaagaaaagaaaacagtctaaaggtttaactgaacagataaagctactagaagaaaacatagggggaaaactccatgacattagtctgagcaacgatttttggatatgatcccaaaagctcaggcagcactagtcacaaaagccaagatacagaaccaacctaagcacccctcagcagatgcacaggtaaagaaaatgtggtacgtatggggcacaatggaatacgattcagcctttaaaaacagtgaaattctgtcattggcaacaatgtagatgaacctgaaggacacttatgctaagtgaaataagccaggcacagaaggagcaatactgcatgattgcacttacatctggcaggttaaaaaggcaaactcttagaggcagacagtagagaggtggtgccagggagcgggcactggtggctggggagatgttggtcaaagggcacaaaactgcagttgggaggaattagttcaggacatcccttgtacatggggacagtggttagtaacaacggattgtatccttgaaaaccgctaagaaaatagtttttaagtgttcttgacacaaaaagtgacacgtatgtgagatactgcatggtcattagctggatttagccattccacaatgtacacatatttcaaacattgtgttgtatatgataaacatgtataatttttgtcaattaaaaatttttaggaagaggaggagaagagaagaagaaggagaaggagaaagaggaacaagaagagagagagacaaagacaccaggttttttctgacccctgggctatcaaaacacctattgcccaataactagttggccgttggtgccctaaactattgaagcgattgctgttatgtggatgggccccggacacttagaaactcgtgacccctgaggacccccacgaggacagtcagggtccccccgaactcagggagcactgaggaaggagctcttagaggcgtggggcccctcaggcccctcagagggctctgccacatgggtcaggggcaggctgagggggagtcccaggctccatgcccagcctctgtgcctctgaccagggtgtcccccacaccgcctcctccccagtgccctccactggccacacctggccagaagctggggagaggagagcacagtggttaagtcagtccctgcagggagacggcaccagaaaaacctggcctgtggatgagtcccggcctggcagccacagagcagagagctctagaagcaacgaaggcccgagtctgctcagggaagagcgggcagcagccccagggccggacagtgaccaagagtggcaccgcccatggctcaacgggtctttgcccacagatcccccagcccctggagacagggtctgtgtgcctggccgtgcaggcaggcaccacactcagggggaggccactgtggagctctgtgcagagccccgggcgggagcctactgctcccgaaggtccggccacagctgctctcgtttgctctcccctgcagagtgtccgagccacacccagcctcttggcgtctacctgctaacccctgcagtgcaggacctgtggctccgggacaaagccaccttcacctgcttcgtggtgggcagtgacctgaaggatgctcacctgacctgggaggtggccgggaaggtccccacagggggcgtggaggaagggctgctggagcggcacagcaacggctcccagagccagcacagccgtctgaccctgcccaggtccttgtggaacgcggggacctccgtcacctgcacactgaaccatcccagcctcccaccccagaggttgatggcgctgagagaacccggtgagcctggctcccaggtggggagacgagggtgcccacagcctgctgacccctacgcctgccccagggccatgaccccagctgggccccagcagcaccggtcatcctccacaggaaaggagaagggaggcaccagcaccctggccggccccacttctctcccagtgcccccgtggccagaggctgacagcctcccccacctccccgcagctgcgcaggcacccgtcaagctttccctgaacctgctggcctcgtctgaccctcccgaggcggcctcgtggctcctgtgtgaggtgtctggcttctcgccccccaacatcctcctgatgtggctggaggaccagcgtgaggtgaacacttctgggtttgcccccgcacgcccccctccacagcccgggagcaccacgttctgggcctggagtgtgctgcgtgtcccagccccgcccagccctcagccagccacctacacgtgtgtggtcagccacgaggactcccggactctgctcaacgccagccggagcctagaagtcagctgtgagtcacccccaggcccagggttgggacggggactctgaggggggccataaggagctggaatccatactaggcaggggtgggcactgggcaggggcggggctaggctgtcctgggcacacaggccccttctcggtgtccggcaggagcacagacttcccagtactcctgggccatggatgtcccagcgtccatccttgctgtccacaccacgtgctggcccaggctggctggcacagtgtaagaggtggatacaacccctcgccgtgccctgaggagtggcggtttcctcccaagacattccccacggctgggtgctgggcacaggccttccctggtgtgaccgtgaatgtggtcaccctgaacagctgccctctctggggacatctgactgtccaagaccacagtcagcacctctgggagccagaggggtctccagagacccccagatgtcaggcttgggctcagtgcccagcgaaaggtcagccccacacatgcccataatgggcgcccacccagagtgacagcccccagcctcctgccaggcccacccttttccgcccccttgaggcatggcacacagaccagtgcgcccactgcccgagcatggccccagtgggatgtggtggccacgaggggctgtacacacagcaggaggctgtccgccctgctcagggcctgctgcctatgccccagctgtccaaccaagggaggcatggaagggcccctggtgtaagctggagccaggcacccaggcccccggccaccctgcagagccaaggaaaggaagacacccaagtcaacaaggggcagggctgagggctgtcccaggctcttttggcccgaggggctgccagcagccctgacccggcatgggccttccccaaaagcgaccctgtgaggtggcctcacagagaaccccctctgaggacagtgtctgaccctgcctgcctcacacagatgggccccacagcagtgggcaacctggggggcagcagcccaacctgaccctgcagggactgccccctgcagcagcagctgcttctcagtcccccaacctccctgtccccgccagagggtcttccccgaagctgcagccccaacccatggctgcccacctggaaccgggactccctgtccactgccccctccccttcggggccccatctgtgctggggcccaggttcggcctacagattcccatcattgccatggcctcctgaccttgcctatccacccccaaccaccggctccatgctgaccctcccccaggctcccacgcccagctggccggccatccccaggcacagacagtctgggatctcacaggttagcctggaccatccacctggccagacctgggagaggctggaagctgccctgccaccatgctccagggccccaggttgcagtactatggggtgagggtgtgtgtgcacacctgtgtgtacctaggatatccgagtgtacccttgtgcccccaagcacaagtctccctcccaggcagtgaggcccagatggtgcagtggttagagctgaggcttatcccacagagaaccctggcgccttggtcaaggaagcccctatgcctttcttgcctcgatttcccctcttgtctgctgagccagcaggggccacgtcctgggctgctgtgaggaggaagcaagttggtgctaggaggggctcctgtgtgtgcatgggcgggaggggtgcaggtatctgagcaccccggtctccacttgagagagcagggcaggagctccctgacccacccagactacacacgctgtgtccacgtgtctcccattatctgtggcagaggatccggcttctttctcaatttccagttcttcacaaagcaatgcctttgtaaaatgcaataagaaatactagaaaaatgatatgaacagaaagacacgccgattttttgttattagatgtaacagaccatggccccatgaaatgatcccggaccagatccgtccacacccgccactcagcagctctggccgagctcacagtacaaccacaataaactcttgttgaatgaactctaggaagtctgtgacgtggctggttcttgtcaatgcttcctgcctgcccacaggctcttcctcgtggatggggctgtgcttgccacggaagcgcgtttttcccggcctaggcttgccttgggccccactgccgtctccagctggagatgaccttctatacacacatttgctcatgacagacccttgcttagcccccttccatggctccctcctgctgctgggataaaatcaccttgcctggatatcccctcctgggcccctttccaccctccttagtcagcacccccagttcagggcacctgctttccccgctgcggagaagccactctctccttgctgcccggctgtgtcttgccttccacaccttgtcacagtggccacttcctaaggaaggcctccctgtgtgcaggtgtgcagaagtgccccagcctcccgtcacctttgtcacgggagcccaatccatgagagtctatggttctgtctgtctgccccactcagggcagcgacaagtccaggcggggaggacacagtaggcagagatttgtcgaggggacatatgagcaagagggtgaggctgggagctccctggagataaccacgcctcctgggaagactcgccgtcatttcagctccacgctgtgcgggggtgggtggaggggtagcctggccctcatgaccagggagcttctcactcagcccctgttcctccccagacctggccatgacccccctgatccctcagagcaaggatgagaacagcgatgactacacgacctttgatgatgtgggcagcctgtggaccgccctgtccacgtttgtggccctcttcatcctcaccctcctctacagcggcattgtcactttcatcaaggtcaggggagcggccaggctctcagtgaccctcggggtgggtgtggggcaaggtgcccttccaggggacatgccagagctggtccagggatcctggaccaggcagaggcagggctgagggagcctggaggacatgcaggccctctgtggcctgtggacactgtcgaaggccctcttgaccctgtggataaaggacaacaccccctcccctgctcctctgtctcccctgcccctccacccctcaggcttctagccccctgtctgaccccaggggctgtctttcaggtgaagtagccccagaagagcaggacgccctgtacctgcagagaagggaagcagcctctgtacctcatctgtggctaccagagagcagaaaggacccaccctggactcttctgtgtgcaggaagatgcgccagcccctgcccccggctcccctctgtccgccacagaatccagtcttctagaccagggggacgggcacccatcactccgcaggcgaatcagagcccccctgccccggccctaacccctgtgcctccttcccgtgcttcccccagagccagctacacccctgccccggccctaacccccatgcctccttcctgtgcttcccccagagccagctagtcccacctgcagcccgctggcctccccataaacacgctttggttcatttca

SEQ ID NO: 11 - DNA, 1975 bp, Homo sapiens
gggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttccaggtgagggccgggcccagccaccgggacagagagggagccgaagggggcgggagtggcgggcaccgggctgacacgtgtccctcactgcagtgattgccgagctgcctcccaaagtgagcgtcttcgtcccaccccgcgacggcttcttcggcaacccccgcaagtccaagctcatctgccaggccacgggtttcagtccccggcagattcaggtgtcctggctgcgcgaggggaagcaggtggggtctggcgtcaccacggaccaggtgcaggctgaggccaaagagtctgggcccacgacctacaaggtgaccagcacactgaccatcaaagagagcgactggctcagccagagcatgttcacctgccgcgtggatcacaggggcctgaccttccagcagaatgcgtcctccatgtgtggccccggtgagtgacctgtccccaggggcagcacccaccgacacacaggggtccactcgggtctggcattcgccaccccggatgcagccatctactccctgagccttggcttcccagagcggccaagggcaggggctcgggcggcaggacccctgggctcggcagaggcagttgctactctttgggtgggaaccatgcctccgcccacatccacacctgccccacctctgactcccttctcttgactccagatcaagacacagccatccgggtcttcgccatccccccatcctttgccagcatcttcctcaccaagtccaccaagttgacctgcctggtcacagacctgaccacctatgacagcgtgaccatctcctggacccgccagaatggcgaagctgtgaaaacccacaccaacatctccgagagccaccccaatgccactttcagcgccgtgggtgaggccagcatctgcgaggatgactggaattccggggagaggttcacgtgcaccgtgacccacacagacctgccctcgccactgaagcagaccatctcccggcccaagggtaggccccactcttgcccctcttcctgcactccctgggacctcccttggcctctggggcatggtggaaagcacccctcactcccccgttgtctgggcaactggggaaaaggggactcaaccccagcccacaggctggtccccccactgccccgccctcaccaccatctctgttcacaggggtggccctgcacaggcccgatgtctacttgctgccaccagcccgggagcagctgaacctgcgggagtcggccaccatcacgtgcctggtgacgggcttctctcccgcggacgtcttcgtgcagtggatgcagagggggcagcccttgtccccggagaagtatgtgaccagcgccccaatgcctgagccccaggccccaggccggtacttcgcccacagcatcctgaccgtgtccgaagaggaatggaacacgggggagacctacacctgcgtggtggcccatgaggccctgcccaacagggtcaccgagaggaccgtggacaagtccaccggtaaacccaccctgtacaacgtgtccctggtcatgtccgacacagctggcacctgctactgaccctgctggcctgcccacaggctcggggcggctggccgctctgtgtgtgcatgcaaactaaccgtgtcaacggggtgagatgttgcatcttataaaatt

SEQ ID NO: 12 - DNA, 61 bp, Homo sapiens
tactactactactactacatggacgtctggggcaaagggaccacggtcaccgtctcctcag

SEQ ID NO: 13 - DNA, 52 bp, Homo sapiens
tactggtacttcgatctctggggccgtggcaccctggtcactgtctcctcag

SEQ ID NO: 14 - DNA, 52 bp, Homo sapiens
gctgaatacttccagcactggggccagggcaccctggtcaccgtctcctcag

SEQ ID NO: 15 - DNA, 20 bp, Homo sapiens
ggtatagtgggagctactac

SEQ ID NO: 16 - DNA, 20 bp, Homo sapiens
gtagagatggctacaattac

SEQ ID NO: 17 - DNA, 31 bp, Homo sapiens
gtattactatgatagtagtggttattactac

SEQ ID NO: 18 - DNA, 28 bp, Homo sapiens
agcatattgtggtggtgactgctattcc

SEQ ID NO: 19 - DNA, 21 bp, Homo sapiens
gggtatagcagtggctggtac

SEQ ID NO: 20 - DNA, 20 bp, Homo sapiens
gtggatacagctatggttac

SEQ ID NO: 21 - DNA, 37 bp, Homo sapiens
gtattatgattacgtttgggggagttatcgttatacc

SEQ ID NO: 22 - DNA, 31 bp, Homo sapiens
aggatattgtagtggtggtagctgctactcc

SEQ ID NO: 23 - DNA, 21 bp, Homo sapiens
gggtatagcagcagctggtac

SEQ ID NO: 24 - DNA, 23 bp, Homo sapiens
gtggatatagtggctacgattac

SEQ ID NO: 25 - DNA, 31 bp, Homo sapiens
gtattactatggttcggggagttattataac

SEQ ID NO: 26 - DNA, 31 bp, Homo sapiens
gtattacgatattttgactggttattataac

SEQ ID NO: 27 - DNA, 31 bp, Homo sapiens
aggatattgtactaatggtgtatgctatacc

SEQ ID NO: 28 - DNA, 20 bp, Homo sapiens
gtggatacagctatggttac

SEQ ID NO: 29 - DNA, 31 bp, Homo sapiens
gtattacgatttttggagtggttattatacc

SEQ ID NO: 30 - DNA, 31 bp, Homo sapiens
aggatattgtagtagtaccagctgctatgcc

SEQ ID NO: 31 - DNA, 498 bp, Homo sapiens
gcagagcctgctgaattctggctgaccagggcagtcaccagagctccagacaatgtctgtctccttcctcatcttcctgcccgtgctgggcctcccatggggtcagtgtcagggagatgccgtattcacagcagcattcacagactgaggggtgtttcactttgctgtttccttttgtctccaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaaga

SEQ ID NO: 32 - DNA, 500 bp, Homo sapiens
gagagcatcacccagcaaccacatctgtcctctagagaatcccctgagagctccgttcctcaccatggactggacctggaggatcctcttcttggtggcagcagccacaggtaagaggctccctagtcccagtgatgagaaagagattgagtccagtccagggagatctcatccacttctgtgttctctccacaggagcccactcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgaga

SEQ ID NO: 33 - DNA, 478 bp, Homo sapiens
ccacatccctcctcagaagcccccagagcacaactcctcaccatggactggacctggaggatcctctttttggtggcagcagccacaggtaaggggctgccaaatcccagtgaggaggaagggatcgaagccagtcaagggggcttccatccactcctgtgtcttctctacaggtgtccactcccaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgaga

SEQ ID NO: 34 - DNA, 494 bp, Homo sapiens
aaattcagggtccagctcacatgggaaatactttctgagactcatggacctcctgcacaagaacatgaaacacctgtggttcttcctcctgctggtggcagctcccagatgtgagtgtctcaaggctgcagacatggggatatgggaggtgcctctgatcccagggctcactgtgggtctctctgttcacaggggtcctgtcccaggtgcagctgcaggagtcgggcccaggactggtgaagccttcggagaccctgtccctcacctgcactgtctctggtggctccatcagtagttactactggagctggatccggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgaga

SEQ ID NO: 35 - DNA, 463 bp, Homo sapiens
agtgactcctgtgccccaccatggacacactttgctccacgctcctgctgctgaccatcccttcatgtgagtgctgtggtcagggactccttcacgggtgaaacatcagttttcttgtttgtgggcttcatcttcttatgctttctccacaggggtcttgtcccagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacaga

SEQ ID NO: 36 - DNA, 533 bp, Homo sapiens
aggtctcagagaggagccttagccctggactccaaggcctttccacttggtgatcagcactgagcacagaggactcaccatggaattggggctgagctgggttttccttgttgctattttagaaggtgattcatggaaaactaggaagattgagtgtgtgtggatatgagtgtgagaaacagtggatttgtgtggcagtttctgaccttggtgtctctttgtttgcaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgaga

SEQ ID NO: 37 - DNA, 499 bp, Homo sapiens
gagcatcactcaacaaccacatctgtcctctagagaaaaccctgtgagcacagctcctcaccatggactggacctggaggatcctcttcttggtggcagcagctacaagtaaggggcttcctagtctcaaagctgaggaacggatcctggttcagtcaaagaggattttattctctcctgtgttctctccacaggtgcccactcccaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgaga

SEQ ID NO: 38 - DNA, 525 bp, Homo sapiens
agctctgggagaggagccccagccctgagattcccaggtgtttccattcagtgatcagcactgaacacagaggactcaccatggagttgggactgagctggattttccttttggctattttaaaaggtgattcatggagaaatagagagattgagtgtgagtggacatgagtggatttgtgtggcagtttctgaccttggtgtctctgtgtttgcaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagat

SEQ ID NO: 39 - DNA, 568 bp, Homo sapiens
ctccctctgctgataaaaaccagccgagcccagaccctgcagctctgggagaagagccccagccccagaattcccaggagtttccattcggtgatcagcactgaacacagaggactcaccatggagtttgggctgagctgggttttccttgttgctattataaaaggtgatttatggagaactagagacattgagtggacgtgagtgagataagcagtgaatatatgtggcagtttctgactaggttgtctctgtgtttgcaggtgtccagtgtcaggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgaga

SEQ ID NO: 40 - DNA, 531 bp, Homo sapiens
agctctgggagtggagccccagccttgggattcccaagtgtttgtattcagtgatcaggactgaacacacaggactcaccatggagttggggctgagctgggttttccttgttgctatattagaaggtgattcatggagaactagagatattgagtgtgaatgggcatgaatgagagaaacagtgggtatgtgtggcaatttctgacttttgtgtctctgtgtttgcaggtgtccagtgtgaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaaga

SEQ ID NO: 41 - DNA, 540 bp, Homo sapiens
agctctgggagaggagccccagccttgggattcccaagtgttttcattcagtgatcaggactgaacacagaggactcaccatggagtttgggctgagctggattttccttgctgctattttaaaaggtgatttatggagaactagagagattaagtgtgagtggacgtgagtgagagaaacagtggatatgtgtggcagtttctgatcttagtgtctctgtgtttgcaggtgtccagtgtgaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccaca

SEQ ID NO: 42 - DNA, 526 bp, Homo sapiens
agccctgggagagaagccccagccctgggattctcaggtgtttctattgggtcaacagcaataaacaaattaccatggaatttgggctgagctgggtttttcttgctggtattttaaaaggtgattcatggagaactaaggatattgagtgagtggacatgagtgagagaaacagtggatatgtgtggcagtttctgaccagggtgtctctgtgtttgcaggtgtccagtgtgaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgaga

SEQ ID NO: 43 - DNA, 494 bp, Homo sapiens
gcatcacccaaaaaccacacccctccttgggagaatcccctagatcacagctcctcaccatggactggacctggagcatccttttcttggtggcagcagcaacaggtaacggactccccagtcccagggctgagagagaaaccaggccagtcatgtgagacttcacccactcctgtgtcctctccacaggtgcccactcccaggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgaga

SEQ ID NO: 44 - DNA, 515 bp, Homo sapiens
ccagccctgagattcccacgtgtttccattcagtgatcagcactgaacacagaggactcgccatggagtttgggctgagctgggttttccttgttgctattttaaaaggtgattcatggatcaatagagatgttgagtgtgagtgaacacgagtgagagaaacagtggatttgtgtggcagtttctgaccaggtgtctctgtgtttgcaggtgtccagtgtgaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgaga

SEQ ID NO: 45 - DNA, 531 bp, Homo sapiens
agctctgagagaggagccttagccctggattccaaggcctatccacttggtgatcagcactgagcaccgaggattcaccatggaactggggctccgctgggttttccttgttgctattttagaaggtgaatcatggaaaagtagagagatttagtgtgtgtggatatgagtgagagaaacggtggatgtgtgtgacagtttctgaccaatgtctctctgtttgcaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgaga

SEQ ID NO: 46 - DNA, 533 bp, Homo sapiens
agctctgagagaggagcccagccctgggattttcaggtgttttcatttggtgatcaggactgaacagagagaactcaccatggagtttgggctgagctggctttttcttgtggctattttaaaaggtaattcatggagaaatagaaaaattgagtgtgaatggataagagtgagagaaacagtggatacgtgtggcagtttctgaccagggtttctttttgtttgcaggtgtccagtgtgaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaa

SEQ ID NO: 47 - DNA, 496 bp, Homo sapiens
accatcacacaacagccacatccctcccctacagaagcccccagagcgcagcacctcaccatggactgcacctggaggatcctcttcttggtggcagcagctacaggcaagagaatcctgagttccagggctgatgaggggactgggtccagttaagtggtgtctcatccactcctctgtcctctccacaggcacccacgcccaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaaca

SEQ ID NO: 48 - DNA, 467 bp, Homo sapiens
gctcagtgactcctgtgccccaccatggacacactttgctacacactcctgctgctgaccaccccttcctgtgagtgctgtggtcagggacttcctcagaagtgaaacatcagttgtctcctttgtgggcttcatcttcttatgtcttctccacaggggtcttgtcccaggtcaccttgaaggagtctggtcctgtgctggtgaaacccacagagaccctcacgctgacctgcaccgtctctgggttctcactcagcaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggata

SEQ ID NO: 49 - DNA, 505 bp, Homo sapiens
atttccttaaattcagggtcctgctcacatgggaaatactttctgagagtcctggacctcctgtgcaagaacatgaaacacctgtggttcttcctcctgctggtggcagctcccagatgtgagtgtctcaaggctgcagacatggagatatgggaggtgcctctgagcccagggctcactgtgggtctctctgttcacagtggtcctgtcccaggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgaga

SEQ ID NO: 50 - DNA, 532 bp, Homo sapiens
cagctctgggagaggagcccagcactagaagtcggcggtgtttccattcggtgatcagcactgaacacagaggactcaccatggagtttgggctgagctgggttttcctcgttgctcttttaagaggtgattcatggagaaatagagagactgagtgtgagtgaacatgagtgagaaaaactggatttgtgtggcattttctgataacggtgtccttctgtttgcaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaga

SEQ ID NO: 51 - DNA, 532 bp, Homo sapiens
cagctctgggagaggagcccagcactagaagtcggcggtgtttccattcggtgatcagcactgaacacagaggactcaccatggagtttgggctgagctgggttttcctcgttgctcttttaagaggtgattcatggagaaatagagagactgagtgtgagtgaacatgagtgagaaaaactggatttgtgtggcattttctgataacggtgtccttctgtttgcaggtgtccagtgtcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgaga

SEQ ID NO: 52 - DNA, 483 bp, Homo sapiens
cagctcacatgggaagtgctttctgagagtcatggacctcctgcacaagaacatgaaacacctgtggttcttcctcctcctggtggcagctcccagatgtgagtgtctcaggaatgcggatatgaagatatgagatgctgcctctgatcccagggctcactgtgggtttctctgttcacaggggtcctgtcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgaga

SEQ ID NO: 53 - DNA, 467 bp, Homo sapiens
aacaaacaaattaccatggaatttgggctgagctgggtttttcttgctgctattttaaaaggtgattcatgaagaactaaggatattgagtgagtggacatgagtgagagaaacagtggatttgtgtggcagtttctgaccagggtgtctctgtgtttgcaggtgtccagtgtgaggtgcagctggtggagtctgggggaggcttggtacagcctgggggatccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgaga

SEQ ID NO: 54 - DNA, 529 bp, Homo sapiens
ctctgggagtggagccccagccttgggattcccaggtgtttcccttcagtgatcaggactgaacacacacaactcatcatgcagtttgtgctgagctgggttttccttgttggtattttaaaaggtgattcatggagaactacagatgttgagtgtgagtggacatgagtgagcaaaacagtgggtttgtgtggcagtttctgaccttggtgtctctgtgtttgcaggtgtccagtgtgaggtgcagctggtggagtctgggggaggcttggtacagcctagggggtccctgagactctcctgtgcagcctctggattcaccgtcagtagcaatgagatgagctggatccgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatat

SEQ ID NO: 55 - DNA, 508 bp, Homo sapiens
atttccttaaattcaggtccaactcataagggaaatgctttctgagagtcatggatctcatgtgcaagaaaatgaagcacctgtggttcttcctcctgctggtggcggctcccagatgtgagtgtttctaggatgcagacatggagatatgggaggctgcctctgatcccagggctcactgtgggtttttctgttcacaggggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgaga

SEQ ID NO: 56 - DNA, 494 bp, Homo sapiens
atcacccaacaaccacatccctcctctagagaatcccctgaaagcacagctcctcaccatggactggacctggagaatcctcttcttggtggcagcagccacaggtaaggggctcccaagtcccagtgatgaggaggggattgagtccagtcaaggtggcttttatccactcctgtgtcccctccacagatgcctactcccagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaaga

SEQ ID NO: 57 - DNA, 740 bp, Homo sapiens
atctgtggggacttgttcttcagtgaaaggatcctgtccgcaaacagaaatggagcaggacatgcatttcttcaagcaggattagggcttggaccatcagcatcccactcctgtgtggcagatgggacatctatcttctttctcaacctcgatcaggctttgaggtatgaaataatctgtctcatgaatatgcaaataaccttagatctactgaggtaaatatggatacatctgggccctgaaagcatcatccaacaaccacatcccttctctacagaagcctctgagaggaaagttcttcaccatggactggacctggagggtcttctgcttgctggctgtagctccaggtaaagggccaactggttccagggctgaggaagggattttttccagtttagaggactgtcattctctactgtgtcctctccgcaggtgctcactcccaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgaga

SEQ ID NO: 58 - DNA, 533 bp, Homo sapiens
agctctcagagaggtgccttagccctggattccaaggcatttccacttggtgatcagcactgaacacagaggactcaccatggagttggggctgtgctgggttttccttgttgctattttagaaggtgattcatggaaaactagagagatttagtgtgtgtggatatgagtgagagaaacagtggatatgtgtggcagtttctgaccttggtgtctctttgtttgcaggtgtccagtgtgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtgtattactgtgcgaga

SEQ ID NO: 59 - DNA, 540 bp, Homo sapiens
agctctgggagaggagccccagccgtgagattcccaggagtttccacttggtgatcagcactgaacacagaccaccaaccatggagtttgggcttagctgggttttccttgttgctattttaaaaggtaattcatggtgtactagagatactgagtgtgaggggacatgagtggtagaaacagtggatatgtgtggcagtttctgaccttggtgtttctgtgtttgcaggtgtccaatgtgaggtgcagctggtggagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactaga

SEQ ID NO: 60 - DNA, 493 bp, Homo sapiens
tgagtctccctcactgcccagctgggatctcagggcttcattttctgtcctccaccatcatggggtcaaccgccatcctcgccctcctcctggctgttctccaaggtcagtcctgccgagggcttgaggtcacagaggagaacgggtggaaaggagcccctgattcaaattttgtgtctcccccacaggagtctgtgccgaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgaga

SEQ ID NO: 61 - DNA, 670 bp, Homo sapiens
aataccaatctcccccaggacacttcatctgcacggagcccggcctctcctcagatgtcccaccccagagcttgctatatagtcggggacatccaaatagggccctccctctgctgatgaaaaccagcccagctgaccctgcagctctgggagaggagcccagcactgggattccgaggtgtttccattcggtgatcagcactgaacacagaggactcaccatggagttttggctgagctgggttttccttgttgctattttaaaaggtgattcatggagaactagagatattgagtgtgagtgaacacgagtgagagaaacagtggatatgtgtggcagtttctaaccaatgtctctgtgtttgcaggtgtccagtgtgaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgaga

SEQ ID NO: 62 - DNA, 497 bp, Homo sapiens
agcatcatccagaaaccacatccctccgctagagaagcccctgacggcacagttcctcactatggactggatttggagggtcctcttcttggtgggagcagcgacaggcaaggagatgccaagtcccagtgatgaggaggggattgagtccagtcaaggtggctttcatccactcctgtgttctctccacaggtgcccactcccaaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggca

SEQ ID NO: 63 - DNA, 537 bp, Homo sapiens
acttaagcacccacaggaaaccaccacacatttccttaaattcaggttccagctcacatgggaaatactttctgagagtcctggacctcctgtgcaagaacatgaaacacctgtggttcttcctcctcctggtggcagctcccagatgtgagtgtctcagggatccagacatgggggtatgggaggtgcctctgatcccagggctcactgtgggtctctctgttcacaggggtcctgtcccaggtgcagctgcaggagtcgggcccaggactggtgaagccttcggagaccctgtccctcacctgcactgtctctggtggctccgtcagcagtggtggttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgaga

SEQ ID NO: 64 - DNA, 528 bp, Homo sapiens
agctctgggagaggagcccagcactgggattccgaggtgtttccattcagtgatctgcactgaacacagaggactcgccatggagtttgggctgagctgggttttccttgttgctattttaaaaggtgattcatggagaactagagatattgagtgtgagtgaacacgagtgagagaaacagtggatatgtgtggcagtttctaaccaatgtctctgtgtttgcaggtgtccagtgtgaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagctgtggtagcacatactacgcagactccgtgaagggccgattcaccatctccagagacaattccaagaacacgctgtatcttcaaatgaacagcctgagagctgaggacacggctgtgtattactgtgcgaga

SEQ ID NO: 65 - DNA, 498 bp, Homo sapiens
agcatcacataacaaccacattcctcctctgaagaagcccctgggagcacagctcatcaccatggactggacctggaggttcctctttgtggtggcagcagctacaggtaaggggcttcctagtcctaaggctgaggaagggatcctggtttagttaaagaggattttattcacccctgtgtcctctccacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgaga

SEQ ID NO: 66 - DNA, 519 bp, Homo sapiens
atctccaccagctccaccctcccctgggttcaaaagacgaggacagggcctcgctcagtgaatcctgctctccaccatggacatactttgttccacgctcctgctactgactgtcccgtcctgtgagtgctgtggtcaggtagtacttcagaagcaaaaaatctattctctcctttgtgggcttcatcttcttatgtcttctccacaggggtcttatcccaggtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggata

SEQ ID NO: 67 - DNA, 540 bp, Homo sapiens
agctctgggagaggagctccagccttgggattcccagctgtctccactcggtgatcggcactgaatacaggagactcaccatggagtttgggctgagctgggttttccttgttgctattttaaaaggtgattcatggggaactagagatactgagtgtgagtggacatgagtgagagaaacagtggacgtgtgtggcactttctgaccagggtgtctctgtgtttgcaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactaga

SEQ ID NO: 68 - DNA, 295 bp, Homo sapiens
gtgtctttgccgaggtgcagctgttgcagtctgcagcagaggtgaaaagacccggggagtctctgaggatctcctgtaagacttctggatacagctttaccagctactggatccactgggtgcgccagatgcccgggaaagaactggagtggatggggagcatctatcctgggaactctgataccagatacagcccatccttccaaggccacgtcaccatctcagccgacagctccagcagcaccgcctacctgcagtggagcagcctgaaggcctcggacgccgccatgtatta

SEQ ID NO: 69 - DNA, 489 bp, Homo sapiens
acccaacaacaacatccctccttgggagaatcccctagagcacagctcctcaccatggactggacctggagcatcctcttcttggtggcagcagcaacaggtaaggggctccccagtctcggggttgaggcagaaaccaggccactcaagtgaggctttacccacccctgtgtcctctccacaggtacctactcccaggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctccatggacacctctgccagcacagcatacctgcagatcagcagcctaaaggctgaggacatggccatgtattactgtgcgaga

SEQ ID NO: 70 - DNA, 534 bp, Homo sapiens
agctctgggagaggagcccccgccctgggattcccaggtgttttcatttggtgatcagcactgaacacagaagagtcatgatggagtttgggctgagctgggttttccttgttgctatttttaaaggtgattcatgaggaaatagagatattgagtgtgagtggacatgagtgagagaaacagtggatttgtgtggcagtttctgaccttggtgtctctgtgtttgcaggtgtccagtgtgaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgaga

SEQ ID NO: 71 - DNA, 2025 bp, Homo sapiens
ttttcacctctccatacaaaggcaccacccacatgcaaatcctcacttaagcacccacaggaaaccaccacacatttccttaaattcaggttccagctcacatgggaaatactttctgagagtcctggacctcctgtgcaagaacatgaaacatctgtggttcttccttctcctggtggcagctcccagatgtgagtatctcagggatccagacatggggatatgggaggtgcctctgatcccagggctcactgtgggtctctctgttcacaggggtcctgtcccaggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagacacagtgaggggaggtgagtgtgagcccagacaaaaacctccgtgcagggaggcggaggggaccggcgcaggtgctgctcagcgccagcagggggcgcgcggggcccacagagcaggaggcccggtcaggagcaggtgcagggagggcggggcttcctcatctgctcagtggtctccctcctcgccagcacctcagctgtccccaggggtcctctttctttattatctgtggttctgcttcctcacattcttgtgccaagaaagaaatgaggaagacaaattttcgtctgtagttgaagtttcaccaattactaggaactttcctagaagttcctgcatggcccattatagcttacagattaaatatatatcaagcttctcatctcttgatttgtgtcatcaactgaattgtgccctctttgaaattcatatgcagaaaccttaaattcaattgatgtatattggaattttaatgaaataattaaggttaaatgtggtcataagtgtaagactctaattcaacagacgtgtcgtctttataagaagaggaagagacaccagagacctctcacttttcacgtgcaggcagagaagaggccatgtggagacgtaatgcactagaaggtggcccagtgcaagccaggaagaagcctcaccaagaaccaaccctgccagaacattgatcttcaacattcagactgcagaattttaagaaaatcaatatttgttgtttaagccacccactcctgttgtcttcttatgaagatccagacagactaataccacataactctgttagcgctgtcccctggatgcagaatcagcccgctggggctgggcacatctctcagatttccacataaagtaggcaaaaaatagtagttctgatataaaaatttgtcatgtccctgttggccaatttctgggcaaggtcttttaaagaagccctgggggctttgtcacaaaagttgccttttatcatttattaggacataactgatgaacaatgagtaccagttggatggagactgaccactgaccatcttctgctgtctcctaagtatgccacagaaaaccacaccaacattactctatgtcttcaactttctaaatttgcactgattggtatttaaggcaggcccagcgttgaataactcctttagtttttgcttctctgggaaaggtcttatctatcctggccttggtcttcaagtttcagcaattctgggaagccaaggacgcctctatctcctcctccatgctctgcaactcacctgagaacagctttctcattggaatgtcttctgtttaaggaataagagtccctgtttcaggcttgggtgcctgagtacacctactggatccagcccaggattggagaaactttccagaacacatcacctgagaaatgaccagtcacactgttacactttcacaatttccgcttc

SEQ ID NO: 72 - DNA, 690 bp, Homo sapiens
aatttctcaaatcccattgttgtcacccatcttcctcaggacactttcatctgccctgggtcctgctctttcttcaggtgtctcaccccagagcttgatatatagtaggagacatgcaaatagggccctcactctgctgaagaaaaccagccctgcagctctgggagaggagccccagccctgggattcccagctgtttctgcttgctgatcaggactgcacacagagaactcaccatggagtttgggctgagctgggttttccttgttgctattttaaaaggtgattcatggagaactggagatatggagtgtgaatggacatgagtgagataagcagtggatgtgtgtggcagtttctgaccagggtgtctctgtgtttgcaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaaga

SEQ ID NO: 73 - DNA, 540 bp, Homo sapiens
agctctgagagcggagccccagccccagaattcccaggtgttttcatttggtgatcagcactgaacacagaggactcaccatggagtttgggctgagctgggttttccttgttgttattttacaaggtgatttatggagaactagagatgttaagtgtgagtggacgtgagtgagagaaacagtggatttgtgtgacagtttctgaccagggtgtctctgtgtttgcaggtgtccagtgtgaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctaga

SEQ ID NO: 74 - DNA, 18 bp, Homo sapiens
gggtatagcagcggctac

SEQ ID NO: 75 - DNA, 17 bp, Homo sapiens
ggtataaccggaaccac

SEQ ID NO: 76 - DNA, 19 bp, Homo sapiens
tgactacggtggtaactcc

SEQ ID NO: 77 - DNA, 55 bp, Homo sapiens
caaaggtgctgggggcccctggacccgacccgccctggagaccgcagccacatca

SEQ ID NO: 78 - DNA, 16 bp, Homo sapiens
tgactacggtgactac

SEQ ID NO: 79 - DNA, 18 bp, Homo sapiens
gagtatagcagctcgtcc

SEQ ID NO: 80 - DNA, 446 bp, Homo sapiens
gagtttgtgctaagctgggttttccttgttgctatattaaaatgtgattcatggagaactagagagattgagtgtgagttacatgagtgagagaaacagtggatatgtttggcaatttctgacttttgtgtctctgtgtttgcaggtgtccagtgtgaggatcagctggtggagtctgggggaggcttggtacagcctggggggtccctgagaccctcctgtgcagcctctggattcgccttcagtagctatgttctgcactgggttcgccgggctccagggaagggtccggagtgggtatcagctattggtactggtggtgatacatactatgcagactccgtgatgggccgattcaccatctccagagacaacgccaagaagtccttgtatcttcaaatgaacagcctgatagctgaggacatggctgtgtattattgtgcaag

SEQ ID NO: 81 - DNA, 508 bp, Homo sapiens
atttccttaaattcagggtcctgctcacatgggaaatactttctgagagtcctggacctcctgtgcaagaacatgaaacacctgtggttcttcctcctgctggtggcagctcccagatgtgagtgtctcaaggctgcagacatggagatatgggaggtgcctctgatcccagggctcactgtgtgtctctctgttcacaggggtcctgccccaggtgcagctgcaggagtcgggcccaggactggtgaagccttcacagaccctgtccctcacctgtactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgaga

SEQ ID NO: 82 - DNA, 537 bp, Homo sapiens
agctctgggagaggagccccagccctgagattcccaggtgtttccattcggtgatcagcactgaacacagagaacgcaccatggagtttggactgagctgggttttccttgttgctattttaaaaggtgattcatggataaatagagatgttgagtgtgagtgaacatgagtgagagaaacagtggatatgtgtggcagtgtctgaccagggtgtctctgtgtttgcaggtgtccagtgtgaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagat

SEQ ID NO: 83 - DNA, 16 bp, Homo sapiens
tgactacagtaactac

SEQ ID NO: 84 - DNA, 16 bp, Homo sapiens
tgactacagtaactac

SEQ ID NO: 85 - DNA, 17 bp, Homo sapiens
ggtacaactggaacgac

SEQ ID NO: 86 - DNA, 11 bp, Homo sapiens
ctaactgggga

SEQ ID NO: 87 - DNA, 17 bp, Homo sapiens
ggtataactggaacgac

SEQ ID NO: 88 - DNA, 50 bp, Homo sapiens
cttgcagttggacttcccaggccgacagtggtctggcttctgaggggtca

SEQ ID NO: 89 - DNA, 17 bp, Homo sapiens
ggtataactggaactac

SEQ ID NO: 90 - DNA, 60 bp, Homo sapiens
gctacaagtgcttggagcactggggccagggcagcccggccaccgtctccctgggaacgt

SEQ ID NO: 91 - DNA, 46 bp, Homo sapiens
tactttgactactggggccagggaaccctggtcaccgtctcctcag

SEQ ID NO: 92 - DNA, 49 bp, Homo sapiens
aactggttcgacccctggggccagggaaccctggtcaccgtctcctcag

SEQ ID NO: 93 - DNA, 49 bp, Homo sapiens
gatgcttttgatatctggggccaagggacaatggtcaccgtctcttcag

SEQ ID NO: 94 - DNA, 253 bp, Homo sapiens
gtgcagctgcaggagtggggcccaggactggtgaagcttcggagaccctgtccctcacatgcgctgtctctggtgactccatcagcagtggtaactggtggagctggtccgccagtccccagggaaggggctggaatggattggatacatctattatagtgggaggagctactacaccccgtccctcaggagttgagtcaccatgtcaatagaaacgtccaagaaccagttttccctgaagctgagctctgtg

SEQ ID NO: 95 - DNA, 435 bp, Homo sapiens
atggactggacctggagcatcctcttcttggtggcagcagcaacaggtaagggactccccagtcccagggctgagggagaaaccaggccagtcatgtgagacttcacccactgctgtctcctctccacaggtgcccactcccgagtgcagctggtgcagtctgggcctgaggtgaagcagcctggggcctcggcgaaggtctcctgcaaggtgtctggttaaactgtcatcacctatggtatgaattggatacgacagaccccaggacaggggcttgagtggatgggatggatcatcctaccctggtgaacccaatgtatgcccacagattcacacacggtttgtcttctccatggacacctctgtcagcacggcggatctgcagactagctgcctaaagactgaggatgcagccatttattactgtgtgaggta

SEQ ID NO: 96 - DNA, 444 bp, Homo sapiens
atggagtttgggctgagctgggttttccttgttgctattttaagaggtgattcatagataaatagagatgttgagtgggagtggacatgagtgagagaaacagtggatgtgtgtggcagtttctgaccttggtgtctttgtgtttgcaggtgtccagtgtgaggtgcagctggtggagtctggggaaggcttggtccagcctggggggtccctgagactctcctgtgcagcctctggattcaccttcagtagctctgctatgcactgggtccgccaggctccaagaaagggtttgtagtgggtctcagttattagtacaagtggtgataccgtactctacacagactctgtgaagggccgattcaccatctccagagacaatgcccagaattcactgtctctgcaaatgaacagcctgagagccgagggcacagttgtgtacta

SEQ ID NO: 97 - DNA, 37 bp, Homo sapiens
atcctcacagaccctctccctcacctgcactgtctct

SEQ ID NO: 98 - DNA, 248 bp, Homo sapiens
gggctagtgaagctctcacagaccctctctctcacctgtgctgtctctgcattctccatcacaaccagtgcttcctgctggagctgcatccatcaccccccgcaaggaagggactggagcgaatcaggtgcacaggtcatgagggagtgcacattccaacccactcctcaagagtccagtcactatctccagatccacatccaaaaaacagtgtttcctgtagctgagctacctgagcaacaagtaca

SEQ ID NO: 99 - DNA, 441 bp, Homo sapiens
atgaagtctgggctgagccggtttttccttgttgctattttaaaagataattaatggtgaactagagatacttagtgtgaggggacatgagtgagagaaacagtggatagtgtggcagtttctgatcacgatgtctctggaggtgtccagtgtgaggtgcagctggtggagtctgggggaggcttggtacagcctggggggtccctgagactctcctgtgcagcctctggattcaccttccgttaactactgcatgcagtggatctgccgggctccaggaaaggggctggagtgggtaggtttcactaaaaacaaaactaatcgtggaacaacagaatacgccgcgtctgtgaaaggcagattcaccatctcaagcgatgattccaaaagcatcgcctatctgcaaatgaacagcctgaaaaccgaggacacggccgtgta

SEQ ID NO: 100 - DNA, 458 bp, Homo sapiens
atggagtttgggctgagctgggttttccttgttgctaatgtaaaaggtgactcatggagaactagagatattgagtgtgagtggacacaagtgagagaaacagtggatatgtgtggcaggttctgaccagggtgtctgtgtgtgtttgcaggtgtccagtgtgaggtgcagctggtggagtctttgggaggcttgttatagcctgggggtccctgagactttcttttgcagcctctggattcacctttagtacctttattaggtactggatgagctgggtccatcaggctcctgggaaagggctggagtaggtctcatttatgagttgttgtgtaggtagcacaagctatgcagactctgtgaagggtcgattcaccctctccagagatgatgccaagaaatcactgtatctgcaaatgaacagcgtcagagccgaggataggtctgtgtattactgt

SEQ ID NO: 101 - DNA, 439 bp, Homo sapiens
atagagttagggctgagctgggtttcccttgtcattattttaaaaggcgaataatggagaacttgagatatggagtgtgagtggatatgagtgaaaaaacagtgattctgtgtggcaggttctgactcagatgtctctgtgcttgtaggtgtctagtgtggggtgcagatggtggagtcttggggagagttggcacaagctgaatgtgcctgagactctgccgtgcatcctctgaatccaccttctgtagctactagatcagctgaatctgccaggctccaggaaaggggctgcagtgagtagtagatataatgtacgatggaagtcagacataatatgcagactctgtgaaggtcagattcaccatctccaaagacaatgccaagcacaggttgtatctgcaaatgaacagtctgagagctgagaatatggctctgta

SEQ ID NO: 102 - DNA, 295 bp, Homo sapiens
gtgtccaatgtgaagtgtagctggtagagtctgggggaggcttggtacagcttggggggtccatgtgactctcctgtgcagcctctggatacactttcagtaactatggcatgcactaggtggaccaagctccagggaagggactggagtgggtcttacattaatgctagtggtggaggcatatactactcagactctgtgaagggccggttgaccatctccagagaaaacaccaagaactcactgtatctgcaaataaacagtttcattgctgacaccatggccgtctattact

SEQ ID NO: 103 - DNA, 440 bp, Homo sapiens
atggagtggacttggaggatcctaattttggtggtcgtagctgcaggtaggataattctcagtccccaggactaaggtgactgggtccagtcaaagggggttttatccactcccgtgtcctctccacaggtgcccagtcccaggtgcagctggtgcagtctggggatgagatgaagaaggctggggcatcagtgaaagtctcctgcaagacttgtggatacacctaccttcaccagttactctatgcactaggtgcgccaggcccatgcacaagggcttgagtggatgggaaggatgtgccctagtgatggcagcataagctacgcagagaagttccagggcagagtcaccatgaccagggacacatccacgagcacagcctacatggagctgagcagcctgagatctgaagacacggccatgtattactgtgggagaga

SEQ ID NO: 104 - DNA, 58 bp, Homo sapiens
ctggtgaagcccttgcaaaccccctcactcacctgtgctgcctctggattctctgtca

SEQ ID NO: 105 - DNA, 250 bp, Homo sapiens
gggggaaacattgtacagcccagcggttctcacagactctcctgcaaagcctctgatttcacttgtactggctacagcatgagcttggtccagcaggcttcatgacagggatttgtgtgggtggcaacagtgagttatcagggttactctccatgagtacaagtaaattaacagtcccaagcaacaccctttcaagtgcagtctaccttaaaatgaccaatgtgaaagccaaggacaagaccttgtatta

SEQ ID NO: 106 - DNA, 286 bp, Homo sapiens
cactggtggaatctggaagagaaatgatacagcctaactgttctcagagccttttttacaaagcctctgaatttaccttcattgactctagcatgagctcagcccagcaggcttcaggacaggggttggtgtgggaggcaaaagcgagggattcaagtggaatttgttagtggtaccctccatcaatacaaagaaaaatcataatcctcagggacacccttgtcagcacagtctccctcaaaatgaccaacctgagagccgaggagaaggccatgtattactgtga

SEQ ID NO: 107 - DNA, 434 bp, Homo sapiens
atggactggacctgaaggatcctcttcttgatggcagcagcaacaggtaaggggctccccagtctcagggctgaggaagaaaccaggccagtcatgtgagacttcacccactcttgtgtccactccacaggtgcccactccctgcagctggtgcagtctgggcctgaggtgaagaagcctggggcctcagtgaaggtctcctataagtcttctggttacaccttcaccatctatggtatgaattgggtatgatagacccctggacagggctttgagtggatgtgatggatcatcacctacactgggaacccaacgtatacccacggcttcacaggatggtttgtcttctccatggacacgtctgtcagcacggcgtgtcttcagatcagcagcctaaaggctgaggacacggccgagtattactgtgcgaagta

SEQ ID NO: 108 - DNA, 265 bp, Homo sapiens
cctggtgaagccctcacagatcctccccctggcctgtggcatctctgcttctccattacaaccagtgcttcctgctggagctggatccgtcaccccccggggaagggactggagcgaatcaggtgcacaggtcatgagggagtgcacaatccaacccactcctcaagagtccagtcaccatctccagatccacatccaaaaaacagtttctcctacagctgagctaccttaacaaggagtacacaaccatgatttttatacaaaa

SEQ ID NO: 109 - DNA, 439 bp, Homo sapiens
atgttgtttgggctgagctgggctttcctttttactattttaagaggtgatacatgaagaactacagatattgttcgtgagtggatattagagaaacagtggatatgtgtggcagtttctgaccaggatgtctctgtgtttgcaggtgtgcagtatgaggtgcagctggtagagtctgggggagacttggtacagctgtggtggggttgggggtgtcctgagactctcatgtgcagcctgcggattcatcttgagaagcaatgacatgaactgggcccaccgggcttcaagaaaggggctggaatgggtctcatacattagtgctagtggtggtagcctatactatgcagacactgaagggtagattcaccatctctagagacaatggcaagaacatgctgtacttgcaaatgaacagtctgagagatgaggactcggc

SEQ ID NO: 110 - DNA, 241 bp, Homo sapiens
gaagtcctgtgtgaagttcaccgggggagacagaggaaataacggtgcagccgggggctatctgagtctctcctccaaagactctggattcaccttcactgattgcagcataagcttggtccagcaagctccaggaccagggttgatgtgggcagcaacagggagaaattgaagaggaagctctcagtggtgccctccatgaatacaaagaatcttcacagtccccaggacacccttacgt

SEQ ID NO: 111 - DNA, 224 bp, Homo sapiens
ggcctggcgaagccctcacagaccctctccctcatctgtgctgtctctgcttctccatcacaaccagtgcttcctgctggagctggatccctcagctccccagggaagggactggagtgaatcaggtgcacaggtcatgagggagaacacaacgcaacccacgcctcaagagtccagtcaccatctccagatccacatccaaaacacagtttcttctacagctg

SEQ ID NO: 112 - DNA, 99 bp, Homo sapiens
gatttatcatctcaagagacaatgtcaagaagatgctgtttctgcaaatgggcaatctgcaaaccaaggacacgtcactacattactgtgcaagagaag

SEQ ID NO: 113 - DNA, 291 bp, Homo sapiens
ctgtgaagttaactaatggagttagacagagaaatactacagaccaggaattctgccttttctgcaaagcctctggattcactttcactgaaaacagcataagcttgatccagcaggcttcatgacaggggtgggtgtgggtaataacaataattcaaatagaagttctcagtgggactctccttgagtaaaaagatgattaacaatcctcaaatacactcagttcaggagattctcttttaagatgattaacctgagagctcaggaaaagtccgtgtattactttgaggg

SEQ ID NO: 114 - DNA, 440 bp, Homo sapiens
atggagcttgggctgagctgggttttcactgttgctgttttaaaaggtgaactagagagattgagcgtgagtggatacccttgagagaaatggtggattatgtctgggagtttctgaccaggatgtctacgagtttgcaggtgtctagtgagaggtacagctcgtggagtccggagaggacccaagacaacctgggggatccttgagactctcctgtgcagactctggattaaccttcagtagctactgaatgagctcggtttcccaggctccagggaaggggctggagtgagtagtagatatacagtgtgatggaagtcagatatgttatgcccaatctgtgaagagcaaattcaccatctccaaagaaaatgccaagaactcactgtatttgcaaatgaacagtctgagagcagagggcacagctgtgtgttactgta

SEQ ID NO: 115 - DNA, 451 bp, Homo sapiens
atggagtttgtgctgagctgggttttccttgttgctattttaaaacgtgatctatagagaactagagatattgagtatgaatggatatgagtgagaaacagtggatacgtgtggcagtttctgaccggggtgtctctgtgtttgcaggtatccagtgtgagatgcagctggtggagtctgggggaggcttggcaaagcctgcgtggtccccgagactctcctgtgcagcctctcaattcaccttcagtagctactacatgaactgtgtccgccaggctccagggaatgggctggagttggtttgacaagttaatcctaatgggggtagcacatacctcatagactccggtaaggaccgattcaatacctccagagataacgccaagaacacacttcatctgcaaatgaacagcctgaaaaccgaggacacggccctctattagtgtaccag

SEQ ID NO: 116 - DNA, 220 bp, Homo sapiens
tctagtaaagccctcagagaccctctccttcacctgtgctgtctctggatttccaatcataaccagtacttcctcctggagctgtatctgccagcccccagggaagaagctgaagtgggtcaggtgtgtaggtcacgaggaaacacacagtgcaacccgcttctcaagagtccagtcaccacctccagatccacattcagaaaacagtttttcctacagc

SEQ ID NO: 117 - DNA, 250 bp, Homo sapiens
aacagcccagcagttcactgagactgtcctgcaaagcctctggtttcgggtttactgggtgcagcatgagcttggtccagcacgcttcacaacaggaattggtgtgggtagcaacagtgagagatcatatgggagttctaagggttactctccatgagtacagataaatcaacattcccaagtgacaccctttcaagtgcagtctaccttacaaggaccaacctgaaagccaagggcaaggccgtatatt

SEQ ID NO: 118 - DNA, 437 bp, Homo sapiens
attaagctgaatttttcttgttggtattttaaaaggtaactcatagggaactagagtgagtgagagtgagtggatatgagtgagagaaacagtggatatgtttgccagtttctgaccaggatttgtttgtattttcaggtgttcagtgtgaggtggagctgatagagcccacagaggacctgagacaacctgggaagttcctgagactctcctgtgtagcctctagattcgccttcagtagcttctgaatgagcccagttcaccagtctgcaggcaaggggctggagtgagtaatagatataaaagatgatggaagtcagatacaccatgcagactctgtgaagggcagattctccatctccaaagacaatgctaagaactctctgtatctgcaaatgaacagtcagagaactgaggacatggctgtgtatggctgt

SEQ ID NO: 119 - DNA, 412 bp, Homo sapiens
actccttctctgcctgctggctgccctctgtggtgagttactcatgatttcatacgtggggagacacgggatgaggcaaatgtgtctgtgactcacagatgttctctattctcaggggttcacagtgaggaccaccttgtgcaatgggaggaagaagtagtggtccccttggtcatgctcagcctcacctatgccgcctatgcacattcaatttctgaacattctgtttcctggatccaccatctcccatcaaaaggtcttcagtgtgttggtgtgatatgggttaagggaaacactaagccccaaccttcagggcagagctagcatctccagaaacacatagtaaaaaacaagaaaacttacagctgagaagtgtgatggctggggatgcaggcgtgtattactgtgctca

SEQ ID NO: 120 - DNA, 199 bp, Homo sapiens
agtatggtatgaattcagtgtgaccagcccctggacaagggcttgagtggatgggatggatcatcacctacactgggaacccaacatataccaacggcttcacaggacggtttctattctccatggacacctctgtcagcatggcgtatctgaagatcagcagcctaaaggctgaggacacggccgtgtatgactgtat

SEQ ID NO: 121 - DNA, 325 bp, Homo sapiens
ccactgttattccaggtgtcctgtcccaggtgcagctgcaggagtcaggtccaggacccatgaggccctcagacactgccctctgcctgtgctgtgtctggattcttttttttaccatggatattatttgagatgaatccaccatcccgtgggcaacaggctggaatggctggggcacagttactagactggatcatcaaggaatacacatcatgcaccctccacccaggtccatgtccccatcaacagtgactcaaccaagagccagttctctgtgaagctcagctccatgaccacctaggacacggctgagtattactgtgaa

SEQ ID NO: 122 - DNA, 232 bp, Homo sapiens
ttggcctggtgaagccttcacagaacctctccctcacctgtgccatctctgcattctccatcacaaccagtgtttcctgctggagctgcatccatcagcgcccccatgggaggtactggagtggatcgggtgcataggtcatggagggagcacaaattactcccctcttctcaagagtccagtcaccatctccagatccatgtccaaaaagtagttcttcttacagctgaac

SEQ ID NO: 123 - DNA, 451 bp, Homo sapiens
atggagtctgggctgagctgggttttccttgttgctattttgaaaggtgattcatggggaatgagttgaatgtaagtgaatatgagtgagagaaacagtggatgtgtgcggcagtttctgaccagggtgtctctgtgtttgcaggtgtccagtgtgaggtgcagctggtggagtctgggtgaggcttggtacagcctggagggtccctgagactctcctgtgcagcctctggattcaccttcagtagctcctggatgcactgggtctgccaggctccggagaaggggctggagtgggtggccgacataaagtgtgacggaagtgagaaatactatgtagactctgtgaagggccgattgaccatctccagagacaatgccaagaactccctctatctgcaagtgaacagcctgagagctgaggacatgaccgtgtattactgtgtgagagg

SEQ ID NO: 124 - DNA, 439 bp, Homo sapiens
atggagcttgggctgagctgggttttcactgttgctgttttaaaaggtgaactagagagattgagcgtgagtggatacccttgagagaaatggtggattatgtctgggagtttctgaccaggatgtctacgagtttgcaggtgtctagtgagaggtacagctcgtggagtccggagaggacccaagacaacctgggggatccctgagactctcctgtgcagactctggattaaccttcagtagctactgaaggaactcggtttcccaggctccagggaaggggctggagtgagtagtagatatacagtgtgatggaagtcagatatgttatgcataatctttgaagagcaaattcaccatctccaaagaaaatgccaagaactcactgtatttgctaatgaacagtctgagagcagcgggcacagctgtgtgttactgt

SEQ ID NO: 125 - DNA, 174 bp, Homo sapiens
atgttgtttgggctgagctgggctttccttgttactattttaagaggtgattcatgaagaactacagatattgtttgtgagtggatattagagaaacagtggatatgtgtggcagttgctgaccaggatttctctgtgtttgcaggtgtgcagtatgaggtgcagctggtagag

SEQ ID NO: 126 - DNA, 172 bp, Homo sapiens
gagctggatccatcagcccccagggaagggatggagtgggtcaggtgcacaggtcatgaagggagcacaaattctaacccactcctcaagagtccagtcaccacctccagatctatgtccaaaaacagctcttcgtatggctgagtgacattagcaacaagcacacagccat

SEQ ID NO: 127 - DNA, 232 bp, Homo sapiens
cagcctggctgttctcttagcctcttttgcaaagcatcaagattcaccttcactgactacagcataaattgagcccagatggctgggggacagaggctggagtgggtggtaacagtgattgattcaagtggaagttctcagtgatattctgcatcagcataatgaagattcacaattcccagggacaccaattaccagcacagtctcccttaaaataatctacttggaagct

SEQ ID NO: 128 - DNA, 269 bp, Homo sapiens
tggcctggtgaagccctcacagaccctctcccttacctgcgctgtgtctgtgttccccgtgataacgaggtcttcctgctgaagctggatccatcagccccccagggaagggaatggagtggattgggtgcataggtcatgaagggagcacacattaccacccactcctcaagtgtccagtcaccatccccagatccgtgtccaaaaaagcagttcttcctacagctgagctacatgagcaacaagcacatagccatgtatttttaagc

SEQ ID NO: 129 - DNA, 438 bp, Homo sapiens
atggagcttgggctgagctgggttttcactgttgctgttttaaaaggtgaactagagagattgagtgtgaatggatacacttgagagaaacagtggatatgtctggaactttctgaccaggacacctacaagtttgcaggtgtccagtgtgaggtacagctggtggagtctgaagaaaaccaaagacaacttgggggatccctgagactctcctgtgcagactctggattaaccttcagtagctactgaatgagctcagattcccaggctccagggaaggggctggagtgagtagtagatatatagtaggatagaagtcagctatgttatgcacaatctgtgaagagcagattcaccatctccaaagaaaatgccaagaactcactctgtttgcaaatgaacagtctgagagcagagggcacggccgtgtattactgt

SEQ ID NO: 130 - DNA, 2910 bp, Homo sapiens
aacccgagaggggtgagcgcctacctaagccggcccagcccgttcgacctgttcatccgcaagtcgcccacgatcacctgtctggtggtggacctggcacccagcaagtggaccgtgaacctgacctggtcccgggccagtgggaagcctgtgaaccactccaccagaaaggaggagaagcagcgcaatggcacgttaaccgtcacgtccaccctgccggtgggcacccgagactggatcgaaggggagacctaccagtgcagggtgacccacccccacctgcccagggccctcgtgcggtccacgaccaagaccagcggtgagccacgggcaggccggggtcgtggggggagggagggagcgagtgagcggggcctgggctgaccccacgtctggccacaggcccgcgtgctgccccggaagtctatgcgtttgcgacgccggagtggctggggagccgggacaagcgcaccctcacctgcctgatccagaacttcatgcctgaggacatctcggtgcagtggctgcacaacgaggtgcagctcccggacgcccggcacagcacgacgcagccccgcaagaccaagggctccggcttcttcatcttcagccgcctggaggtgaccagggccgagtgggagcagaaagatgagttcatctgccgtgcagtccatgaggcagcgagcccctcacagaccgtccagcgagcggtgtctgtaaatcccggtaaatgacgtactcctgcctccctccctcccagggctccgtccagctgtgcagtggggagggctggccagaccttctgtccactgttgcaacgaccccaggaagctacccccaataaacagtgcctgctcagagcccagggtacacccgttcttgggagcgggcagggctgtgggcaggtgcatcttggcacagaggaatgggccccccaggaggggcagtgggaggaggtgggcagggctgagtccccccaggagaggtggtgggaggaggtgggcagggctgaggtgccactcatccatctgccttcgtgtcagggttatttgtcaaacagcgtatctgcagggactcatcacagctaccccgggccctctctgcccccactctcggtctaccccctccaaggagtccaaagacccaggggaggtcctcagggaaggggcaagggagccccgacagccctctctcttgggggcttggcttctacccccctggacaggagcccctgcacccccaggtatagatgggcacacaggcccctccaggtagaaaaacagccctaagtgaaacccccacacagacacacacgacccgacagccctcgcccaagtctgtgccactggcgttcgcctctctgccctgtcccaccttgccgagtcctggccccagcaccggggccagtggagccgagcccactcacaccccgcagcctccgccaccccgccctgtgggcacaccaggcccaggtcagcagccaggccccctctcctactgccccccaccgccccttggtccatcctgaatcggcctccaggggatcgccagcctcacacacccagtctcgcccactcacgcctcactcaaggcacagctgtgcacacactaggccccatagcaactccacagcaccctgtaccaccaccagggcgccatagacaccccacacgtggtcacacgtggcccacactccgcctcccaccctgcctccagcgaggctactgccaagcccttcctctgagccatacctgggccgctggatcccagagagaaatggagaggccctcacgtggtgtcctccagtccaaccctccctgtcaccctgtcagcagcaccccacagccaaacacaggatggatgcgtgggctccatcccccactcacccacaccggaaccccagagcaggctacgtgcccctcacagacctcaaacccacatgtgcatctgacaccccagatccaaacgctccccccggtcatgcacaccaagggcacagcacccaccaaatccacacggaaacacgggcaccgggcaccccatgagcacaaagcccctccatgtctgaagacagtccctgcacaccgtcacagccatacattcagcttcactctcacgtcccagcccacctgcacccagctctgggcctggagcagcagaaagaggtgtgagggcccgaggccggacctgcacctgctgatgacccgggaccagcaggcagctcacggtgttggggaagggagtggaggggactcagggcaggagccagagggaccaggctggtgggcggggccgggccggggtagggccaggaggcagctctggacacccacaggcctgggctcatagtccacaccaggacagcccctcagagcacccatgcagtgagtcccaggtcttgggagccaggccgcagagctcacgcatccttccgagggccctgagtgaggcggccactcctgtgccgaggggttgggtccttctctggggagggcgtggggtctagagaggcggagtggaggtaaccagaggtcaggagagaagccgtaaggaacagagggaaaatggggccagagtgggggcccagggacgagaggtcaggagtggtcggcctggctctgggccgttgactgactcgggacctgggtgcccaccctcagggctggctggcggctccgcgcagtcccagagggccccggatagggtgctctgccactccggacagcagcagggactgccgagagcagcagggggctctgtcccccacccccgctgccactgtggagccgggagggctgactggccaggtcccccagagctggacgtgtgcgtggaggaggccgagggcgaggcgccgtggacgtggaccggcctctgcatcttcgccgcactcttcctgctcagcgtgag

SEQ ID NO: 131 - DNA, 295 bp, Homo sapiens
gctcccaggtgcagctggggcagtctgaggctgaggtaaagaagcctggggcctcagtgaaggtctcctgcaaggcttccggatacaccttcacttgctgctccttgcactggttgcaacaggcccctggacaagggcttgaaaggatgagatggatcacactttacaatggtaacaccaactatgcaaagaagttccagggcagagtcaccattaccagggacatgtccctgaggacagcctacatagagctgagcagcctgagatctgaggactcggctgtgtattactgggc

SEQ ID NO: 132 - DNA, 450 bp, Homo sapiens
tggagtcatggctgagctgggtttttcttgccgctattttaaaaggtaattcattgagaactattgaaattgagtgtgagtggataagagtgagataaacagtggatacgtgtggcagtttctgaccagggtttctttgtgtttgcaggtgtccagtgtgaggtgcagctggtggagtctgggggaggcttggtccagcctggggggtccctgagactctcctgtgcagcctcaggattctcctttagtagctatggcatgagctgggtccgccaggctccagggaaggggctggagtgagtggcacatatctggaatgatggaagtcagaaatactatgcagactctgtgaagggccgattcacaatctccgagacaattctaagagcatgctctatctgcaaatggacagtctgaaagctaaggacacggccatgtattactgtacca

SEQ ID NO: 133 - DNA, 241 bp, Homo sapiens
gcctcagtgaaggtctcctgcaaagctctggatacaccttcgccagctacgacattcactgtgtgtgacaggcccctggataagggtttgaatggatggtagggagctactctggcaatggtaacacaggctatgcacagaagtttcagggcagagtcaccatgaccagggacacgtccacgagcacagcctacatggagctgagcagtcagagatctgaggacatagatgtgtactactg

SEQ ID NO: 134 - DNA, 255 bp, Homo sapiens
ggcctggtgaagccctcacagaccctctccctcacctgtgctgtctctggattccccatcacaaccagtgcttcctgctgtagctgcattcataaaccccccaggaagggactggagtgaatccagtgcacaggtcatgagggagtgcacattccaacccactcctcaagagtccagtcaccatctccagatccatgtccaaaaagcagttcttcctacagccgagctaagtgagtcacaagcacacagccatgt

SEQ ID NO: 135 - DNA, 457 bp, Homo sapiens
atggagtctgggctgagctggattttccttgttgcagttttaaaaggtgatttatggagaatgagacacactgagtgtgactggacataagtgagagaaacagtggatttgtgtggcagtttctgaccagggtgtctccgtgtttgcaggtgtccagtgtgaggtgcagctggtggagtctgggggaggcttagtaaagactggaggggtctctgagactctcctgtgcagcctctggattcaccttcagtagctctgctatgcactgggtccaccaggctccaggaaagggtttggagtgggtctcagttattagtacaagtggtgataccgtactctacacagactctgtgaagggctgattcaccatctctagagacaatgcccagaattcactgtatctgcaaatgaacagcctgagagccgacgacatggctgtgtattactgtgtgaaaga

SEQ ID NO: 136 - DNA, 235 bp, Homo sapiens
ctggtgaagcccccaaagaccctctccctcatgtgtgtcatctctgcattctccatcacaaccagtgcttcctcctggatctgcatccatcaccccctctctgggagggaatggagtggattgggtccatagatgatgaagggagcacacattactcccctttcctcaagagtccagtcaccatccccagatccatgtccaaaaacagttcttcctacagctgagctacatgagc

SEQ ID NO: 137 - DNA, 5211 bp, Homo sapiens
ctccaccaagggcccatcggtcttccccctggtgccctcctccaggagcgtctctgagggcacagcggccctgggctgcctggtcaaggactacttccccgaaccggtgacggtgtcgtggaactcaggggccctgaccagaagcgtgcacaccttcccggctgtcctacagtcctcaggactctactccctcagcagcgtggtgaccgtgccctccagcagcttgggcacccagacctacacctgcaacgtagatcacaagcccagcaacaccaaggtggacaagacagttggtgagaggccagcacagggagggagggtgtctgctggaagccaggctcagccctcttgcctggacgtaccccggctgtgcagccccagtccagggcagcaaggcaggccccatctgtctcctcacccggaggcctctgcccgccccactcatgctcagggagagggtcttctggctttttccaccaggctccaggcagccacaggctggaagcccctaccccaggccctgcgcacaaaggggcaggtgctgcacttagactggccaagagccatatccgggaagaccctgcccctgacctaagcccaccccaaaggccaagatctccactccctcagctcagacacctctcctcccagatctgagtaactcccaatcttctctctgcagagcccaaaaccccatgttgtgacacaactcacacatgcccaccatgtgcaagtaagccagcccaggcctcgccctccagctcaaggcgggacaggtgccctagagtagcctgcgtccagggacaggccccaaccgggtgctgacacgtccgcctccatctcttcctcagcaactgaacccctggggggaccgtcagtcttcctcttccccccaaaacccaaggataccctcatgatctcccggacccctgaggtcacgtgcgtggtggtggacgtgagccacgaagaccctgaggtcaagttcaactggtacgtggacggcgtggaggtgcataatgccaagacaaagccgtgggaggagcagtacaacagcacgtaccatgtggtcagcgtcctcaccgtcgtgcaccagaactggctgaacggcaaggagtacaagtgcaaggtctccaacaaaggcctcccagcccccatcgagaaaaccatctccaaaaccaaaggtgggacccacggagcgcgaaggccacgtggacagaggccggcttggcccaccctctgccctgggagtgaccgctgtaccaacctctgtccctacagggcagccccgagaaccacaggtgtacaccctgcccccatcccagaagatgaccaagaaccaggtcaccctgacctgcctggtcaaaggcttctaccccagcgacatcgccgtggagtgggagagcaatgggcagccggagaacaactacaagaccacgcctcccatgctggactccaacggctccttcttcctctatagcaagctcaccgtggacaagagcaggtggcagcaggggaacgtcttctcatgctccgtgatgcatgagggtctgcagaaccactacacgcagaagagcctctccctgtccccggggtaaatgagtgcgacggccggcaagcccccgctccccgggctctcgcggtcgcacgaggatgcttggcacgtaccccgtctacatacttcccaggcacccagcatggaaataaagcacccaccactgccctgggcccctgcgagactgtgatggttctttccacgggtcaggccgagtctgaggcctgagtggcatgagggaggcagagcgggtcccactgtccccacactggcccaggctgtgcaggtgtgcctgggccgcctagggtggggctcagccaggggctgccctcggcagggtgggggatttgccagcgtggccctccctccagcagcacctgccctgggctgagccacgagaagccctaggagcccctggggacagacacacagcccctgcctctgtaggagactgtcctgttctgtgagcgccctgtcctccgaccccccatgcccactcgggggcatgcctagtccatgtgcgtagggacaggccctccctcacccatctacccccacggcactaacccctggcagccctgcccagcctcgcacccgcatggggacacaaccgactccggggacatgcactctcgggccctatggagggactggtccagatgcccacacacacactcagcccagacccgttcaacaaaccccgcactgaggttggccggccacacggccaccacacacacacgtgcacgcctcacacacggagcctcacccgggcgaactgcacagcacccagaccagagcaaggtcctcgcacacgtgaacactcctcggacacaggcccctacaagccccatgcggcacctcaaggcccacgagcctctcggcagcttctccacttgctgaccagctcagacaaacccagtcctcctctcacaaagtgcccctgcagccgccacacacacacaggggatcacacaccacgtcacgtccctggccctggcccacttcccaatacagcccttccctgctcctggggtcacatgaggggtgggcttcatatctcctgccctctggggctcagggagggacacgggagacggggagcgggtcctgctgagggccaggtcgctatttagggccgggtgtctggctgagccccagggccaaagccggtgcccaggatggacagcttccgggagctgacctcaggacactgttgggccatcgaggccgggccctacatcctaggccccgccacagagggaatcacccccagaggcccaagcccagggggacacagcactgaccacccccttcctgtccagagctgcaactggaggagagctgtgcggaggcgcaggacggggagctggacgggctgtggacgaccatcaccatcttcatcacactcttcctgctaagcgtgtgctacagtgccaccgtcaccttcttcaaggtcggccgcacgttgtccccagctgtccttgacattgcccccatgctgtcacacactgtccctgacactgtccccaggctgtccccacctgtccctgacgctgtcccccacgctctcacaaactgtccctcactctgtacccacctgtccaacagtgtcccccagactgtctccacatgtccctgacactatccccaacgctgtcgccacctgtccctgacactccccaacgctgtacccacctgtccaacagtgtcccccagactgtctccacatgtgcctgacactatccccaatgctgcacccacctgtccctgacactgtcccccacactgtcacaaactgtccctgacactgtcccccacacgttccctgtccctgacactgtcccctgtgctgtcacaaactgtcactgacagtgtcccccacactatccccacctgtccctgacgctgtcccccacactatccccacctgtccctgacgctgtcccccacactatccccacctgtcccggacactattccccacactgtccccaccagtccccaacactgtaccccatgctatccccacctgtccccaacactgtcccccacagtcccctcctgtccctgaatgtcccccatgctgtttcctcctgtcccctcctgtcccgacactgtcccctacactgtcttctcgtctcctcctatccctgacactgtcccccacgctgtcccctcctgtccccaacaatgtcccccacagtttcctcctgtacctcacactgtcccccatgctgtcttctcctgtctcctcctgtccctgacactgtcccccacgctgtcaccacctgtccccgacactgtcccccatactgtccccacctgtccccgacactgtcccccacgctgtcccctcctgtccccaacactgtccccatgctgtctcctcctgtctctgacactgtcccccactctgtcccctacagtccctgacactgtccccatgctttcccctcctgtatgcaacactgtcccccatgctgtctcctcctgtccctgacactgtcccccatgctgtccccacctgtcccactgtcccacatgctgtccccacctgtccctgacactgtccccgacactgtctctcatgctgtccccacccatctccgacactgtaccccatgctgtccccacctgtccttgacactgtcccccatgctgtccccacctgtccctgatgctgtcccccacactgtccccatctgtccctgacactctccccaatgctgtccccacctgtccctgacactgtcccccacgctgttcccacctgtccccgacactgtcccccacactgtccccacctgtcccaacaatgtcctcacactgtccccacctgtcccgacactgtccatgctgtccgcacctctccctgacactgtcccccatgctgtccccacctctccctgacgctgtcccccacactgtcccctctccctgacactgtcccccacactgtccccacctttccctgacactgtcccccacgctgtccccacctccccctgacactgtcccctacactgttcccacctctccctaacactgtcccccacgctgtcccctcctgtccccaacactttcccccacgctgtccccaccagtccccaacactgtacaccatgctttccccacctgtccccaacactgtcccccacactgtcccctcctgtccccaaaaatgtcccccacactgtttcctcctgtccccaacactgtccaccactctgtctcctcctgtccctgacactgtcccccactctgtccccacctgtccccaacactatcccccacactgtctccacctgtccctgacgctgtcttctgtactgcccacatgctgttggtgccctggctctgctctccatgtccaggcctcagagcaggcagtggtgaggccctggcacctgggtggactgaagggcggatgggcctcaggggcagggctgtggcctgggtggcatgaggggtgggtggaccttgggggaagagatgtggccctcagtgccctgaggggtgggtggggctcggggacagggctgtggcctcgctcacccctgtgctgtgccttgcctacaggtgaagtggatcttctcctcggtggtggacctgaagcagaccatcgtccccgactacaggaacatgatcgggcaggg

SEQ ID NO: 138 - DNA, 280 bp, Homo sapiens
attgtacagcccagtggttcactgagactctcctgcaaagcctctgatttcacctttactggctacagcatgagcttggtccagcaggcttcatgacagggattggtgtgggtggaaacagtgagtgatcaagtgggagttctcagagttactctccatgagtacaaataaattaacagtcccaagcgacaccttttcatgtgcagtctaccttacaatgaccaacctgaaagccaaggacaaggctgtgtattactgtgagggacacaggagagggaat

SEQ ID NO: 139 - DNA, 450 bp, Homo sapiens
atggagttggggctgaggtgggttttccttgctgctattttaaaaggtgatttatggagaactagagctattgagtgtgaatggacataagtgagcgaaacagtggatatgtgtggcagtttcttaccaggatgtctctgtgtttgcaggtgtccagtgtgagatgcagctggtagagtctggagcaaacttgacaaagcctgggtgtccctgagactctcctgtgcagcctctggattcaccttcagtagccatagcacgcactgggtcccccaggctccagggaagggtctgcagtgggtcccagttattagtggtagtggtagtaccatgtactacgcagactctgtgaagggccgattcaccatttccagagacaataccaaaaactcactgtatctgcaaatgaacagactgagggcagaggatgcagctgcatatgactctgtg

SEQ ID NO: 140 - DNA, 291 bp, Homo sapiens
gaagtttactgatggagtcagagggggaaaaaatttacagcccagtggtgagactctcctgcaaagcctctggtttcacctttactggttacagcatgagcttggtccagcacgcttcacaacagggataggtgtgggtgccaacagtgagtgatcaagtatgaattctcagggttactttccatgagtacaaataaattaacaatctcaagcaacacccttttaagtgcagtctgccttacaatgaccaatctgaaagccaaggacaaggtcatgtattactgtgagtga

SEQ ID NO: 141 - DNA, 37 bp, Homo sapiens
gggaggggctgcaatggataaaatccattgctagtgg

SEQ ID NO: 142 - DNA, 46 bp, Homo sapiens
ctaattttccataccgccagatgtcctattcaggagcagctacagc

SEQ ID NO: 143 - DNA, 331 bp, Homo sapiens
gggctgttctcagtctgttgcttctgtgcttgcagaggtcccctgtgaagttaattactggagtctctcagagaaatactacagaccaagaattctcagacttttctggaaaccctgtggattcactttcactgaaaacagcataagcttggtccagcaggcttcatgacaggggtgggtgtaggtgataacatcagtaattcaagtggaagttctcagtgggactctccttgagtacaaagaagattaacagtcctcagagacacgcttttcagatgattctctcttaagatgattaacctgagagctcaggaaaattccgtttattact

SEQ ID NO: 144 - DNA, 291 bp, Homo sapiens
gtgcagctggtggagtctgggggaggcttggtagagcctggggggtccctgagactctcctgtgcagcctctggattcaccttcagtaacagtgacatgaactgggtccgccaggctccaggaaaggggctggagtgggtatcgggtgttagttggaatggcagtaggacgcactatgcagactctgtgaagggccgattcatcatctccagagacaattccaggaacttcctgtatcagcaaatgaacagcctgaggcccgaggacatggctgtgtattactgtgtgaga

SEQ ID NO: 145 - DNA, 250 bp, Homo sapiens
ttctcttcctcacatgccccatttctgggttgtccatcccaaccaacagttactgctggagctgaatccactagcccgcttccatgggctgtcaggaacacattgcaagggtgacacacacgatgatccatctctgcagagccaactctccttctccagagattcatccaagaaacaattttgactatacctgagctctgtgacatctgaggacatggtttgtattactgtgcaagacaaacagtgagag

SEQ ID NO: 146 - DNA, 445 bp, Homo sapiens
tatggggtttgagctaaccagaatttttcttgttgctattttaaaaggtgactcatagagaaatagagtgagtgagagtgagtggatataagtgagaaaaacagtagatgtgtttggcagtttctgaccaggacgtttgtgtattttcaggtgttcagtgtgaggtggagctgatagagtccatagagggcctgagacaacttgggaagttcctgagactctcctgtgtagcctctggattcaccttcagtagctactgaatgagctgggtcaatgagactctagggaaggggctggagggagtaatagatgtaaaatatgatggaagtcagatataccatgcagactctgtgaagggcagattcaccatctccaaagacaatgctaagaactcaccgtatctccaaacgaacagtctgagagctgaggacatgaccatgcatgg

SEQ ID NO: 147 - DNA, 259 bp, Homo sapiens
ggcctggtgaggccctcacagaccccctccctcacctgtgctgtctctggattctccatcacaactagtgcttcctgctggagctggatccgccagtcctcagtcaagggagtggatcagggcataggtcacgagggagcacaaattctaacccactcctcatgagctcagtcaccatctccagatccacgtccaagaaccaaattttcttttagctgagttctgtgaccaacaatgccacaaccttgtattactgtga

SEQ ID NO: 148 - DNA, 462 bp, Homo sapiens
atggagtcatggctgagctgggtttttcttgccgctattttaaaaggtaattcattgagaactattgaaattgagtgtgagcggataagagtgagagaaacagtggatacgtgtggcagtttctgaccagggtttctttttgtttgcaggtgtccagtgtgaggtgcagctggtggagtctgggggaggcttggtacagcctggggggtccctgagactctcctgtgcagcctctggattcaccttcagttactactacatgagcggggtccgccaggctcccgggaaggggctggaatgggtaggtttcattagaaacaaagctaatggtgggacaacagaatagaccacgtctgtgaaaggcagattcacaatctcaagagatgattccaaaagcatcacctatctgcaaatgaagagcctgaaaaccgaggacacggccgtgtattactgttccagaga

SEQ ID NO: 149 - DNA, 54 bp, Homo sapiens
attctcttttaagataataaaactgagagcccaagacaagtctgtgtattactg

SEQ ID NO: 150 - DNA, 484 bp, Homo sapiens
gtgggttgggtgcacaggtcatgaaggcagcaaaaattccaacccactcctcaagagtccagtcgccacctccagatctatgtccgccggggcagctcttcctatggctgagctacatgagcaacaagcaaataaccatgttttttgttgttgttgtttagttttgttttgctttgtttttagacagagtctcgctgtgtcacccaggctggagtgcagtggtgcgatctcagctcactgcaatctctgcctcctgagttcaagtgattctcctgcctcagcctgccctagtagctgagactacaggcactcactacgacgcccagctaatatttgtatttttagtagagacagggtttcactatgttggccaggctgttcttgaactcttgacttcgtgatccacccgcctcagcctcccaaagtgccgggattacaggcgtgagccaccgcgctcagccacaaccatgtatttttaagcaaa

SEQ ID NO: 151 - DNA, 1256 bp, Homo sapiens
gcctccacacagggcccatccatcttccccttgatcccctgctgcaaagacattgcctctgatgccacctccatgaacctgggctgcctggccacaggctacttcctgaagtcagtgactgtgacctgggacacaggctccctcaacaggagcgctgggaccttcccagccaccaccctcacgccctctggccattacgccatcaccagccagctgactgcctcgggtgcgtgggccaaacgctcacctgcagcgtggcacacactctgtggtccgcagaccaggtcagtaccttcagcatctactccagggacttcaccctccccaccgtgaagatcttacagtcctcctgtgatggcagtggacacttacccccgaccatccagttcctgtgcctcatctctgggtacacccaggtgccatcagcatcacctggctggaggatgggcaggtcgtggatgtgaactggtccatcgcctctcccatactggaggatgagctggcctccacacaaagcaagctcaccctcacccagaagcgctggctgcccgaccacacctacacctgccaggtcacctatcaaggtaacacctttgaggacagtgccaagaagtgtgcagattctaacccgcaaggggtgagcacctacctgagccggtccagccccttctacctgttcatccgcaagttgcccacaatcacctgtctggtggtggacctggcacccagcaaggagaacgtgaagctgacttggtcccaggccagtgggaagtctgtggctcaggtcatcctaaggcaagagaagcagtgcaatggcacgttcaccatcacgtccaccctgctggtgggcaccagagactggatcaagggggagacctaccagtgcagggtgacccacacccacctgcagtccacgaccaagatcagcggcccatgtgctcccccacaggtctacgtgtttgcaacgctagaagagccgaggaaccaggacaagcgcaccctcacctgcctgatccagaacttctggcccaaggacatcttggtgcagtggctgtacaacgaggtgcagctcccggacacttggcacagcatgacgcagccccgcaaaaccaagggctctggcgtcttagtcttcagctgcctggaggttaccagggctgaatgggaacagaaaaacgagttcatctgctctgtggtccatgagacagcgactggctcacagaccgtcaagtaactgttgtctgtaaatcccatta

SEQ ID NO: 152 - DNA, 88 bp, Homo sapiens
gatttattgtctccagagacaatgtcaagaatatgctatatctgcaaatgggcgatctgtaaaccaagaacacatcagtatatcactg

SEQ ID NO: 153 - DNA, 28 bp, Homo sapiens
gaggtgcaggtggtggagtgtaggggag

SEQ ID NO: 154 - DNA, 419 bp, Homo sapiens
atcctcttcttggtggcagctgccacaggtaaggggctcccaagtcctagtgatgaggaggggattgagtccagtcaagggggcttttatcatctcctcccttctcctcacagatgtccattcccaggttcagctgttgcagcctggggctgaggtgaagaagcctgcgtcctcagtgaaggtctcctgccaggcttccagatacaccttcaccaaatactttacacagtgggtgcgacagggccctggacaagggcatagtggttgggatgcatcaacccttacaatgataacacacactacgcacagaagttccggggcagagtcaccattaccagtgacaggtccgtgagcacagcctacatggagctgagcagcctgagatctgaagacatggtcgtgtattcctgtgtgagaga

SEQ ID NO: 155 - DNA, 296 bp, Homo sapiens
aagtcctgtatgaagttcagtggtggagtcagaggggtaaacgtagtacagcccagtggttcactgagactttcttgcaaagcgtctggattcaccttttctggcaacagcctgaggttggtccagcaggcttcacaacagggattgtggtggctggcaacagtgagtcaacaagtgggagtgctcaggtttactcttcatgagtacaaataaattaactggtccagcgacaccctttcacgtgcactctaccttacaatgactaacctgaaagccaaggacaaggttgtgtaata

SEQ ID NO: 156 - DNA, 261 bp, Homo sapiens
agcctggctattctcttagcttcttctgcaaagcatcaagattcaccttcactgactgcagcatttattgggccctgatggctggaggagaggggctggagtgggtggtagccatgagtgacccaagtggaagttctcagtggtgctctgctccagcacaaagaagattcacagttcctggggacaacacttaacatcacaatctcccttaaaattatctactggaaagctgaggagtaggcagtgtattactgtgagaga

SEQ ID NO: 157 - DNA, 462 bp, Homo sapiens
atggagtcatggctgagctgggtttttcttgccgctattttaaaaggtaattcattgagaactattgaaattgagtgtgagtggataagagtgagagaaacagtggatttgtgtggcagtttctgaccagggtttctttttgtttgcaggtgtccagtgtgaggtgcagctggtggagtccgggggaggcttggtccagcctggggggtccctgagactctcctgtgcagcctctggattcaccttcagtgactactacatgagctgggtccgccaggctcccgggaaggggctggagtgggtaggtttcattagaaacaaagctaatggtgggacaacagaatagaccacgtctgtgaaaggcagattcacaatctcaagagatgattccaaaagcatcacctatctgcaaatgaacagcctgagagccgaggacacggccgtgtattactgtgcgagaga

SEQ ID NO: 158 - DNA, 430 bp, Homo sapiens
gctttactccacgcttctcctgctgactgtcccttcctgtgagttcagtggtcagggaatccttcaggggtgaaacacctgttcttttctttgtgggcttcatcttcttatgctttctccacaggggtcttatcccaggtcaccttgaaggagtctggtcctgcactggtgaaacccacacagaccctcatgctgacctgcaccttctctgggttctcactcagcacttctggaatgggtgtgggttagatctgtcagccctcagcaaaggccctggagtggcttgcacacatttattagaatgataataaatactacagcccatctctgaagagtaggctcattatctccaaggacacctccaagaatgaagtggttctaacagtgatcaacatggacattgtggacacagccacacattactgtgcaa

SEQ ID NO: 159 - DNA, 241 bp, Homo sapiens
ccaggtgccctgtctttggagcagctacaggagtcaggcccagactagaagagcccacactgaccttctgcatcacttatgctctctctggccactacatcacaaacagtgcttatgactgggcctgaatctgccagcccaggaaagggctggaatggatggggtgcattggtagtgatggtgggggtcctactagcctgtggcaaatggaagcatctcttttttatcagactgaataata

SEQ ID NO: 160 - DNA, 302 bp, Homo sapiens
gtatccagggtgaggcccagcttacagagtctgggggagacttggtacactgagaggggcccctgaggctctcctgtgcagcctcttggttcaccttcagtatctatgagattcactgggtttgccaggcctcagggaaggggctggaatgggttgcagttatatggcgtagtgaaagtcatcaatacaatgcagactatgttaggggcagactcaccacttccagagacaacaccaagtacatgctgtacatgcaaatgaacagcctgagaacccagaacatggcagcatttaactgtgca

SEQ ID NO: 161 - DNA, 290 bp, Homo sapiens
atgggctggacctgcaagatcctcttcttggtggcagcagccacaggtaagcagttcccaggtccaagtaatgaggaggggattgagtccagtcaagggggctttcatccactcctgtgtcctccccacaggtgcccactcccaggtgcagctggtgcaatctggggctgaggtgaagaagcctggggcctcagtgaaggtctcctgcaaggcttctggatacaccttcacctactgctacttgcactgggtatgacaggcccctggacaagggcttgaatggacaggat

SEQ ID NO: 162 - DNA, 461 bp, Homo sapiens
atggggtttgtgctgacttgggatttacttgttactattttaaaagtagattcagggtgaactagagattttgagtgtgagtggataacagttaaggaaacactgaaaatatgtgccagtttctgaccaggatgcccctgtgtttttgggtgtccagtgtgaggcgcagttgttggagcctgggggagacttggtacagcctggcgcggtgggggtgggggtccctgagactgtcctgtgcagcctctggatttgccttcagtagccactggatgcactgggcctgccaggctccagggaacagactggagtgggtctcatgtattagtactgatgggagtagcatacgctatgcacattctgggaagttctgattccccatctccagaaacaatgccaagaacacactcttatctggaaatgaacagtttgagagctgagtacacagccacgtattactg

SEQ ID NO: 163 - DNA, 280 bp, Homo sapiens
ggcctggtgaagccttcacagaacctctccctcacctgtgccatctctgcattctccatcacaaccagtgtttccttctggagctgcatccatcagcgcccccatgggaggtactggagtggatcgggtgcataggtcatggagggagcacagattactcccctcttctcaagagtccagtcaccatctccagatccatgtccaaaaagtacttcttcttacaggtgaactatgtgagcaacaaacacatagccatgtattttagagcaaaagacacagt

SEQ ID NO: 164 - DNA, 133 bp, Homo sapiens
ctgatagagtcaggggggaaaattgtacagcccagtggttcactgagactctcatgcaaagcctctgatttcacctttactggctacagcatgagcttggtccagcaggcttcatgacagggattggtgtggg

SEQ ID NO: 165 - DNA, 241 bp, Homo sapiens
ctctcctcacctgcactgtctctggattccccatcataaccagtgtttcctgctagaattgtatctgcttgcccctagaagatggacaggagtggatcaggtgcatgggttgtgaagggagcacaaattacaacccactgctcaagagtccatatccagatccaagaaacagttcttacagctgagctctgtgcccagtgaacacacaactacgcatttttaagcaaaagacgcaatgaag

SEQ ID NO: 166 - DNA, 267 bp, Homo sapiens
gtcctgtgtgaagtttactgatggagtcagagggagaaagattgtacagcccagcggttcactcagccactcctgcaaagactctggatcaccttcactgattgcagcataagcttggtccagcaggctccaggaccagagttggcgtgggcagcaacagggagaaattcaagaggaagttcttacatgcacccttacgtgcacggtctcactgagatctttacttcctttatcacgtttgttctgtaaatcacaacgaatggtgca

SEQ ID NO: 167 - DNA, 301 bp, Homo sapiens
gtgaggcgcagctggtggagtctgggggaggcttggtacagcctgggtgggtccccgagactctcatttgcagcttctagattcaccttcagtgacttctgaatgcactggatccgccaggcttctgggaaagggctggagtgggttggccgtattagaaccaaacgtaacagttacacgacagaatgcgctgcatctgtgaaaggcaggttcaccatctcaagagatgattcaaagaacacactgtatctgcaagtgaataccctgaaaaccgagtacacggccatctattactgtacta

SEQ ID NO: 168 - DNA, 180 bp, Homo sapiens
gggcctggacccagcagccctctgggaaggcgctggggcacctcagctccaggggcagcacacacttcagcccagcctttctgggccaactctccatctgtagagacacatccaaggcccagttatccctgcagctgagctccgtgatggccaagggcagggccgcacattcccgtggga

SEQ ID NO: 169 - DNA, 432 bp, Homo sapiens
atggagtctgggctgagctgggtttcacagttgttattttaaaaggtaaaccagagaaatagagtgtgagtgaatatatttgagagaaacagtggatatgtcaggcagtttctcaccaggatctctacgagtttacgggtgtccagtgtgaggtacagctggtggagtctggagaggacccaagacaacctgggttccctgagactctcctgtgcagcctctggattaaccttcagtagctactgaatgagctcggtttcccaggctccagggaaggggctggagtgagtagtagatatacagtgtgatggaagtcagatatgttatgcacaatctgtgacgagcagattcaccgtctccaaagaaaatgccaagaactcactgtatttgcaaatgaacagtctgagagcagagggcacagctgtgtgttac

SEQ ID NO: 170 - DNA, 427 bp, Homo sapiens
attaagctgaatttttcttgttggtattttaaaaggtgactcctagggaactagagtgagtgagagtgagtggatatgagtgagagaaacagtggatatgtttgccagtttctgaccaggatgtgtgtgtattttcaggtgttcagtgtgaggtggagctgatagagtccatagaggacctgagacaacctgggaagttcctgagactctcctgtgtagcctctagattcgccttcagtagcttctgaatgagccgagttcaccagtctccaggcaaggggctggagtgagtaatagatataaaagatgatggaagtcagatacaccatgcagactctgtgaagggcagattctccatctccaaagacaatgctaagaactctctgtatctgcaaatgaacactcagagagctgaggacgtggccgt

SEQ ID NO: 171 - DNA, 414 bp, Homo sapiens
atgtactggacctggaggatcctcttcttggtggcagcagcaacaggtaagggacctcccagtcaccgggctgagagagaaaccaggccagtcaagtgagacttcacgcactcctgtctcctctccacaggtgtccactcacaggtgcagctggtgcagtctgggcctgaggtgaagaagcctggagcctcattgaaggtttcctgcaaggcttctggatacaccttcacaagctatgctatcagctgggtatgacaggcccatggacaagggcttgaggaaatgggatggatcaacaccaacactgggaacctaacgtatgcccagggcttcacaggacggtttgtcttctccatggacacctccgtcagcatggcatatcttcatatcagcagcctaaaggctgaggacacg

SEQ ID NO: 172 - DNA, 256 bp, Homo sapiens
ggcctggtggagccctcgcagaccctctccctcacctgtgctgtctctggattttccatcacaaccagtgtttcctgctggagctggatccacgagtccacatgggaaggactggagtggaccaggcgcacacgtcatgaagggagcaaaaattcccacccactccttatgaatccagtcaccatctccaaattcgggtccaaaaaacacttgtttttacagtggagctatgtgagcaacaagctcacagccatgt

SEQ ID NO: 173 - DNA, 451 bp, Homo sapiens
atgaaacacctgtggttcttcctcctgctggtggcagctcccagatgtgagtgcctcagggatccagacctgaagatatgagatgctgcctctcatcccagggctcaccgtggttctctctgttcacaggggtcctgtcccaggtgcagctgcaggagtcgggcccaggactggtgaagccttcggagaccctgtccctcatctgcgctgtctctggtgactccatcagcagtggtaactggtgaatctgggtccgccagcccccagggaaggggctggagtggattggggaaatccatcatagtgggagcacctactacaacccgtccctcaagagtcgaatcaccatgtccgtagacacgtccaagaaccagttctacctgaagctgagctctgtgaccgccgcggacacggccgtgtattactgtgcgagatacacagtgaggggagg

SEQ ID NO: 174 - DNA, 444 bp, Homo sapiens
atggacacgttttgctccacactcctgctgctgaccaccccttcctgtgagtgttgtggtcagggacttcctcagaagtgaaacatcagttctctcctttgtgggcttcatcttcttatgtcttctccacaggggtcttgtcccaggtcaccttgaaggagtctggtcctgcgctggtgaaacccacagagaccctcacgctgacctgcactctctctgggttctcactcagcacttctggaatgggtatgagctggatccgtcagcccccagggaaggccctggagtggcttgctcacatttttttgaatgacaaaaaatcctacagcacgtctctgaagaacaggctcatcatctccaaggacacctccaaaagccaggtggtccttaccatgaccaacatggaccctgtggacacagccacgtattactgtgcatggagag

SEQ ID NO: 175 - DNA, 298 bp, Homo sapiens
gggacattgtgctgacccagtctccagcctccttggccgtgtctccaggacagagggccaccatcacctgcagagccagtgagagtgtcagtttcttgggaataaacttaattcactggtatcagcagaaaccaggacaacctcctaaactcctgatttaccaagcatccaataaagacactggggtcccagccaggttcagcggcagtgggtctgggaccgatttcaccctcacaattaatcctgtggaagctaatgatactgcaaattattactgtctgcagagtaagaattttcc

SEQ ID NO: 176 - DNA, 523 bp, Homo sapiens
gaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataaataaagtgaatctttgcacctgt

SEQ ID NO: 177 - DNA, 38 bp, Homo sapiens
gatcaccttcggccaagggacacgactggagattaaac

SEQ ID NO: 178 - DNA, 37 bp, Homo sapiens
ctcactttcggcggagggaccaaggtggagatcaaac

SEQ ID NO: 179 - DNA, 38 bp, Homo sapiens
attcactttcggccctgggaccaaagtggatatcaaac

SEQ ID NO: 180 - DNA, 38 bp, Homo sapiens
gtacacttttggccaggggaccaagctggagatcaaac

SEQ ID NO: 181 - DNA, 38 bp, Homo sapiens
gtggacgttcggccaagggaccaaggtggaaatcaaac

SEQ ID NO: 182 - DNA, 757 bp, Homo sapiens
tttggctcttgatttacattgggtactttcacaacccactgctcatgaaatttgcttttgtactcactggttgtttttgcataggcccctccaggccacgaccagctgtttggattttataaacgggccgtttgcattgtgaactgagctacaacaggcaggcaggggcagcaagatggtgttgcagacccaggtcttcatttctctgttgctctggatctctggtgaggaattaaaaagtgccacagtcttttcagagtaatatctgtgtagaaataaaaaaaattaagatatagttggaaataatgactatttccaatatggatccaattatctgctgacttataatactactagaaagcaaatttaaatgacatatttcaattatatctgagacagcgtgtataagtttatgtataatcattgtccattactgactacaggtgcctacggggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcct

SEQ ID NO: 183 - DNA, 553 bp, Homo sapiens
ataaaatctgtgctgtcaaactgattaggaactgactaccacctgcaggtcagggccaaggttatggggtcccaggttcacctcctcagcttcctcctcctttggatctctggtaagagaaacacttcctctcctctgtgccaccaagtcccctgcatatccacaaaaataatatattttcataaggaattgattttcctcattctctgcaaatatgatgcatttgatttatgttttttactttgctccataatcagataccagggcagaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataatttccct

SEQ ID NO: 184 - DNA, 616 bp, Homo sapiens
atcttaaaagaggttctttctctgggatgtggcatgagcaaaactgacaagtcaaggcaggaagatgttgccatcacaactcattgggtttctgctgctctgggttccaggtgagaatatttccacaaacctaggcggagatattctttcaatctgtaatttctttcattggggactctgcaataggtgatttttggcttgattttaaaatcctaattttaaaaatgtaatgcatattctttcttcatgtctagcaagattaaaggtgattttcatacacagatatttatgttgtactgatgtttgctgtatattttcagcctccaggggtgaaattgtgctgactcagtctccagactttcagtctgtgactccaaaggagaaagtcaccatcacctgccgggccagtcagagcattggtagtagcttacactggtaccagcagaaaccagatcagtctccaaagctcctcatcaagtatgcttcccagtccttctcaggggtcccctcgaggttcagtggcagtggatctgggacagatttcaccctcaccatcaatagcctggaagctgaagatgctgcaacgtattactgtcatcagagtagtagtttacct

SEQ ID NO: 185 - DNA, 314 bp, Homo sapiens
gatccagtgaggatattgtgatgacccagactccactctccctgcccgtcacccctggagagccggcctccatctcctgcaggtctagtcagagcctcttggatagtgatgatggaaacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtttcct

SEQ ID NO: 186 - DNA, 781 bp, Homo sapiens
gatcaggactcctcagttcaccttctcactatgaggctccctgctcagctcttggggctgctaatgctctgggtccctggtaaggacagaaggagatgagggaggagaatggggtgggaaggtaagcctggggaccccactgccttccatgtgtgttctgccctgcccatgtgttagatgtacaggtcttgttctccaggatggggaatgtgaggtttaaatctgtgagagtgaggacgattcaaaaagaagcaaggacctgtgtgctctggtgaatatcgtcacacagagaaagggaggtggtgtaggtgacttctagaatcccctttgcagcttgcaaatttggaatatgtttagtgtataaatacaaacaacaaaaaattatatagcctgaaataaaaaatgaaaatttatgataaatgacacatgatatttgtacatatccttccacttctttctatctattttaggatccagtgcagagattgtgatgacccagactccactctccttgtctatcacccctggagagcaggcctccatgtcctgcaggtctagtcagagcctcctgcatagtgatggatacacctatttgtattggtttctgcagaaagccaggccagtctccacgctcctgatctatgaagtttccaaccggttctctggagtgccagataggttcagtggcagcgggtcagggacagatttcacactgaaaatcagccgggtggaggctgaggattttggagtttattactgcatgcaagatgcacaagatcct

SEQ ID NO: 187 - DNA, 632 bp, Homo sapiens
gcatgtccctcccagccgccctgcagtccagagcccatatcaatgcctgggtcagagctctggggaggaactgctcagttaggacccagagggaaccatggaaaccccagcgcagcttctcttcctcctgctactctggctcccaggtgaggggaacatgggatggttttgcatgtcagtgaaaaccctctcaagtcctgttacctggcaactctgctgaatcaatacaataattaaagctcaatataaagcaataattctggctcttctgggaagacagtgggtttgatttagattacatgggtgacttttctattttatttccaatctcagataccaccggagaaattgtgttgacgcagtctccagccaccctgtctttgtctccaggggaaagagccaccctctcctgcggggccagtcagagtgttagcagcagctacttagcctggtaccagcagaaacctggcctggcgcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacct

SEQ ID NO: 188 - DNA, 577 bp, Homo sapiens
agcaaaactgaagtcaaaacactgagatggtgtccccgttgcaattcctgcggcttctgctcctctgggttccaggtgagaatatttagaaaaagctaaaactaattctttgaaccattaattttcttaattaggaacctggcaccatatggaacttggcttgtttttaaatgtgatttttttttaagtaatgcgtattctttcatcttgtgctactagattagtggtgatttcattaagcagatgcttatattgtgctaatgtttgctgtatggtttcagcctccaggggtgatgttgtgatgacacagtctccagctttcctctctgtgactccaggggagaaagtcaccatcacctgccaggccagtgaaggcattggcaactacttatactggtaccagcagaaaccagatcaagccccaaagctcctcatcaagtatgcttcccagtccatctcaggggtcccctcgaggttcagtggcagtggatctgggacagatttcacctttaccatcagtagcctggaagctgaagatgctgcaacatattactgtcagcagggcaataagcaccct

SEQ ID NO: 189 - DNA, 657 bp, Homo sapiens
gggacacctggggacactgaactggtgctgagttactgagatgagccagccctgcagctgtgtccagcctgcccatcctctgctcatttgcatattcccagaacacaacctcctgccctgaagacttcttaataggctggtcacacttcttgcaggagtcagacccactcaggacacagcatggacatgagggtccccgctcagctcctggggcttctgctgctctggctcccaggtaaggaaggagaacactaacagtttactcagcccagggggctcagtacagcctggctattcagggaaattctcttactacatgattaattgtgtggaccatttgtgtttatgcttccaatctcaggtgccagatgtgccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaataattaccct

SEQ ID NO: 190 - DNA, 611 bp, Homo sapiens
gcatgtccctcccagctgccctaccttccagagcccatatcaatgcctgggtcagagctctggggaggaactgctcagttaggacccagacggaaccatggaagccccagcgcagcttctcttcctcctgctactctggctcccaggtgaggggaatatgaggtgtctttgcacatcagtgaaaactcctgccacctctgctcagcaagaaatataattaaaattcaaaatagatcaacaattttggctctactcaaagacagtgggtttgattttgattacatgagtgcatttctgttttatttccaatttcagataccaccggagaaattgtgttgacacagtctccagccaccctgtctttgtctccaggggaaagagccaccctctcctgcagggccagtcagggtgttagcagctacttagcctggtaccagcagaaacctggccaggctcccaggctcctcatctatgatgcatccaacagggccactggcatcccagccaggttcagtggcagtgggcctgggacagacttcactctcaccatcagcagcctagagcctgaagattttgcagtttattactgtcagcagcgtagcaactggcat

SEQ ID NO: 191 - DNA, 487 bp, Homo sapiens
agtcccagtcaggacacagcatggacatgagggtccccgctcagctcctggggctcctgctgctctggctcccaggtaaggaaggagaacactaggaattttcttagcccactgtgctctggcacttctgggaagttctcttataccatgattcatggtgtggatatttgtttttatgtttccaatctcaggtgtcagatttgacatccagatgatccagtctccatctttcctgtctgcatctgtaggagacagagtcagtatcatttgctgggcaagtgagggcattagcagtaatttagcctggtatctgcagaaaccagggaaatcccctaagctcttcctctatgatgcaaaagatttgcaccctggggtctcatcgaggttcagtggcaggggatctgggacggatttcactctcaccatcatcagcctgaagcctgaagattttgcagcttattactgtaaacaggacttcagttaccct

SEQ ID NO: 192 - DNA, 563 bp, Homo sapiens
gggtcagagctctggggaggaactgctcagttaggacccagacggaaccatggaagccccagcgcagcttctcttcctcctgctactctggctcccaggtgaggggaatatgaggtggttttgcacatcagtgaaaactcctgccacctctgctcagcaagaaatataattaaaattcaatgtagatcaacaattttggctctacttaaagacagtgggtttgattttgattacatgagtgcatttctgttttatttccaatttcagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggcatcccagccaggttcagtggcagtgggtctgggacagagttcactctcaccatcagcagcctgcagtctgaagattttgcagtttattactgtcagcagtataataactggcct

SEQ ID NO: 193 - DNA, 478 bp, Homo sapiens
gcatggacatgagggcccccgctcagctcctgggactcctgctgctctggctcccaggtaaggagggaaacaacaaaaattttattcagccagtgtagccattaatgcctggcacttcaggaaattcttcttagaacattactaatcatgtggatatgtgtttttatgttcctaatatcagataccagatgtgacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccgctttgcaatcagggggtcccatctcggttcagtggcagtggatctgggacagatttcactctcaccatcagcagcctgcagcctgaagatgttgcaacttattactgtcaaaagtataacagtgcccct

SEQ ID NO: 194 - DNA, 619 bp, Homo sapiens
ggtatcttaaaagaggttctttctctgggatgtggcatgagcaaaactgacaagtcaaggcaggaagatgtcgccatcacaactcattgggtttctgctgctctgggttccaggtgagaatatttccacaaacctaggcggagatattctttcaatctgtaatttctttcattggggactctgcaataggtgatttttggcttgattttaaaatcctaattttaaaaatgtaatgcatattctttcttcatgtctagcaagattaaaggtgattttcatacacagatatttatgttgtactgatgtttgctgtatattttcagcctccaggggtgaaattgtgctgactcagtctccagactttcagtctgtgactccaaaggagaaagtcaccatcacctgccgggccagtcagagcattggtagtagcttacactggtaccagcagaaaccagatcagtctccaaagctcctcatcaagtatgcttcccagtccatctcaggggtcccctcgaggttcagtggcagtggatctgggacagatttcaccctcaccatcaatagcctggaagctgaagatgctgcagcgtattactgtcatcagagtagtagtttacct

SEQ ID NO: 195 - DNA, 271 bp, Homo sapiens
gtgacatccagtcacccagtctccatccacactgtctgcatctgtaaggagacagcgtcaccatcacttgccgggcgagtcagagcattggtagtaatttagactggtatcagcagaaaccagggaaggcccctaagggcctgatctatgctgcatccagtttgcaatctggggctccttcgcggttcggtggcagtggatctgggacagattttactctcaccatcagaatcctgcagcctaaagatgttgcaacttattactgtcaaca

SEQ ID NO: 196 - DNA, 557 bp, Homo sapiens
gaggaactgctcagttaggacccagatggaaccatggaagccccagcacagcttcttcttcctcctgctactctggctcccaggtgaggggaatatgaggtggttttgcacatcagtgaaaactccatcaggagttttctctgctcagcaagaaatataattaaaattcaaagtagatgaacaattttggctctactcaaagacagctggtttgatctagattacatgagtgcatttctgttttatttccaatctcagataccaccggagaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacct

SEQ ID NO: 197 - DNA, 821 bp, Homo sapiens
tgactgatcaggactcctcagttcaccttctcacaatgaggctccctgctcagctcctggggctgctaatgctctgggtcccaggtaagggtagaagggagatgagggaggagaatggcatggaacggtgagttctggggccccactgcctctaacaacagtgatctctgggggtctcactacactcctatgtgtgttcctttcctgtattggacatgcacatgttgtcctccagaatggggcatgtgatgatcagatctgtgagagtcaggaagattcaagaagaaacaaggatctgtgctctggggaagactgacacagaaaggggatggtgtggggtcttctggagacccctttgagccttggatcccttgagttccattttgaaactgtatatttttgaaatatgaacaaatacatatatagcctgagataaacaacaaatcaaaatttatgaaaattacacataaactttatacataaccttgctcttctttctatttatttcaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaactgggactctggggtcccagacagattcagcggcagtgggtcaggcactgatttcacactgaaaatcagcagggtggaggctgaggatgttggggtttattactgcatgcaaggtacacactggcct

SEQ ID NO: 198 - DNA, 656 bp, Homo sapiens
gggacacctggggacactgagctggtgctgagttactgagatgagccagctctgcagctgtgcccagtcagccccatcccctgctcatttgcatgttcccagagcacaacctcctgcactgaagccttattaataggctggccacacttcatgcaggagtcagacccagtcaggacacagcatggacatgagggtccccgctcagctcctggggctcctgctgctctggctcccaggtaaggaaggagaacactatgaatttactcagccaatgtgctcagtacagcctggcccttcagggaaattctcttactacatgattaattgtatggatatttgtttttatgtttccaatctcaggtgccagatgtgtcatctggatgacccagtctccatccttactctctgcatctacaggagacagagtcaccatcagttgtcggatgagtcagggcattagcagttatttagcctggtatcagcaaaaaccagggaaagcccctgagctcctgatctatgctgcatccactttgcaaagtggggtcccatcaaggttcagtggcagtggatctgggacagatttcactctcaccatcagttgcctgcagtctgaagattttgcaacttattactgtcaacagtattatagtttccct

SEQ ID NO: 199 - DNA, 506 bp, Homo sapiens
gcaggagtcagacccactcaggacacagcatggacatgagggtccccgctcagctcctggggctcctgctgctctggctcccaggtaaggatggagaacactggcagtttactcagcccagggtgctcagcacagcctggctattcagggaaattctcttactacatgattaattgtgtggaccatttgtttttgtgtttccaatctcaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattaccct

SEQ ID NO: 200 - DNA, 522 bp, Homo sapiens
aggctggtcacaccccgtgcagcagtcagtcccagtcaggacacagcatggacatgagggtccccgctcagctcctggggctcctactgctctgggtcccaggtaaggaaggagaacactaggaatttactcagctggtgcgctcagtatagcctggctcttcagggaggtcttcttataacatgatggattgaatggatgtttgtttttatatttccaatctcaggtgccagatgtgacatccagttgacccagtctccatcctccctgtctgcatctgtaggagacagagtcaccatcacttgccgggtgagtcagggcattagcagttatttaaattggtatcggcagaaaccagggaaagttcctaagctcctgatctatagtgcatccaatttgcaatctggagtcccatctcggttcagtggcagtggatctgggacagatttcactctcactatcagcagcctgcagcctgaagatgttgcaacttattacggtcaacggacttacaatgcccct

SEQ ID NO: 201 - DNA, 587 bp, Homo sapiens
cctgggtcagagctctggagaagagctgctcagttaggacccagagggaaccatggaaaccccagcgcagcttctcttcctcctgctactctggctcccaggtgaggggaacatgggatggttttgcatgtcagtgaaaaccctctcaagtcctgttacctggcaactctgctcagtcaatacaataattaaagctcaatataaagcaataattctggctcttctgggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacct

SEQ ID NO: 202 - DNA, 564 bp, Homo sapiens
atgttcgcagagcacagccccctgccctgaagacttattaataggctggtcgcaccctgtgcaggagtcagtcccaaccaggacacagcatggacatgagggtccctgctcagctcctggggctcctgctgctctggctctcaggtaaggaaggataacactatgaattttctcagccagtgggctcagtacagcctggctcttgatggaagccttcctataatatgactaatagtatgaatatttgtgtttatgtttctaatcgcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccct

SEQ ID NO: 203 - DNA, 503 bp, Homo sapiens
aggaatcagtcccactcaggacacagcatggacatgagggtccccgctcagctcctggggctcctgctgctctggttcccaggtaaggatggagaacactagcagtttactcagcccagagtgctcagtactgctttactgttcagggaaattctcttacaacatgattaattgtgtggacatttgtttttatgtttccaatctcaggtgccaggtgtgacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccct

SEQ ID NO: 204 - DNA, 523 bp, Homo sapiens
aggctggacacacttcatgcaggagtcagaccctgtcaggacacagcatagacatgagggtccccgctcagctcctggggctcctgctgctctggctcccaggtaaggaaggagaacactaggaatttactcagcccagtgtgcttggtacagcctggcccttcagggaagttctcttacaacatgattaattgtatggacatttgtttttatgtttccaatctcaggtgccagatgtgccatccggatgacccagtctccatcctcattctctgcatctacaggagacagagtcaccatcacttgtcgggcgagtcagggtattagcagttatttagcctggtatcagcaaaaaccagggaaagcccctaagctcctgatctatgctgcatccactttgcaaagtggggtcccatcaaggttcagcggcagtggatctgggacagatttcactctcaccatcagctgcctgcagtctgaagattttgcaacttattactgtcaacagtattatagttaccct

SEQ ID NO: 205 - DNA, 656 bp, Homo sapiens
gggacacctggggacactgagctggtgctgagttactgagatgagccagccctgcagctgcgcccagcctgccccatcccctgctcatttgcatgttcccagagcacagtctcctgacctgaagacttattaacaggctgatcacaccctgtgcaggagtcagacccagtcaggacacagcatggacatgagggtccccgctcagctcctggggctcctgctgctctggttcccaggtaagaaaggagaacactaggattatactcggtcagtgtgctgagtactgctttactattcagggaacttctcttacagcatgattaattgtgtggacatttgtttttatgtttccaatctcaggttccagatgcgacatccagatgacccagtctccatcttctgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcactatcagcagcctgcagcctgaagattttgcaacttactattgtcaacaggctaacagtttccct

SEQ ID NO: 206 - DNA, 503 bp, Homo sapiens
aggaatcagacccagtcaggacacagcatggacatgagagtcctcgctcagctcctggggctcctgctgctctgtttcccaggtaaggatggagaacactagcagtttactcagcccagggtgctcagtactgctttactattcagggaaattctcttacaacatgattaattgtgtggacatttgtttttatgtttccaatctcaggtgccagatgtgacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttaccct

SEQ ID NO: 207 - DNA, 503 bp, Homo sapiens
aggaatcagacccagtcaggacacagcatggacatgagggtcctcgctcagctcctggggctcctgctgctctgtttcccaggtaaggatggagaacactagcagtttactcagcccagggtgctcagtactgctttactattcagggaaattctcttacaacatgattaattgtgtggacatttgtttttatgtttccaatctcaggtgccagatgtgacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccct

SEQ ID NO: 208 - DNA, 833 bp, Homo sapiens
aattaggactcctcaggtcaccttctcacaatgaggctccttgctcagcttctggggctgctaatgctctgggtccctggtgaggacagaagagagatgagggaggagaatggggtgggagggtgaactctgggggccccattgcctcccatgtgtgttctgtcctcatgttagatgtgtacgtcttgtactccaggatggggcttgtaacttttatatctgcgtgagtaaggcatgtgaggtttagatctgtaagaatgaggaagattccagaaggaacaaagaccagtgctccggtgaagactctaacagagaaagagggaatggtagaggaaacttctagcactcaaagcactctgctgtgctttgaaaatatgtttttattttgaaattatatattactagggtctgaatcaaattataaaaattgatttagcctgaaataaataacagaagaaaaattattttaaaattgtgcttaaagtttctacataaccttgcacttctctctcattatttcaggatccagtggggatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaagctacacaatttcct

SEQ ID NO: 209 - DNA, 561 bp, Homo sapiens
gtcagagccctggggaggaactgctcagttaggacccagagggaaccatggaagccccagctcagcttctcttcctcctgctactctggctcccaggtgaggggaacatgaggtggttttgcacattagtgaaaactcttgccacctctgctcagcaagaaatataattaaaattcaaagtatatcaacaattttggctctactcaaagacagttggtttgatcttgattacatgagtgcatttctgttttatttccaatttcagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcct

SEQ ID NO: 210 - DNA, 833 bp, Homo sapiens
aattaggactcctcaggtcaccttctcacaatgaggctccttgctcagcttctggggctgctaatgctctgggtccctggtgaggacagaagagagatgagggaggagaatggggtgggagggtgaactctgggggccccattgcctcccatgtgtgttctgtcctcatgttagatgtgtacgtcttgtactccaggatggggcttgtaacttttatatctgcgtgagtaaggcatgtgaggtttagatctgtaagaatgaggaagattccagaaggaacaaagaccagtgctccggtgaagactctaacagagaaagagggaatggtagaggaaacttctagcactcaaagcactctgctgtgctttgaaaatatgtttttattttgaaattatatattactagggtctgaatcaaattataaaaattgatttagcctgaaataaataacagaagaaaaattattttaaaattgtgcttaaagtttctacataaccttgcacttctctctcattatttcaggatccagtggggatattgtgatgacccagactccactctcctcgcctgtcacccttggacagccggcctccatctccttcaggtctagtcaaagcctcgtacacagtgatggaaacacctacttgagttggcttcagcagaggccaggccagcctccaagactcctaatttataaggtttctaaccggttctctggggtcccagacagattcagtggcagtggggcagggacagatttcacactgaaaatcagcagggtggaagctgaggatgtcggggtttattactgcacgcaagctacacaatttcct

SEQ ID NO: 211 - DNA, 534 bp, Homo sapiens
agacttcttaataggctggtcacacctgtgcaggagtcagtcccagtcaggacacagcatggacatgagggtccccgctcagctcctggggctcctgctgctctggctcccaggtaaggaaggagaacactaggaatttactcagcccagtgtgttccgtacagcctggctcttgagggaagttctcttacaacatgattaattctatggacatttgtgtttatatttccaatctcaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccct

SEQ ID NO: 212 - DNA, 506 bp, Homo sapiens
gtgcaggagtcagtcccaaccaggacacagcatggacatgagggtccctgctcagctcctggggctcctgctgctctggctctcaggtaaggaaggataacactaggaattttctcagccagtgtgctcagtacagcctggctcttgatggaagccttcctataatatgactaatagtatgaatatttgtgtttatgtttctaatcgcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccct

SEQ ID NO: 213 - DNA, 522 bp, Homo sapiens
gggctggtcgcaccctgtgcaggagtcagtctcagtcaggacacagcatggacatgagggtccccgctcagctcctggggctcctgctactctggctccgaggtaaggatggagaacactaggaatttactcagccagtgtgctcagtactgactggaacttcagggaagttctctgataacatgattaatagtaagaatatttgtttttatgtttccaatctcaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccct

SEQ ID NO: 214 - DNA, 776 bp, Homo sapiens
ttgactgatcaggactcctcagttcaccttctcacaatgaggctccctgctcagctcctggggctgctaatgctctgggtctctggtaagaaaagaaggagatgaggaaggagaatagggtgggagggtgagctctagggctccacagcatcccatgatcccatgtttagtctaaccctgtgttagaggagtataatctgtgctgtagaaaagggaacttgatattttgctctgtgaataattagaagcctcataagaaatatgacgtctggtgctccgattaagattttcaaaatataaaggtctcttatactttacaaaaattgaattcattttagaatgtgtatttttatggcataaatcagtattttttaaaattaagtttaaataaatgacataagataaattatgaaaattgctcattaggtttgtacataactttgcaattcattatttcaggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcccaca

SEQ ID NO: 215 - DNA, 657 bp, Homo sapiens
gggacacctggggacactgagctggtgctgagttactgagatgaaccagccctgcagctgtgcccagcctgccttgccccctgctaatttgcatgttcccagagcacatcctcctaccctgaagacttattaatgcgctggtcacacttcatgcaggagtcagacccagtcaggacacagcatggacatgagggtgcccgctcagcgcctggggctcctgctgctctggttcccaggtaaggaaggagaaccctagcagtttactcagcccagtgtgttccgtacagcctggctcttgagggaagttctcttacaacatgattaattgtatggacatttgtgtttatatttccaatctcaggtgccagatgtgccatccggatgacccagtctccattctccctgtctgcatctgtaggagacagagtcaccatcacttgctgggccagtcagggcattagcagttatttagcctggtatcagcaaaaaccagcaaaagcccctaagctcttcatctattatgcatccagtttgcaaagtggggtcccatcaaggttcagcggcagtggatctgggacggattacactctcaccatcagcagcctgcagcctgaagattttgcaacttattactgtcaacagtattatagtacccct

SEQ ID NO: 216 - DNA, 657 bp, Homo sapiens
gggacacctggggacactgagctgctgctgagttactgagatgagccagccctgcagctgcgcccagcctgccccatcccctgctcatttgcatgttcccagagcatagcctcctgccctgaagccttattaataggctggacacacttcatggaggaatcagtcccactcaggacacagcatggacatgagggtccctgctcagctcctggggctcctgctgctctggttcccaggtaaggatggagaacactaacagtttactcagcccagagtgctcagtactgctttactgttcagggaaattctcttacaacatgattaattgtgtggacatttgtttttatgtttccaatctcaggtgccagatgtaacatccagatgacccagtctccatctgccatgtctgcatctgtaggagacagagtcaccatcacttgtcgggcgaggcagggcattagcaattatttagcctggtttcagcagaaaccagggaaagtccctaagcacctgatctatgctgcatccagtttgcaaagtggggtcccatcaaggttcagcggcagtggatctgggacagaattcactctcacaatcagcagcctgcagcctgaagattttgcaacttattactgtctacagcataatagttaccct

SEQ ID NO: 217 - DNA, 614 bp, Homo sapiens
gcatgtccctcccagctgccctaccttccagagcccatatcaatgcctgggtcagagccctgggaaggaactgctcagttaggacccagacggaaccatggaagccccagctcagcttctcttcctcctgctactctggctcccaggtgaggggaacatgaggtggttttgcacatcagtgaaaactcctgccacctctgctcagcaagaaatataattaaaattcaatgtagatcaacaattttggctctactcaaagacagctggtttgatctagattacatgagtgcatttctgttttatttccaatcttggataccaccagagaaattgtaatgacacagtctccacccaccctgtctttgtctccaggggaaagagtcaccctctcctgcagggccagtcagagtgttagcagcagctacttaacctggtatcagcagaaacctggccaggcgcccaggctcctcatctatggtgcatccaccagggccactagcatcccagccaggttcagtggcagtgggtctgggacagacttcactctcaccatcagcagcctgcagcctgaagattttgcagtttattactgtcagcaggattataacttacct

SEQ ID NO: 218 - DNA, 816 bp, Homo sapiens
gatcaggactcctcagttcaccttctcacaatgaggctccctgctcagctcctggggctgctaatgctctgggtcccaggtaagggtagaagggagatgagggaggagaatggcatggaacggtgagttctggggccccactgcctctaacaacagtgatctctgggggtctcactacactcctatgtgtgttcctttcctgtattggacatgcacatgttgtcctccagagtggggcatgtgatgatcagatctgtgagagtgaggaagattcaagcagaaacaaggatctgtgctctggggaagactgacacagaaaggggatggtgtggggtcttctggagacccctttgagccttggatcccttgagttccattttgaaactgtgtatttttgaaatatgaacaaatacatatatagcctgaaataaacaacaaatcaaaatttatgaaaattacacataaactttatacataaccttgctcttctttctatttatttcaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcct

SEQ ID NO: 219 - DNA, 758 bp, Homo sapiens
gatcaggacttctcagttcatcttctcaccatgaggctccctgctcagctcctggggctgctaatgctctggatacctggtaaggatggaaggagatgagggaggaggagggggtgggaagctgagctctggcggccccactgattcccgtgtttattctaaccatgtgttaaaggaatatggcctatgctccagggagaggaattcatattttgccctgatgatgatttgaaaactcctaaaagcagtgctctgaataatatcttgagaaatgaaagaactcttgtgcctatttaataaagggttcatttaaagagtttgtttttatgatatgaatacaaatttgtaaaaataaaagattagccataaatcaataccataaggcaaatctcaaaagttgttcattatgctttcacataaccttgcacttctctctcataatttcaggatccagtgcagatattgtgatgacccagactccactctctctgtccgtcacccctggacagccggcctccatctcctgcaagtctagtcagagcctcctgcatagtgatggaaagacctatttgtattggtacctgcagaagccaggccagcctccacagctcctgatctatgaagtttccaaccggttctctggagtgccagataggttcagtggcagcgggtcagggacagatttcacactgaaaatcagccgggtggaggctgaggatgttggggtttattactgcatgcaaagtatacagcttcct

SEQ ID NO: 220 - DNA, 522 bp, Homo sapiens
aggctgatcacaccctgtgcaggagtcagacccagtcaggacacagcatggacatgagggtccccgctcagctcctggggctcctgctgctctggttcccaggtaagaaaggagaacactaggattatactcggtcagtgtgctgagtactgctttactattcagggaacttctcttacagcatgattaattgtgtggacatttgtttttatgtttccaatctcaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccct

SEQ ID NO: 221 - DNA, 657 bp, Homo sapiens
gggacacctggggacactgagctggtgctgagttactgagatgagccagctctgcagctgtgcccagcctgccccatcccctgctcatttgcatgttcccagagcacaacctcctgccctgaagccttattaataggctggtcacactttgtgcaggagtcagacccagtcaggacacagcatggacatgagggtccccgctcagctcctggggctcctgctgctctggctcccaggtaaggaaggagaacactaggaatttactcagcccagtgtgctcagtactgcctggttattcagggaagtcttcctataatatgatcaatagtatgaatatttgtgtttctatttccaatctcaggtgccaaatgtgacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattct

SEQ ID NO: 222 - DNA, 764 bp, Homo sapiens
gatcaggactcctcagttcaccttctcacaatgaggctccctgctcagctcctggggctgctaatgctctgggtctctggtaagaaaagaaggagatgaggaaggagaatagggtgggagggtgagctctagggctccacagcatcccatgatcccatgtttagtcttaccctgtgttagaggagtataatctgtgctgtagaaaagggaacttgatattttgctctgtgaataattagaagcctcataagaaatatgacgtctggtgctctgattaagatcttcaaaatataaaggtctcttatactttacaaaaattgaattcattttagaatgtgtatttttatggcataaatcactattttttaaaattaagtttaaataaatgacataagataaattatgaaaattgctcattaggtttgtacataactttgcaattcattatttcaggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcct

SEQ ID NO: 223 - DNA, 611 bp, Homo sapiens
gcatgtccctcccagctgccctaccttccagagcccatatcaatgcctgggtcagagctctggggaggaactgctcagttaggacccagacggaaccatggaagccccagcgcagcttctcttcctcctgctactctggctcccaggtgaggggaatatgaggtggttttgcacatcagtgaaaactcctgccacctctgctcagcaagaaatataattaaaattcaatgtagatcaacaattttggctctacttaaagacagtgggtttgattttgattacatgagtgcatttctgttttatttccaatttcagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcct

SEQ ID NO: 224 - DNA, 506 bp, Homo sapiens
gtgcagaagtctctctcagtcaggacacagcatggacatgagggtccctgctcagctcctgggactcctgctgctctggctcccaggtaaggagggaaacaacaaaaattttattcagccagtgtagccactaatgcctggcacttcaggaaattcttcttagaacattactaatcatgtggatatgtgtttttatgttcctaatatcagataccagatgtgacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgcccct

SEQ ID NO: 225 - DNA, 477 bp, Homo sapiens
atggacatgagggtccccgctcagctcctggggctcctactgctctgggtcccaggtaaggaaggagaacactaggaatttactcagctggtgcgctcagtatagcctggctcttcagggaggtcttcttataacatgatggattgaatggatgtttgtttttatatttccaatctcaggtgccagatgtgacatccagttgacccagtctccatcctccctgtctgcatctgtaggagacagagtcaccatcacttgccgggtgagtcagggcattagcagttatttaaattggtatcggcagaaaccagggaaagttcctaagctcctgatctatagtgcatccaatttgcaatctggagtcccatctcggttcagtggcagtggatctgggacagatttcactctcactatcagcagcctgcagcctgaagatgttgcaacttattacggtcaacggacttacaatgcccctcc

SEQ ID NO: 226 - DNA, 707 bp, Homo sapiens
atgctctgggtccctggtaaggacagaaagagatgagggaggacaactgggtgggaggtgagctctgtgggctccacagcttcacatgtttattccaataatgtgatagaggcacatggtctatgctccagggaatggaattcaggtttgtcttatgaataatcaggattcacctccagggaacgatgaccagtgctctgattaagaacttgaaaaaaaagagttcccttgtggctaataaataatgggtctattttagaaagtctacttttcatgatataaatcaaaactttaaaaatgtaactgtaaatttatatcacaagagaaattatgaaagttgctcataatgtatctatataaacttgcacttctctgttattatttcaggatccagtgaggatattgtgatgacccagactccactctccctgcccgtcacccctggagagccggcctccatctcctgcaggtctagtcagagcctcttggatagtgatgatggaaacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtttccttccaca

SEQ ID NO: 227 - DNA, 500 bp, Homo sapiens
gtcagtctcagtcaggacacagcatggacatgagggtccccgctcagctcctggggctcctgctactctggctccgaggtaaggatggagaacactaggaatttactcagccagtgtgctcagtactgactggaacttcagggaagttctctgataacatgattaatagtaagaatatttgtttttatgtttccaatctcaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcc

SEQ ID NO: 228 - DNA, 226 bp, Homo sapiens
atggaaagccagcctttatctcctgcaggtctagttagagcctcctgtataataatggaaacacctatttgtattggtacctgcagaagccaggccagtctccacagctcctgatttatgaggtttccaaccaggcctccgaattctcagacaggttcaggggtaatgggtcaggtactgagtttacactgaaagtcagtaggacggagactaaggatgttggagt

SEQ ID NO: 229 - DNA, 526 bp, Homo sapiens
catggaagctgcagctcagctgctttgattcttgttactctggctcccaggtgcaggaaacaccggatggttctgcatgtcagtgaaactttctcaaccttgttgagtcctgttacctggcacacctgctgggaaggcacaatgattaaagctcaatgtagatcaatggtcctggatgcactgggaagacaataggtatgatgtagtgtacgtgtgtgacatttctgtttttattccaatttcagataccaccagagaacttgtgatgacagtctccagcctccctgtctttatctctaggggaaaaagccaccctcacctacagagccaagtagactattagcagctccttagcagggtatcagtggaaacctggacaggctctcaggctcctcatccatggtgcatccaccaggaccaccaatgtcccagcctggtggagtggcagtgggttcggggaaaacttcagtctcattatcagcaggctggagcatgaagattttgcactttaacactgttatcagca

SEQ ID NO: 230 - DNA, 446 bp, Homo sapiens
atggacatgagggtccctgctcagctcctggggctcctgctgctctgactctcaggcaaggaaggagaacactaggaatttactgagccagtgtggtcagtactacctggctattcaggaaagtcctctcataacatggttaatagtgttaatagttttgtttcccatctcaggtgccagatatgacatgcagatgacccagtctccatcctcgctgtcttcctgtctaggtgagagtcaccatcacatgccaggaaagtcaggtagggcattagccatgttttagcctgatacaaagagaagccagggaaagcttctgagctcctgatctacgatgcatccaatttgcaaacctgggtcccattgcagttatgtggcattggatccaggacagatttgattctcaccattagcatcctccagtctgaagttgctgcaacttctta

SEQ ID NO: 231 - DNA, 253 bp, Homo sapiens
agtgatgacacagtctccagcttccctgtctttgtctctggagaaaaaagccaccctgacttgcagggccagtcagtgttagcagctactaagcctggtaccagaagaaacctgagcgggttcccaggctcctcatctatggtacagccctgatttgtgatagtgggtcggggacagggcttactctcaccatcggcagcctggagcctggagcctggagatttgcacttcatcactgttatcagcatagtag

SEQ ID NO: 232 - DNA, 775 bp, Homo sapiens
gtgaggctccctgctcagctcccagggctgctaatgcactgggtccctgctgagagcagaagggaaatgagggaggatgatggggtgggagggtgaactctgtgggccctgccacctcccatgtgtgttctgtcctcgtgttagatgtgtcttgtcctccaggatggggcatgtgatgtctagatctgtgagagtgaggaagattccagaaggagcaaggacatgtactttagtgaaagctgtgacacagaaagagggggatgggataggtgacttctagaggcttatttgtgctttgcaaatcttggttctttttaaacctgtatgttttgggagtattaaccaaaatcatacacaaaaaataattgagcaaaacataaataacagacagaaaattattaaaatggctcacaatgtttgtacataaccttgcacttctctcttattatttcaggatccaatggagatgctgtgtgacccagcctctactctccctgcccgtcacccctggaaagccagcctctatctcctgtagatccagtcatagcccctttcacagtaatggatacacctatttgaattgggacctacagaagccaggccagcctccacggctcctgattgatttggtttccaacagggaccctggagtcccagacaggttcagtggcagtgggtcggggacagatttcatgtttaaaataaggaggatggatgctgaggatgttggggtttattgctgccagcaaagtacacattattctcccacaatggt

SEQ ID NO: 233 - DNA, 695 bp, Homo sapiens
agtgaggctccctgctcagctcctggggctgctaatgctctgggtccctggtaagggcagaagggaaatgagggaggatgatggggtgggagggtgaactctgtggaccccgccacctcccatgtgtgtcctgtcctcgtgttagatgtgtcttgtcctccaggatggggcatgtgatgtctagatctgtgagagtgaggaagattccagaaggagcaaggatatgtaaatattggttctttttaaatctgtatgttttgggaggattaatcaaaatcacacacacaaaaataattgagcaaaacataaataacagacagaaaatgattaaaatgactcacaatgtttgcacataaccttgcacttctctctcattatttcatgatccaatggagatgctgtgatgacccaacctccactctccctgcccatcacccctggagagccagcctccatctcctgcaggtctagtcacagcccccttcacagtaatggatacatctatttcaactggtacctacagaagacaggccagcctccttggctcccaatctatttggtttccaatcacgaccctggagtcccagacaggttcagtggcagtgggttggggacagatttcatgctgaaatcaggaggatggatgctgaggatgttggggtttattgctgccagcaaagtacacattatcctcc

SEQ ID NO: 234 - DNA, 444 bp, Homo sapiens
atggacatgagggtccccactcagctccaggggctcctgctgctccggctcccaggtaaggatggagaacactaggaatttactcagccaatgtgctcagtacagcctggcctttcagggaaatcatcttacaaatagttgtgtggattatttgtttttatgtcccaggagtcagatgtgatttccagatgactcagtctccatcctccctgactgcatctgtaggagagagagtcaccatcacttgctgggcgagtcagggcatttgcaattatttaagctagtatcagtagaaactagagaatcctcctaagctcctgatctatgctgcatccagtttgcaatctggggtcccgtcacggttcagtggcagtaggtctgggacacatttcacacattctcaccatcaggagcctgcaacctgaagatgttataacttattac

SEQ ID NO: 235 - DNA, 715 bp, Homo sapiens
cagtgaggctccctgctcagctcctggggctgctaatgctctgggtccctggtaaggacagaagagaggagaatgggactggagggtgagctctgtggaatctgcagcctcccatttgttgttctgtctacatgtcagatgcagatttcttgtcctccagcaaagggaatttaatattcagacctgtaagaactaagaacgagccacaaggaaaaagaacttcactgtcgagaacttcaaaaacaaagaggccactttgtgcctttaattattggattatttttggatattggataaatgtagtgtatgaatctaatcaaacacaaaaaagtagcctaacgtatacaataaaactaaattataaaaatgtctcacattgtttgtatgtaaccttgtacttctcactgttattattttaggatccagtggggatattgtgatgacccagcatctgctctccctgcccatccctctgggagagccggcctccatctcctgcaggtctagtcagagcctcctgcatagtgatggaaacacctatttggattggtacctgcagaagccaggccagtctccacagcttcttatctacacaatttctaacaaattctatggagtcccaaacaagttcagtggcagcaggtcagggacaggtttcacacttaaattcagcaaagtggaggctgaggatgttggggtttattgctgtgaacag

SEQ ID NO: 236 - DNA, 731 bp, Homo sapiens
atgaggctccctgctcagctcctggggctgctaatgctatgggtccctggtaaggatagaaataagatgaggtgggaaaatggggtgggagggtgagatctgggggctccacagcttcctatatttatttcaaacgtgttagaggcacatggtctatgctccaggaaagagaattcatattcttgccttatgaataaccaggattctccaaggaactatgaccagtgctctggttaagatcttgaaaatagagtttcgtactggctagtaaattgtgcattcattttagaaagtctacttttgatgatataaatctaaacttgaaaaaatacgtaactgtaaatgaatatcataagggaaatcatgaaagttgctcatagtgtgtctatataaccttacacttctttcatgttatttcagggtccagtggggatattatgatgacccaaactccactctccctgctcgtcacccctggatagctggcctccatctccttctgcaggtctagtcacagccttgtatacaggggggaataaacctatttggtacctgcagaagccaggccagtctctacagctcctgatctatttggttttgaaccgggcctctgcagtcccagacaggctcagtggcagtgggtcaggcactgatttcacactgaaaatcagccgggtggaggctgaagatgttggggtttatcactgcatgcaagctctacaaactcctcc

SEQ ID NO: 237 - DNA, 285 bp, Homo sapiens
agtcacccagtctccatccacactgtctgcatctgtaaggagacagtgtcaccatcacttgccgggcgagtcagagcattggtagtaatttagactggtatcagcagaaaccagggaaggcccctaagggcctgatctatgctgcatccagtttgcaatctggggctccttcgcggttcggtggcagtggatctgggacagattttactctcaccatcagaatcctgcagcctaaagatgttgcaacttattactgtcaacagtataaaaattaccctatcacag

SEQ ID NO: 238 - DNA, 483 bp, Homo sapiens
acggacgcgagggcccccactcagctcctggggctcctggggctctggctgccaggtaaggaaggagaacactaggaatttactcagccagtgtgctcagtacagcctggctcttcagggagggcttcttataaatgattgattatgtagatgtttgtttttatgtttccaacctcaggtaccagacgtgatatccagatgacccagtctccatcctccctgtctgcatctgtaggagacagagtcactatcacttgccaggtgagtcacagcattagtaataaattagtctggtatcagcagaaaccagggaaagcccctactctcctaattcatgctgcaacaaaactgcagacgggggtcccatcctggttcagtagcagtcaatctgggacagatttcactctcaccatcagcagcctgcagcctgcagcgtgatgatttggccacttattactatcaacagcattacagttaccctcc

SEQ ID NO: 239 - DNA, 223 bp, Homo sapiens
tggaaagccagcctttgtctcctgcaggtctagttagagcctcctgtataataatggaaacacctatttgtattggtacctgcagaagccaggccagtctccacagctcctgatttatgaggtttccaaccaagcctccgaattctcagacaggttcaggggtaatgggtcaggtactgagtttacactgaaagtcagtaggacggagactaaggatgttgga

SEQ ID NO: 240 - DNA, 472 bp, Homo sapiens
atggacatgagggtccccgctcagctcctggggcttctgctgctctggctcccaggtaaggaaggagaacactagcagtttactcagcccagggggctcagtacagcctggctattcagggaaattctcttactacatgattaattgtgtggaccatttgtgtttatgcttccaatctcaggtgccagatgtgccatccagttgacccagtctccatcctccctgtctgcatctgtaggagacagagtcaccatcacttgccgggcaagtcagggcattagcagtgctttagcctgatatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaataatt

SEQ ID NO: 241 - DNA, 490 bp, Homo sapiens
ccatggaagttccagctcagctcctctcctttctggtactctggctcccaggtgaggggaacacgggatgattctgcatgccagtgaaactctgtcaatgttattgggtcctgtgacctgctcagcaagaacaataattaatattcaatgtacatcaatgatcccagctgtactgggaagacagtggatttgatctagattgcacaattgactttcctgttttattccaatctcagataccactggagaagttgtgctgacatggtccccaatcaccctgtgtttgtccccaggggaaggagccaccctcacctgaaaggccagtcagatcattgacaactattcagcctgggaccagtagaaacctgttctggttcccaggctccttatttatagggcatctaccaaggctaccagcatcccagcccggttcagtggtggtgggcctgaggcagactttaccccaaccatcaacagcctagaccctgaa

SEQ ID NO: 242 - DNA, 438 bp, Homo sapiens
atggacatgagggtccccactcagctccaggggctcctgctgctctggctcccaggtacggatggagaacactaggaatttactcagccaatgtgctcagtacagcctggcctttcagggaaatcatcttataaatagttgtgtggattatttgtttttatgtcccaggagtcagatgtaatttccagatgactcagtctccatcctccctgactgcatctgtaggagagagagtcaccatcacttgctgggcgagtcagggcatttgcaattatttaagctagtatcagtagaaactagagaatcctcctaagctcctgatctatgctgcatccagtttgccatctggggtcccgtcacggttcagtggcagtaggtctgggacacatttcacacattctcaccatcaggagcctgcaacctgaagatgttataact

SEQ ID NO: 243 - DNA, 247 bp, Homo sapiens
tcatctcctgcaggtctagtcagaccctcctgcatagcaatggaaacacctatttgtattggtaactatagaagccaggcgagtctccacagctcctgatctatggggtttccaatggggcctctggagtcccagacaggttcaatagcagtgggtcaggcacatattttaaactcaaaattagcagggtggaggctgaggatattcgactttattaatacatgcaagctacataatatccttgcac

SEQ ID NO: 244 - DNA, 532 bp, Homo sapiens
taggatccggtgggaatattgtgatgacccagactccactctctctgcccgtcaccaatggagagccggcctccatctcctgcaggtctagtcagaaccttttacatggtaatggatacacctatttgtattagttcctgcagaagccaggccactctccacagctcctgatctgtaggacttccaatcagttttctgccttcccacacaggttctccccagtgggaggagagagtagaccagtcatccccagatatatcacaggactagtttcaacctttggaagctggtctatatcctatggttaaataggcatttgtgatacgacctgaaatacatttggacaagaacttcactaacaattgagtcactgaagacttacggccctgtgtgacgcaccacataactgtgagtttgcagtggttgcaggtcagggacagattttatgcttaagatcagtagggtggaggctgaggatcttggctattacaactgccaccacactctacaatatcctcccacaatggttcag

SEQ ID NO: 245 - DNA, 747 bp, Homo sapiens
caatgaggctccctgctcagctcctggggctgctaatgctctgggtctctggtaaggataggatcaaaagtgaggtgagaaaatggggtgggagggtgagatctggggtctccacagcttcctatttttatttcaaccatgtgttacgggcacatggtctgtgctccgggaaagattactcgtattttttgtctcaggaatagtcaggaatcatctcccaggaaaaatgaccagtgctctgattaagctcttgaaaataaactgctccctgctggctagtaacaaattggttcattttagaaagtctacttttcatgataaaaatcaaaacttgaaaaaatatgtaactctaaatcaaaatcttaaggaaaatcatgaaagttgctcaaaatgtgtttatataaccttgcacttctctgttattatttcaggatccagtggggacattgtgatgacccagactccactctccctgcctgtcactcctggagagccagcctccatctcctgcagatctagtgagagcctcttggatactgatgatgaatacacctatttgaattggtacctgcagaagccaggccagtctccacagctcctgatctatgaggtttccaaccgggcctctggagttccagacaggttcagtggcagtgggtcaggcactgatttcactctgaaaatcagtagggtggaggcttaggatgttggggtttattactgcatgcaagctctacaaactccgcc

SEQ ID NO: 246 - DNA, 283 bp, Homo sapiens
acttcagactccactcttccttggagagccatcctccatttcctgcaggtctggtcagagcccctttcatagaaatggaaacacttacttgaattggtttctgcagaagccagaccaacctctaaggtgcctgatttatgaagtttctaacaggaagtctggggtctcgggcaggttcagcagcagtggttcagggacagatttcatattgaaaatcagcagggtagaggctgaggacgttggggtttattactgcctgcaaggtacacaagtgcctcccaca

SEQ ID NO: 247 - DNA, 262 bp, Homo sapiens
acttcacactccactcttccttggagagccatcctccatttcctgcaggtctggtcagagcccctttcatagaaatggaaacacttacttgaattggtttctgcagaagccaggccaacctctaaagtgcctgatttatgaagtttctaacaggaagtctggggtctcaggcaggttcagcagcagtggttcagggacagatttcatattgaaaatcagcagggtagaggctgaggacgttggggtttattactgcctgcaa

SEQ ID NO: 248 - DNA, 490 bp, Homo sapiens
atggaagttccagctcagctcctctcctttctggtactctggctcccaggtgaggggaacacgggatgattctgcatgccaatgaaactctgtcaatgttattgggtcctgtgacctgctcagcaagaacaataattaatattcaatgtacatcaatgatcccagctgtactgggaagacagtggatttgatctagattgcacaattgactttcctgttttattccaatctcagataccactggagaagttgtgctgacatggtccccaatcaccctgtgtttgtccccaggggaaggagccaccctcacctgaaaggccagtcagatcattgacaactattcagcctgggaccagtagaaacctgttctggttcccaggctccttatttatagggcatctaccaaggctaccagcatcccagcccggttcagtggtggtgggcctgaggcagactttaccccaaccatcaacagcctagaccctgaaga

SEQ ID NO: 249 - DNA, 445 bp, Homo sapiens
atggacatgagggtccctgctcagctcctggggctcctgctgctctggctctcaggcaaggaaggagaacactaggaatttactgagccagtgtggtcagtactacctggctattcaggaaagtcctctcataacatggttaatagtgttaatagttttgtttcccatctcaggtgccagatatgacatgcagatgacccagtctccatcctcgctgtcttcctgtctaggtgagagtcaccatcacatgccaggaaagtcaggcagggcattagccatgttttagcctgatacaaagagaagccagggaaagcttctgagctcctgatctacgatgcatccaatttgcaaacctgggtcccattgcagttatgtggcattggatccaggacagatttgattctcaccattagcatcctccagtctgaagttgctgcaacttctt

SEQ ID NO: 250 - DNA, 699 bp, Homo sapiens
agtgaggctccctgctcagctcctggggctgctaatgctctgggtccctggtaagggcagaagggaaatgagggaggatgatggggtgggagggtgaactctgtggatcccgccacctcccatgtgtgtcctgtcctcgtgttagatgtgtcttgtcctccaggatggggcatatgatgtctagatctgtgagagtgaggaagattccagaaggagcaaggacatgtactttagtgaaagctgtgacacagaaagagggggatgggataggtgacttctagaggccggctttgccttgcaaatattggttctttttaaacctgtatgttttgggaggattaatcaaaatcacacacacaaaaataattgagcaaaacataaataacagacagaaaatgattaaaatgactcacaatgtttgcacataaccttgcacttctctctcattatttcatgatccaatggagatgctgcgaagacccaacctccactctccctgcccatcacccctggagagccagcctccatctcctgcaggtctagtcacagcccccttcacagtaatggatacatctatttcaattggtacctacagaagccaggccagcctccttggctcccaatctatttagtttccaatcacgaccctggagtcccagacaagttcagtggcagtgggtcggggacagatttcatgct

SEQ ID NO: 251 - DNA, 739 bp, Homo sapiens
catgaggctccctgctcagctcctggggctgctaatgctctggatccctggtaaggatggaaggagatgagggaggaggagggggtgggaggctgagctctggcggccccactgattcccgtgtttattctaaccatgtgttaaaggaatatgccctatgctccagggagaggaattcatattttgccctgatgatgatttgaaaactcctaaaagcagtgctctgaataatatcttgagaaatgaaagaactcttgtgcctatttaataaagggttcatttaaaattttgtttttatgatatgaatacaaatttgtaaaaataaaagattagccataaatcaatatcataaggcaaatctcaaaagttgttcattatgctttcacataaccttgcacttctctctcataatttcaggatccagtgcggatattgtgatgacccagactccactctctctgtccgtcacccctggacagccggcctccatctcctgcaagtctagtcagagcctcctgcatagtgatggaaagacctatttgtattggtacctgcagaagccaggccagtctccacagctcctgatctatgaagtttccagccggttctctggagtgccagataggttcagtggcagcgggtcagggacagatttcacactgaaaatcagccgggtggaggctgaggatgttggggtttattactgaatgcaaggtatacaccttcctcccacagtggt

SEQ ID NO: 252 - DNA, 502 bp, Homo sapiens
catggaagctgcagctcagctgctctgattcttgttactctggctcccaggtgcaggaaacatcggatggttctgcatgtcagtgaaactttctcaaccttgttgagtcctgttacctggcacacctgctgggaaggcacaatgattaaagctcaatgtagatcaatggtcctggatgcactgggaagacaataggtatgatgtagtgtacatgtgtgacatttctgtttttattccaatttcagataccaccagagaacttgtgatgacagtctccagcctccctgtctttatctctaggggaaaaagccaccctcacctacagagccaagtagactattagcagctccttagcagggtatcagtggaaacctggacaggctctcaggctcctcatccatggtgcatccaccaggaccaccaatgtcccagcctggtggagtggcagtgggttcggggaaaacttcagtctcattatcagcaggctggagcatgaagattt

SEQ ID NO: 253 - DNA, 240 bp, Homo sapiens
atctcctgcaggtctagtcagaccctcctgcatagcaatggaaacacctatttgtattggtaactatagaagccaggcgagtctccacagctcctgatctatggggtttccaatggggcctctggagtcccagacaggttcaatagcagtgggtcaggcacatattttaaactcaaaattagcagggtggaggctgaggatattcgactttattaatacatgcaagctacataatatcct

SEQ ID NO: 254 - DNA, 235 bp, Homo sapiens
agatttcactgtagaaacagtgatgacacagtctccagcttccctgtctttgtctctggagaaaaaagccaccctgacttgcagggccagtcagtgttagcagctactaagcctggtaccagaagaaacctgagcgggctcccaggctcctcatctatggtacagccctgatttgtgatagtgggtcaggacagggcttactctcaccatcggcaggctggagcctgaagatttg

SEQ ID NO: 255 - DNA, 734 bp, Homo sapiens
atgaggctccctgctcagctcttggggctgctaatgctctgggtccctggtaaggacagaaggagatgagggaggagaatggggtgggaaggtaagcctgggggtcccactgccttccatgtgtgttctgccctgcccatgtgttagatgtacaggtcttgttctccaggatggggaatgtgaggtttaaatctgtgagagtgaggacaattcaaaaagaagcaaggacctgtgtgatctggtgaagattgtcacacagagaaagggaggtggtgtaggtgatttctagaatcccctttgcggcttgcaaatttggaatatgtttagtgtataaatacaaacaacaaaaaattatatagcctgaaataaaaaatgaaaatttatgataaatgacacatgatatttgtacatatccttccacttctttctatttattttaggatccagtgcagagattgtgatgacccagactccactctccttgtctatcacccctggagagcaggcctccatgtcctgcaggtctagtcagagcctcctgcatagtgatggatacacctatttgtattggtttctgcagaaagccaggccagtctccacagctcctgatctatgaagtttccaaccggttctctggagtgccagataggttcagtggcagcgggtcagggacagatttcacactgaaaatcagccgggtggaggctgaggatgttggagtttattactgcatg

SEQ ID NO: 256 - DNA, 760 bp, Homo sapiens
aataagggtccctgctcagctcctggggctgctaatgctttgggttcctggtaaggacagaagggagataagggaggagaatggagtgtgagggtgagctctgggggtcccactgcctgtccacatgcacatcttgacctgcaagaaaaggtgtataaagtttagaactgcaagagtcagaaagagaagattcctcactcttatagttctaaacttcatatcctagaaggacaaaggacttgtgctctcatgaagagtgtcacacaggaagaggataatagtgtaggcgacttcttgagtctcttttgtgccttgtgaatgttggttctttttatgcctggatgtttaggggtatgaaccaaagtcacacaaaaaaatcacttagcataaagtagataacagaaagaatatcatttcaatggttcccaatatttgtacataactttgcacttctctcactatttcaggatccagtggagatattgtgatgacccagactccaccctccctgcccgtcaaccctggagagccggcctccatctcttgcaggtctagtcagagcctcctgcatagtaatggatatacctatttgcattggtacctgcagaagccagggcagtctccacagctcctgatttatagggtttccaatcatctttctggggtcccagacaggtttagtggcagtgggtcaggtagtgatttcacactgaaaatcagctgggtggaggctgaggatgttggggtttattactgcatg

SEQ ID NO: 257 - DNA, 792 bp, Homo sapiens
aataaggttccctgctcagctcctggggctgctaatgctttgggttcctggtaaggacagaagggagataagggaggagaatggagtgtgagggtgagctctgggggccccactgcctgtccacatgcacatcttgacctgcaagaaaaggtgtataaagtttagaactgcaagagtcagaaagagaagattcctcactcttatagttctaaacttcatatcctagaaggacaaaggacttgtgctctcatgaagagtgtcacacaggaagaggataatagtgtaggtgacttcttgagtctcttttgtgccttgtgaatgttggttctttttatgcctggatgtttaggggtatgaaccaaagtcacacaaaaaaatcacttagcataaagtagataacagaaagaatatcatttcaatggttcccaatatttgtacataaccttgcacttctctcactacttcaggatccagtggagatattgtgatgacccagactccaccctccctgcccgtcaaccctggagagccggcctccatctcctgcaggtctagtcaaagcctcctgcatagtaatggatatacctatttgcattggtacccgcagaagccagggcaatctccacagctcctgatttatagggtttccagtcgtttttctggggtcccagacaggtttagtggcagtgggtcaggcagtgatttcacactgaaaatcagctgggtggaggctgaggatgttggggtttattactgcatgcaagctacacagtttcctaacacagtggtaca

SEQ ID NO: 258 - DNA, 493 bp, Homo sapiens
atggaagccccatctcagcttctctgcctcctgtactctagctcccaggtgaggggaagaggagatggctctacactgaaactctctcaaccttgttggttcctctgacctggcatccctgctgagcaagaacagtaattataattcagtgtagattagtgactgtggttatactatgaagattgtgggcttgatgcagtttatatgagtgattttcctgttttattctaatctcatgtccctccagagaagttatgttgatgcagtctcttgactccttgtctttgtcttcagggaaaagagactctctcatctgtgtgtgcagtcagagcattggcagctccttagcctggtatcagcagaaacctggaaaagctccctggttcctcatctaaggcacatccaacagggccactagcatcctggggtttagtggtcatggattggagacagactttactatcaccatcagctgcctgaagcctaagatttt

SEQ ID NO: 259 - DNA, 779 bp, Homo sapiens
agtgaggctccctgctcagctccctgggctgctaatgcactgggtccctgctgagagcagaagggaaatgagggaggatgatggggtgggagggtgaactctgtgggccctgccacctcccatgtgtgttctgtcctcgtgttagatgtgtcttgtcctccaggatggggcatgtgatgtctagatctgtgagagtgaggaagattccagaaggagcaaggacatgtactttagtgaaagctgtgacacagaaagagggggatgggataggtgatttctagaggcttatttgtgctttgcaaatcttggttctttttaaacctgtatgttttgggagtattaaccaaaatcatacacaaaaaataattgagcaaaacataaataacagacagaaaattattaaaatggctcacaatgtttgtacataaccttgcacttctctcttattatttcaggatccaatggagatgctgtgtgaaccagcctccactctccctgcccatcacccctggaaagccagcctctatctcctgtagatccagtcatagcccctttcacagtaatggatacacctatttgaattgggacctacagaagccaggccagcctccacggctcctgattgatttggtttccaacagggaccctggagtcccagacaggttcagtggcagtgggtcggggacagatttcatgtttaaaataaggaggatggatgctgaggatgttggggtttattgctgccagcaaagtacacattattctcccacaatggtaca

SEQ ID NO: 260 - DNA, 526 bp, Homo sapiens
ggatcctgtgggaatattgtgatgacccagactccactctctctgcccgtcaccaatggagagccggcctccatctcctgcaggtctagtcagaaccttttacatggtaatggatacacctatttgtattagttcctgcagaagccaggccactctccacagctcctgatctgtaggacttccaatcagttttctgccttcccacacaggttctccccaatgggaggagagagtagaccagtcatccccagatatatcacaggactagtttcaacctttggaagctggtctatatcctatggttaaataggcatttgtgatacgacctgaaatacatttggacaagaacttcactaacaattgagtcactgaagacttacggccctgtgtgacgcaccacataaccgtgagtttgcagtggttgcaggtcagggacagattttatgcttaagatcagtagggtggaggctgaggatcttggctattacaactgccaccacactctacaatatcctcccacaatggt

SEQ ID NO: 261 - DNA, 7184 bp, Homo sapiens
ggccacatggactggggtgcaatgggacagctgctgccagcgagagggaccagggcaccactctctagggagcccacactgcaagtcaggccacaaggacctctgaccctgagggccgatgaggccagggacaggccaggggggccttgaggcccctggtgagccaggccccaacctcaggcagcgctggcccctgctgctgctgggtctggccgtggtaacccatggcctgctgcgcccaacagctgcatcgcagagcagggccctgggccctggagcccctggaggaagcagccggtccagcctgaggagccggtggggcaggtaaggggtgagagattccaggggatgtgggggtctgggtggcagaggcgggaaaggatgaccaaggggagacgagccagaggggtgaggaggaaggttaatccctggaggggagccacagacactgactttaactaaagtgtcaagattttgtccatctttgaattaatttttattgcttaatgtcatattaaaatattatttatcttgattcctgagatttcttcccccacttacatttggcaccaaggccaatgtctccctcacctccccctagtccttggggtagggcaggactggaggcaggggcaggacgtccacaggagtggtggccgctatccctgaaggatgcccaggcctctccctcctcctcctcccactcctcctcccccccctcctcttttccccttggcctatgtcacctgtccactcccaccctcactgggcaggggccactccctggagctccagctaaggtgtgaggggcctttcctggagtccctgggtcactagacctcagccagcatcgcctcctgaaaccagcccctaggagacacaagcttatccagggtgcaagtgcctccaaagaagaagcccaggagaggctctagggaggccacaactccctgtgtgacctcagccattgccaccactctgcgtgtggtgggaggtccccagacaaagcaccaagcatcggggtccatttatgagcatttgggacacaacagcctgttcactggtgcatgttatacccacaggcgataatcatttcaggggcagaacctccctctcggtggccccataggcaggtcctgctgtgatcccctttgtgcagacggggatagagcccggagaggtgaggtgacccgtccgagtcactcagctcatgggcacagattctaaggcccaagctatcccctctagctctcccctgtcccatcctctaagctgatcgagcggacacgtgcatctctgggacctgagtttccctttttctctcttttttttctttttcaaataaagtttcacagagtttcactcttgtcgcccagtctggagtgcaatggcgagatcttggctcattgaaacctccgtctcccaggttcaagacattctcctgcctcagcttccggagtagctgggattacaggcatctgccaccacacctggctaattttgtgtatttttttttagtaaagacagagtttcaccatgttggccaggctggtctcaaactcctgacctcaggtgatccacccacctcagcctcccaaagtgctgggattacaggcatgagacaccacaccgggcctgagtttccccttctgcaatctgaggggccctgactggtgagggccttcagcgtcccacccacccagaggatgctggggtggctgtggtgagagctccagcagtggcagccgacctgacccacaccaggagcccggccatggaggcggggtcagcatggtggcaggccgggaccgggtgtcagtgtcctgcacggacttctgagcaaggagtccccatcagggtcaggctctgtgctggggctgaggtcccagaggatctagatttgccccaattcaagtccacaaggagcgggggccgggtgaggagacagccacatgcagggtgatgcctacagaacagagactgggatggggaaggcccgaggggtctccacaagggacgggtgacaggtggagggagacacagataataaaaaatggtattatgttggggggctattaatgtaagtttttatattagaatctttagaaatcttatagaaatactatgggccgggtgctgtgtctcatgcctgtaatcccagcactttaggacgccaagatgggcagatcacgaggtcaggagattgagaccatcctggccaacatggcaaaactccgtctctactaaaaatacaaaaactagctgggcgtggtggcgcgagcctatagtcccagctactcgggaggggaggcaggagaatcgcttgaatcagggaggtggaggttgcagtgagctgagattgcaccgctgcactccagcctggacgacagaacgagactcccactcaaaaaaaaaaaaaggtattatgctgggggggatatgaatatgagtttttataatctttagaaatactatgggccaggtgcagtggctcatgcctgtaatcccacaactttgggaggctgaggcgggattgtttgagcccaggagtttgagatcagcctgagcaacatagcaagaccccatttctacaaaacatataaaaactagctagtcatggtggcacttgcctgtggtcccagctacttaggaggctggtgagaggattgcttaagcctcggaggttgaggatgcagtaagctgagatcccaccactgcactccagcctgggtgacagaaggagaccctgtctcaaaaaaaaaaaaaaaaaaaaaagactgattattcctgtagaattctggtaaatatctcctatcaaataaatgacttttctattcatagcttattaaaagatattttcattgtttttaagaaataggttgtgtatcactttttatatttagttgtaaatttatttgttttatttatttttttagagatgggggtctcactatgttgcctgggctggcctccaactgctgggctcaagcaatatccctgcctcagcgtccccagtagctgggactacaagcatgcgctaccacaccggcataattttttgtagagatgaggtttcgccatgttgcctgggctggtcttgaacccctgggctcaagccatccacccgcctcggcctcctaaagtgctgagattacagacgtgagccaccctacctagcctgtactatttttaataggtcttaataggttttgaatgttaattatttttaaattaatttcaaaaatcttctacaacatggatgaaacctgaagacattatacttagtgaaataagccagacacaaaaggacaaatgtcatttgaatccacttctatgaggtacctagaataggcaaattcacttggacaaaaagtagatttgaggttagcagggtgagggggagggaagaatgggggactgtagttaacgggtttagagtttctgtttgggaagatgaaagagttctggagatggatggtggtgaaggttgcccaacggtgtgaatgtacttagtgccacggagctgtacgtttaaaaatagttaaagtggaaatattgatgctatgtataaaaatggagcggggtgtggtggctcacacctataatcccagcactttgagaggccaaggtgggcagatcacctgaggtcgggagttcgagaccagcctgacaaacatggagaaacaccgtctctactgaaaatacaaaaaattagccaagtgtgctggcacatgcctgtaatcccagctactcgggaggctgaagcaggagaatcgcttgaacccaggatgtggaggttgcggtgagccaaggtggcaccattgcactccagcctgggcgacaagggtgaaattccatttcaaaaaaataaaaggaaatgggactgtacatagcaggagagagagggagagatcaatatgacacttctttttttttttttttttttttgggacagtcttgctctgttgccaggctgcactccagcctgggcaacagagcgagactctgtctcaaaaaaaaaaagaatgtctagatgcagtagctaagttcgcagaagccatttcagtgtgggaggcgaggtgactgagtccagggactccaggtttctggctgaggggttgagaccgcccatggtcattgtgatgagatgaagacagaaaatgagctgggctgggggaaggtggtcatctcctctggacgtgattagtttgaggctcctgttgggtagcccactgggcaaggtcagtaggcaattgaggagctgagagggtttggagctgggatagactccagcctcaccatgtgggcaatagtgggggtcacagagtgtgaaaatggctaagaaagaggtctgggtggggtctggggagtcagcagccaggcatgggccatggagaaacagatgccaggggaagaggaaaggggagtctcagaccccaaggggaaaagagtcactggaaagaggggccagccctgtgtcgcatccagcggagacaccaggtacagcagaaggaccttggacatgaccatgaggagggccttgttgaccatggcctgggagagatgggggtgagagcctgggggaccacaccatgtccccagcacacagtgcctggtagacaggatggatttatggatggacggacaggtagatggatggacgaatggacagatgatagatggatgcaaagacagatgaatagatggacagatgcatagatggacagatggacagatggatggacggacggatggaatgaatgatcagaaaaggcttcatgaacaaagtgagactgagctgcatctccatgggtagatataaaagcagaggactctcctcttgagtcaggaatgacccaatgtcctggtccagggaggaagtcagcctccttgactggggacacttgtggcagatttcagaggcccttaaaatgaggccaagtgaggtggacaggtccgagccagctgaggactcctcagccacacggcacagctgcctgaggggatgtgtcactcagggagttgctgggacctactgggcccagcgttgccatcagcaccaacagtttcagagagggggacacacgctggggcagcacctgcctcagagaagggacaggcacagagacactactgggggacactactgggacactggccacccccctaccctgtgcctgggtcacagcctacacactgcagccctgtgcccctcactcccagcaggttcctgctccagcgcggctcctggactggccccaggtgctggccccgggggtttcaatccaagcataactcagtgacgcatgtgtttggcagcgggacccagctcaccgttttaagtaagtggctctaacttcccaggctgtcccaccctctcctgtctctggaaaatgtgttttctctctctggggcttcttcccctctgccctcccagccttaagcactgacccctacctttgtccatggggcctggaggagatgtgttagtctcagggtaatggcaggaagggcccccacagtgggagcagccgccttcaggttccaacagcaggacacagcctggtcccagggcctgggctgggattgggcggggtcagggctcctcccctctcccagggcagatgtctgagtgagggacagaggctggttctgatgaggggccctgcagtggccttagagacagtccctgggaccccaggttctaggctgagggctggatgcccatccagcctgggagggccacacgggggcctggggacacaggggtcacccccaggggagaccaatggagggcacagagagggctctgggtctaggctgcagctctgtggcctctgctgggtcttcagggcatggggacacagaggaacggatgaggtcccagagcccagccctcccaggacagtcaccagaaaggagagggtctcttagtgcagagatgtgcctgtccctggagccctgtcatctctggggcctggtgtctctctgttcatgggtcgacctcccaccttcatttgaggaagggcaccttagactcagaaggtgactagcggggagtaaacgggagtgcagagaactccatggctgccaggtgaagtccaggggcatcagaggctgctggggtgggcatgggggctgcggtgccccaaagtctgggggagcagccccaagaacccagccgatgtgaagggtcctgtggtcgggctggtggggacaggggcgacggcagagccccagggtgtgtctgggtggagcccacgcttcaccaggagagctgagtgggccaggctggggcacagcctggtgccccaggggatgggaagctccaggccatgccaggcttgggtctccccacatcctgccagtatagttttgtgtgctgtgagggagacccctagattccaaactcagactccagaaaccaggaaggagggagcacagcctgccctgggtgcacacggggaaaccgaggctgcagaggaaagggctgggccaggacacctgggaaaggtgacttgggaagggctcctaggaaggcacagggctgtctgctctccagagggctccagtggaaaggagggaatgaggagggaaggagaggccctgggtggaccaggcggccacaccatgaaccctcccagagactttagacagagagaggcgctccacaacaccccacactccctctgccatctctcaccccctcctctgtccacacaggtcagcccaaggccaccccctcggtcactctgttcccgccgtcctctgaggagctccaagccaacaaggctacactggtgtgtctcatgaatgacttttatccgggaatcttgacggtgacctggaaggcagatggtacccccatcacccagggcgtggagatgaccacgccctccaaacagagcaacaacaagtacgcggccagcagctacctgagcctgacgcccgagcagtggaggtcccgcagaagctacagctgccaggtcatgcacgaagggagcaccgtggagaagacggtggcccctgcagaatgttcataggttcccagccccgaccccacccaaaggggcctggagctgcaggatcccaggggaagggtctctctctgcatcccaagccatccagcccttctccctgtacccagtaaaccctaaataaataccctctttgtcaaccagaaa

SEQ ID NO: 262 - DNA, 18507 bp, Homo sapiens
atgcccccccctgcgcccggggcccggctccggcttctcgccgccgccgccctggccggcttggccgtcatcagccgaggtaccgcagcgccgggggcggggggctcggccgggacgccagggtcttgggtgggtaatcgggggatcaggggtgggggtcgagggctgcatccctgggccggcgcggggaggccccgggacgccggggtctgggcccgggggtggggtctgcattccctggctgggcagggggacctcggacgtgggggtccgcgccccggggcaggggtcggcgtcctcgggccggagccgggtctaggggcggaggtctgcttccccgagcaggcaagagggtcgcagacacctagccctgcctgggggcaggagtctgcggctcctgttgaggagggggcagacactggactcggggtccccgggtcggatctccgaactgagttggggtggggggcaggggataatgccctgttaggggtcttcatctgtacgtggagagggtccctgaagaggtccttgccgggggctggggtagtcatctcgggacagaggtcaggggatggatgccttcccagggtcagtaagaggaggggacaagggtgtccacagacctagtcccagggtcaggaaaagaggggaagggtctgaaatcccccagcagggtcatctaggttgagagaaagtgttggtacttggggaggttgcagttatgtgggggagaagggagctggagatacaggaagttggggtgctgggctggggtcttggattcccaagctctgattgaatgtctaggttcgtggggctggacagtggaagagcgatgggcatgggaggatgaaggaaagacggaagggaagggttaaagcaggttgaagggttaaccccggcccggcccggccctcccagttggggagagggccaggggcaggtttctgcactgaggttagatagctggaccttgagtctccccagtagggcctggcaggcagggggtggtcaaggagattcctagatttccccctaagaaaagggaggagagtgcaaggaggcaggaggctggagggtgggcgctcaggagggcagggagctgggttaattcagactttctggaggattcccccaggccctcccctgaacaaagagttccagggacaaccaagaaccccgacagagtccccaagagtctcagagaggccgcccgcatagaccaagtctggcacagaaaccccgtcacagcgtcccacccgaagcagcacctgcagacaccagtcacacaaacacagccccatccacgcaggacgcagggacctggtgggccacagcctcagtcccttgctagtcctcccccgtctcccacctgaccagtctgaatcgccctctgactttctgaccacctgtctctgtctctgtcatgcatctctttaggtctttgtgtccctgccatttctggaggttcccatcccttcccatctctgttatccactgctgactttccacctgcctctgtctctgggtcattgtctctccatccctgctgctgacagcacagttccacatctgtctgtctctgcttttcagactgttgcccattgcatgactcagtctcttgatacttgcttgcttcctcacttatgccttaatcttcattaacttctctcatttccttctctcattcatttccttcttgttctgacctacctttctcttttttctttctctttccttctttctctttccttctttctttctttccttctttctctttttctctctctctctctttttctttctttctttctttctttctttctttctttctttctttctttcttctttcttctctttttttctttctttttcttgtttttttgagacagggtctgactttctcacctaggctggagtggagtggtgcaagcatacacagctcactgcagcctcaatttccctgcctcaagcgatcctgccacctcagcctctggagtagctgggaccacagatgcacgccaccacacctggctaatttttaattttttttctttgtagagatgggggtctcactatattgcccagactagtctcaaattcctggcctcaagtgatcctcccacctgggcctctcaaagtgctgagattacaggtgtgagccactgcaccagccacctcttctttctttctctccttgtccttatctcttgtcttcttcttcctcctcttctttccctgatcctgtaccctttgtgacctttcccccactttcctgtttcttctctccctccccttctctctctcactgcaacttcccatttttcacattcactattttttttttttttgaggcagagttttactcttgctgccaggctggagtgtagtggcataatctcagctcactgcaacctctgcctcccgggttcaagtgattctcctgcctcagcctcgcaagtagctgggactacaggtgtgtgccaccacgctgggctaatttttgtacttttagtagatacagggtttcaccatgttggccaggctggtttcgaactcctgacctcaggtgatctgcccacctcagcctcccaaagtgctgggattacaggcatgagccactgtctggcccccacattcattcttaaagtccctataaatcattacggggctagactggggcaggaagctgtggcagagccaggaggtggcttgtgaccctgctcaagtcttttcccatctctggtcttaggttccccttttgagaactggggacgagaggggatggggtggggttgagacagaacgagatgccagaaagacacccccacccacccatggatagtttgagctgtctgggaaaaaaagcttatggcaagatatgcaaactagcatcttctctcttcttttattcatgatcttgtccaagttacaagaggaatacactgcaaacagtccgcctctgataagggcaaaccccattgtgctcctgccctgccaccactctcacaaccactgtcttgagagaaccggtctgtggctggagtgcatccttccatagctttctctcacttctgcagacttagacacgacacacagaggacaacataagtgatggattggttggtttgttgatttttttcccccaaaatagaaacaaaataagcccatttctctgcaatcggccttttcccacttaaccatacctcccttacatccataaatattcatctatcttcaattcttttctaaatcttttatgccaacacacacgcaccccctcacatatacatatttatttacaaagcagctacattgtggtattttaaaacaattcaacaaaatcaaatggccgcttctgcagcagcaaatgaggtgggtggttcctttgcttctggggcagctagcagagtgatgatggtcaggagggggcaggagccccagatttgagtcccagcactgcccctgacaagctagctctccccaggacctctgagctccaggttcatctggcttgtgggctgtgcttggttgttggttcatatagcaaatgttcttggggaccagggccgctattctagacactggatatatacatatggcagtgagtgaaccaggcagtcactgtcctcacggagcttagatcatagtgggatggagagagatcaaagaccaaaaccaaaacctaaagacaaacaaataaaagataatttcagagagtgatgagtaatgtaaagaagataaaagtgacttggcctttgaagctcaagtggttgaggaaaccatctctgagcaggggagagtggagttaagacctgaaggaagagggaagtcaacctttttttttttttttttttttttttgagacagagtcttgctctgtcgcccaggctggagtgcagtggcactatctcagctcactgcaagctccgcctcctgggttcacaccattctcctgcctcagcctcccaagtagctgggactacaggcgcccaccaccacgcctggctaattttttgtatttttagtagagatgggtttcactgtgttagccaggatggtctcgatctcctgacctcatgatccgcccgtcttggcctcccaaagtgctgggattacaggcgtgagccaccacgccccgccggaagtcaacctttcaaagttgacagcagaggtaaagaccttgaggtgggaccaacagaaaggagggtaaagctgggcgcagtggctcacacctgtaatcccagcacttcaggaagccaaggcaggtgaatcacctgagctcaggagttgaagactagcctgggcaacatggggaaaccccatatctacaaaaaaaaaaaaaaaagccaggcatggtggcacgcaccagtagtcccagctactcaggaggctgaggcaggagaatcgcttgagcctgggaggtggaggttgcagtgagccaagatggtgccactgcattccagcctgggtgacacagtggtaccctgtctcaaaaaaaaaaaaaaagaaaagaaacaaagggaaagaaaaggtgtgtctagtttcaggattcttggcacagtgtctggactcccctggtgtcggtgacgctaatgccctcagattttttctttttttttctttgtttttcttttcttttcttttctttttttttttttaagacggagtctcgctgtgtcacccaggctggagtgcagtggcacaatctcggctcactgcaacctccgcatcctgggttcaagcaattctcctgcctcagcctcccaagtagctgggactacaagcacatgccaccatgcccggctaatttttgtgtttttagtagagacggggtttcaccatattggtcaggctagtctcgaactcctgacctcaggcaatccatccgccttggcctcccaaagtgctggcattataggcgtgaaccaccatgcccagccaaccctcagaactctgaggtcagcaaagggaggaggaccctcctggggactcctgggtgccagacataacaggcccagccccttctcacagcctttcccagccagagccgcaccccctcctccctgccccagtctcatgccccgcccctccaccccctacctcccaggtttcccacctgcgtcttctgagactgtggaatcagagtatcaccctcccgacccctgccaaccatttcagggttccagctttgcctaagctccttggcagggcggcagaagattctcacccccagcccaaggtcactcagcttgttagggatctctttctgtcttaagaaaagtcacctgcctaccaccttcattcccaggtttatcaaacaggtatgaggcctgtgcgtctggactgtaaatcctacgagggcagggaacaagtgagccctctgatcaccgccagacacctcccttgccacaggccggtgcctgccacataatcaccctaacagccagctcacggacggctgtttgcaagcacttaactggcaggcactgtactagaacctttacttggattacctcttgtaatcctccccacaacccagtgaggaaggcatgattatcatttccatttcaggtggggaaactgagtcccagagaggtgaagtaacttgtgtggctcagcagcagagctgggacttgaacccagctgcctggcagccacactgcattccctgggccccctggttatgcaaggttggctttatcagtagatgcttaccagggtgtctgcccaggagtcagtgactcagagcaactgacagcccagatacagccctgccctccccgctcccctgagtggagcatctagggagacctatgccaagccagggatagcaatagatggttcctaaaaaagaaggtgctgttaggaaccgctagcatttattgggttctttccgaatgccaacagctgagctagacacttctgcttgcatattctcacggaatccctcacagaaacccttgcagggaagaactactatttttcaccttgtacagttggagaaactgaagctcacactggccaggagtgggggtcatccagctaggaagtggtgggacagacgtttgatcttccaaccctagctcctcagggatttattatctggtctctgaggaccatccatgccctttccacaaacacttcccagttctgagattggctcgaccctggggggacacagctaagattcaagccatcacaaagctcctcatcactgtctcagctaagtcaaacagtgcccagaagaaggagtgggagctctgccttgaacagtcagaaaggtcctcctggggcaagggacatttgcattggggtcttgaagaatgagtaggagttcaagagttgaagagtgttgcaggcatccatttatattcatccattcaacaaatatttcccaaggcctctggtgggccaggcccagtgttgggagatgctggggacacagacttgagtcagaaccaagatttacccccaagaaacttctagtctgatagggaggccagatacagacagtcatcagagtgcaatggacaaagtcctgaggcacccggagtcctgccttccctgcagggtccacttcccaccccagtgaccagataataaagccctgaccaggcactctggctcacgcctgcaataccaacatttgagaggctgaggtgggaggatagcccaggagttcgaaaccagcctgggcaacatggcaagacctcgtctcttaaaaaaaaaaaagtagccaggtgtggtggtgcatgccaatagtcccagctactcgggaggctgaggtgggaggattgcttttgctggggaggttgaggctgcagtgagccatgatcatgccactgcattccagtctgggcaacagagcgagactctgtctcaaaataaaaacagaaataaaaaataaagccccaagaagcctggagtggtgtgtgggctcaactcatgggggcagtgcctgcttcaatcagcagctgagttcaggagccctggagcccctgaaccttagggtaggcaccttggacagctccctcttccccccacttcttggttcctgtaggacaatggctctcaacggggaagggggtgtgtgattttgccccttacggggcatctgacaatgtctggaggcatttgtggtggagaagggcatcaaatggatccagatcagaagcgagacgctgccgacctcctatgttgcataggacagtctggccccaaatgtcagccgtgctgaggtttaggaaccctggcccagaaggtgtgtcagcaggagcatagcaaatcctgtgtgtctgggggatagggcagggtacgtgcctgtctgttttcaccagcctaggaagggatcttggtgcgtacatgtgactctttggcagcactgaatgtggcactacccgtcgttcggtccaggtttttgttggtgactttccaattccctgtgtgtgtgcgtgtgtgtgtgtgtgtgtgtgtgcgtccagccgtgtgtgatctgatcacaggagacaacatgacctgattctcggcccagcgtggccccttcgtgcttgaggggatgtgacagtgttgctgtcttgttacacgggttgtagctttgtgtgcgtctgacccagggccttccaaagtgcaaagttgggaatcatggtgctcgcaccagtggtgtctgtgtaaccagttaggttagtaagcgtgtgtgtgtgtctgtcttcaccagcctgggaagggatgtaattgtgtgtggactttgcagccatgtgtggggctgttgatgtcgatggaaccatgtgggaactattgtatatgatggggtgactcagggtgcagcattgcttggcctgaatgtgacaatatgagcgctcctgggacagatcctcctttccagctgacctgctgctgggtgcctgtgcagagctgggtctgtcagcatcactgtatatacacacctgtccctctgagcgggtccacagccatgcgcgtgactgagagggtgggactgtctcctgtgtttgtatgcgtgtgattgtatgtgtttgtgtgtgtgtgtgtatgggtgtagctggagctgtttgtgtctgtatgactgtgtctgtacctctctgtctgggtaaggacatagcaagtgtggggactatttctaggcctggagaggtctccgtgccttgtccaagcctgtgtgtgtatgtgtgtgtgtgtgcacgcgcgtgcacgcgtgcatccatcatccatccccaagctgtctcctgttgctcccagggctgcgtgtagcagtgtccactgtgtttagctcggggagggtgagccccctctctccattctctttaaatcccagcagtgactctggcatgagggggcccagggtgaggggctgcagggcccagccccaagccccagagcctgccaacccactgcacctggctccgtcctggccccatcctgtggggctgctgatggagagggcccccgggagtcattggggcagcacgggccattaattcattatattaattagctcttcgtctgggctgggggcagggcagccccgcgcaggcccctcccactccagaagtccaaggtcatccagccggccttcctccctctccgcctggtgccagctccaccgcctccgcatgcccagcccccactccctggccctggtccagcccgctggccacggtctacagagagatgactgcgtgggggtgacggagcctgcctgctgtgctgaagtgtgcgagtgggcatgggctcacacctgcaagcatgccctggcaaacttgagcacacagtgtgcctgtgtagatgtgtgtgtctgcaaaggtttgtgtgtgtgtgagggtgtatttgtgcatctgtgatggatgtgtgtctgagaatgtacacatgtggatctctgtgcgcacgtgttcatatctgtgtgtctgcaggtctgttacatatatgtgttatctacatgcatctggttttatgtgtatgccttcggtacatttctgagttaatgtacgtgtgcatctgtgtacttgtgggcctgtgtgtatatatttgtgtgtattcacgtatatatgtgtgtttctgtgtgtatgcatatatactatgcgctcatctttgcataggtacatgtgtgtctgtataccgtacctatgaatatttgtgtgcccatgtacatgtgtatttgtgtgtgtgtatgtgtgtatacatgtatctgtgcataagtgttctgtgtatgcaagtatctgtgtgttgatgtacctgtgtatatgtctgtgcgtgtagaccatgtgtggatgtgtgtacatatctctgcatatgtatatgtatctatggtaattgttggggttctttttgagaccaagtttcgctcttgttgcccaggctggagtgcaatggcgtgatcttggctcactgcaacctccgcctcccgagttcaagtgattctcctgcctcagccacccgagtagctgggattacaggcgtgctccaccacacccggctaatattttgtatttttagtagagatggggttttaccatgttggccaggctggtctcgaactcctggtctcaggtaatcctcccacctcggcctcccaaaatgctgagattacaggtgtgagccaccgcacctggccgtatctatgtaattgttaatctgctcatattggtatgtgtgtcgctgtactctgtatctgtgaatgtatgtgttctgtgtacacaggtatctgtgtctgtgtatatgtgtctgtgtgtatgtcttatgtgtacatgtgtctgcatgtatatgtttgtacatatgtctctgtatatatatgtgtctgtgtacacatgcatctgtgtgtatctgtatgtgtgtgtttgtgtgctacgattgtctctgcatctctggaggtgtgtaggtttgtatgtccatggacacctacccatctgagtctgtgagtctgtgtgggctcatgggaagatacatgttgcatgtgtctgctgtgattgtgtctgctgtgtgtgtatctctgaaaacatcagtgcatgtgtgtggcagcgggtgcaggagacgtctgtgtccgcaaggacgtgtgtgtgcacgtgtggtgcatgtgtgtggcagcgggtgcaggagacgtctgtgtccacaaggacgtgcgtgtgcacatgtgtgcaggtgctaccatgcccgggccttgcctgagctgccaaggctgagccacccccaccttccacagggctgctctcccagagcctggagttcaactctcctgccgacaactacacagtgtgtgaaggtgacaacgccaccctcaggtacctccctcggtgggtggggactcagatctcatggagccatgcggtcctgccccttcaccttcctgggtggggatcctggttacaggaacagcctgggatgggaagacttgggctccacattccccctcagtagcgacacagctatgagctggctccccctcggcttcagtgtccccatctgtcaaaggggtggagagagggggcagagacacacacagagagagggacagagacccagagagagagagggacagagacccagagagaaggggacagagatccagagagaaggggacagagatccagagagaaggggacagagatccagagagaaggggacagagatccagcagagagggacagggttgctgtttccccaggtctccacctctcctcaccctggtctctgttcccccctctctccacgcctctctctctctctctctctcgcttgctctctctctctctctctgtttctgggtctctgtcccccctctttctctgggtctctgtccccctctctctggatctgtctctgggtctctgtccttctctgtgtgtgtgtctctgtccctctctgctggatctctgtccccttctctctgagtctccctctgggtctctttccctctctctctctgggtctctgcccccctctctctctgggtctctgtacccctctctctgtgtgtctctgtccctctctctctgggtctctgttctcctctctctttctctgggtatctgtcccactctgtctctgggtctctgccccctctgcctctgggtctctgtctccctctgtctctgggtctctgtccccctctctctgggtctctgtctctctctctctgggcctctgttcccctctgtctctgggtctctgtccccctctctctgggtctttgtctctttctctctgggtgtctgtatctgtgtgtgtgtgagtctctgtcccctctctctgggtctctgcccccctctctttctgggtctctatccccctctccctaggtctctgtagctctctctctgggtctctctctctctctctttctctctccgggtctctgtccccctctgtctctgggtctctgtgtctctctctctctctgggtctctgtccctctgtgtgtgtgtgtgtctctgtccttctctctctgggtctctgtccctctctctgggtctctgtccctctctctaggtctctttctccttccttctgcatctctattcctctctcccagattctctgttctcccctttttgtgtctctgacacacacgatcactcaataaccacgagctattgttccgttctgcagttgggctcacagctttccctccctgaggctcaacttacccccagctgtatggtgggcacagcagcatccgcctcacagggctgtggtgggacctggagatgcggtggcctccttctcccacccaccccctcggtgggggaagcctcaggctgggtgggtggagaaaaaccttcccactcattctccctgcagctgcttcatcgacgagcacgtgacccgcgtggcctggctgaaccgctccaacatcctgtatgccggcaatgaccgctggaccagcgacccgcgggtgcggctgctcatcaacacccccgaggagttctccatcctcatcaccgaggtggggctcggcgacgagggcctctacacctgctccttccagacccgccaccagccgtacaccactcaggtctacctcattgtccacggtgagcccttggccggggcctggctgggtggaggggttgagagcgtgggggagactaggcatgatgacagataccacgtgttccccaaccccagggatacatagcgagaaagacagacacagccttgcccttggggatttcagcccagcagaagggggccagttacacagacagtgacgcatcaacatgattgcttctagggcaggagagctacagggatgagggggtgcttgggggaagaccacgttcatttgttcagccccattcctggagggcctactctgtgtaagcattgatctacagaacaaggcaggctgtccccacaccttgggagctgattttctgaggacaggctcagagaggacttcccagacgtgacgtctgagctgacgcctttggctgggcacagggctaagaccggaaaagaaacagtgtgtgcagggccaggcaagaagatgagccaagtgtgcaaagggaagtctcatgaggctggaagcgccagatccagagcaggagagatggggctggagagctccacagtgaggcgagaggcagagggcatctgaaatggtggagggtagggagcacctggagagacaggacctggagacagagagaatccagggggatcctggcaagctccaactctggagccagactgcctgggttccaacctcagtgccaccgtccaccagcccagggaccttgagcagggaagaggcccgggactcctttgcaaaatggggatggtgctgtcatatgtcaaatcccagacgtcgtcaattagaagagctacttttattttatgccctactagaaaagaaaaaacaaaaacactgccagcgataccctggcatcctatctcgagggccatcctgcttggagaaatgttcaaatgggagaggggagtggaaagcacagatgacttagaattgatgaaatacagtaacatccaccccagaggctggtagtgagcatctaatcagtggatttgggtaaagcacttagaatagcatctgttacacagaaagtcccatgtgggtatttgttaaataaatttatttaaaataataataaatacaaatagagacggggagaggaattcagaccccaagatggagaaaccaagttaggatgaaggtggagagagaatagagacaagaccagcaattagacaagaagatgccaggcccagacagaggtttcagagaaaaaggcagagactcctgggtctgagggagaaggggctggggtactggactcttgggtctgagggaagaggaactgcgggtctgaactcccgggtctgagggaggaggggctgggggtctgaactcctgggtctgagggaggaggaggggctgggggtctggactcctgggtctgaaggaggaagggctgggggcctggattcctgggcatccatattcagcctctgccgctgcccgcagtccctgcccgcattgtgaacatctcgtcgcctgtgacggtgaatgaggggggcaatgtgaacctgctttgcctggccgtggggcggccagagcccacggtcacctggagacagctccgaggtgaggaccccatcccaggtcaaaagccccgtcccccactgcgcagtctgggcccctccattccccatatccctagctagtttccccagcccccttctccctggccccttggcttcccctcccactctgcttccagttatttcatccacagaccacaaaccccagacctaagaggcgtcaccactggctttccacctgccgtcctaggcctgggccactgcttctgcgtcacttgccaaaccccagcctgcgtcacttccccaaccccagtgtccccgatgtctccccacgcgctcacagcattctcctgggctgagatcccctgccactaggtgccctaagccaggctgcaccagcggtcctgcgtacatctctgcctctctcttctgctggacgctctagcccagcgggcctcatggtgtgggccccagacccgaagcatcagcataccttgggaacttgccaggaatgcactttcccaggctccaaccaagacctgctaaatccaaagctccctctcgctccacaagccccaagaaccagtgctcaaggttacccacaaacggcgccagagtgcccatatatgacagtccaggtcctagacatcacccaccagcccttttatgtggatctccaccaccagatcccagatccctggatcctcattctcagggtctttgaagacccatggtgccagtcactagatcccattccctgaatccctggatcttaccccactgggtcatctgagccccatgagcctggtcttgacatctgggaatctctggatgccctaagtcccagagggtcttctgagactgctgctgtgttatgagacccccatatacttggattgctgatcccaatcaccagatcctgattccctagaccccatgaatcagatcccagaacgagggaccctgccccactggttctgtatttgctagatccttctgagacctaacatcctgggatccccctccccattggggtcctccccacggagctccatgatctgagtcagattcctggagggatctcctgaacccttagattctctaacccaccccactgggttccaggaactgagtcccagacctcactccttcccccacccccagctggagagatcccaggcccccggccctgcagcccctcccccaccccacccccattgacccgggcactccaggccttgccgtgcccgccccgctgatgtgtgtccgtgttgtgcccgtgttgtcccgtgttaagtgtttgtgtccggccccgccccctcctcctccttccccccacagacggcttcacctcggagggagagatcctggagatctctgacatccagcggggccaggccggggagtatgagtgcgtgactcacaacggggttaactcggcgcccgacagccgccgcgtgctggtcacagtcaactgtgagcccccctggcactgggcacgaaagggtggcggacccccgagtccctggggaggagggatctgggggaagaggaagcgggggcgagacttacgggcctgagggaggcgggggctgggggcgggaccccttcgtccccacgcggctaggagaattcgctgacccttgcccctcgccagatcctccgaccatcacggacgtgaccagcgcccgcaccgcgctgggccgggccgccctcctgcgctgcgaagccatggcggttccccccgcggatttccagtggtacaaggatgacagactgtgaggacagcactgagggggccgtgggagcgggaaggggaggtctttagtcccttcgattgtgaggcagggggacggagcggggcgggggaaggcagcagagctctgggtcccgaacctggggcgtccagcttctaggtgatgggatctgtccagccccggagacaagcttgggtccccgcttgatgaatgctggaaccccgtctccccggacttttcagggagctggccaggggtcgggggtcaatgctgaggatctgtcgggcaagatttaggggaccagcagagttcaggagtccctaacgactaggggtgcactacgggagagtccagagtcctgagaggccagggtgcctggaggggggcggcggtgggagtgacccgaggtacatgaggtgctagaacccgaggcgatgggtcactggggtagggggcagaatgctgggtcaccggggaacggaggagcctgagagtcggggggctggcctggctgggcgctgcggcccggcccctgacccggatccctggcaggctgagcagcggcacggccgaaggcctgaaggtgcagacggagcgcacccgctcgatgcttctctttgccaacgtgagcgcccggcattacggcaactatacgtgtcgcgccgccaaccgactgggagcgtccagcgcctccatgcggctcctgcgtgcgtcttcgggcggggcggggccgggaaggtgggcggggccgggggcggggctagggaagtggagacgccgggaccgcccttcaggctggccctgaacttaggagatggacgctgagactgaaaagcaatgcgagtaagaaaccgatccacgcaatcaatattcattgagtgccagctaagggtttgtcgtgggggacgcagctgtgcacaaaagaaacaaggtttggggattcgcagagcttatagtctagtaggagtagaaaagcaataaacaagtggtcatgtaggtaaataagcaaacacatacataaacaaaaaataattttggaggccgggcgtggtggctcacgcctgtaaatcccagcactttgggaggccgaggcgggctgatcacctgaagtcaggaatttgacaccagcctgtccaacatggtgaaactatgtctctaccaaaaaaaaaaaaaaatacaaaaattagccaggcgtagtgatgggcacctgtggtcctagctattcaggatgctgaggcaagaggattgcttgaacctgggaggcagaggttacagtgagccgagattgcgcctgggtgacagagcgagactccgtctcaaaaaaagaaaaaaaaaaaaaaaaagaaacagagtcagaaaagcaggcacacccaatgagagatccagaaaggacgctaaagagtgggctcagaagagatggggcccctggagagacacacatggggttccccactctcaggcctccctccatgaccccttctcttcccccaggcccaggatccctggagaactcagccccgaggcccccagggctcctggccctcctctccgccctgggctggctgtggtggagaatgtaggcgcaacccagtggagctcacctccccctgcagggggcctcaggccaagagtgagagaaacgggggagcaagagccgtgggtctcgtgggggcagaagagctctcggccaccaaggaagaagagagaggagaagaggaggaggcagaggaagaaagatcttcagagaacccatcactgtgagggataacgcaaaattatgcatctttctacagccattctcgccacccgttcacgtttccgattgtgacccactcccgccaccccatacccctctctcttagctcaggctgtcaactggcttgtgtgggtgtgggtgtgtgagtgtgagcctgcatgcatgtgtaggtgtctgtgtctctgtttgtgtgtgtgtgggggggtgggctgggggaagggactcagccgtcctcccgcccccaaaacccccatgtccactgtccccaaccctattgcctctcacctctggctggaggtaggtatgaggctctgcagtggaagctgtgaagagaggcttaccaggctccctgcttccccaatatatgcacgcacactacccctccccctgtcgaaagggcaactcctggcaggttgggagtggggaggggcatcgcactcacctgtcaagctgtcattcagcctttgtgagtaagtgggggacctccatctaggctctgggcttccctgctgtcaaccaccagcttcctgtagccagaggccccatcgctggctcagtggcctgagaccttcccacttttcctgtccctccacaccctggattttctggccccctcctgggccaatcggtgcttccatccaactgtcagactggtggcaggagtcacctgtctgtttcagtgctttgccctacccttgccaccactccccttggccttgatttccccacctgcggcaccagccagctgcccttggggcctttgcagctggcccacaggtgtgagcttgctggtctatcacttcctggcctctccaccaactgtacctcccaaaggctacctgaccgccctcacagacactcagacgcaccacacacacatacacacacacagacacacacacacacacacacacacacaccagcgactgtgaccagcaatagccccctggctccagctgtccggtagctggtgactagctgtatttccccctgggtaggcatctggtgtcaggaagggacgctgagaggccgcagcctcagctctgactgtaggaacactccaccctggtacaccacaccacacaaagtgggggacagagaggcatcacacagacatcctgagcccagacaaagatgccatgtcaccaactccgactcccaggagaccctctatataaacacccaccccaaaccacaccacccagagtctggtggagaaaaggagagggcaaggcgcagtgactgtacctcagacgggggcatgggccccatcccacattgtcttccattcccagggtccaggggatggggtgggacaggggagggatgctagggagggggtggggggccctgggggccatgtgttccaattcatggggagtgttgagaccaccacaccaataaacgcctttttccaaa

SEQ ID NO: 263 - DNA, 539 bp, Homo sapiens
agggtgggtaagaaatacctgcaactgtcagcctcagcagagctctggggagtctgcaccatggcttggaccccactcctcttcctcaccctcctcctccactgcacaggtcaggatggccctcagcaccctgacctccagctcactgataccacctcccaaacttatgccaggaatgtccttccctcttttcttgactccagccggtaatgggtgtctgtgttttcagggtctctctcccagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacgggatccctgatcgcttctcaggctccagctctggggctgagcgctacctcaccatctccagcctccagtctgaggatgaggctgactattactgtcagacctggggcactggcattca

SEQ ID NO: 264 - DNA, 513 bp, Homo sapiens
gaggaaaacaaaccccagctgggaagcctgagaacacttagccttcatgagtgtccccaccatggcctggatgatgcttctcctcggactccttgcttatggatcaggtcaggggaagggactctatccctgggggaccacagaaaacagggtccaggttactctcatcctcatgatcataactgtgtctctcctgttcgttttaggagtggattctcagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgatcgcttctctggctccatccttgggaacaaagctgccctcaccatcacgggggcccaggcagatgatgaatctgattattactgtgtgctgtatatgggtagtggcatttc

SEQ ID NO: 265 - DNA, 483 bp, Homo sapiens
atggcctggaccccactcctcctcctcttccctctcctcctccactgcacaggtcaggaggaccctcagcatcctcatgccccagctcactgacaccatctcccaaactcataccagaaatgttgtttgctcttgtccttccttcaggccataatgagcgtctctgttttcagggtctctctcccagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtaacactca

SEQ ID NO: 266 - DNA, 748 bp, Homo sapiens
tctgaggatacgcgtgacagataagaagggctggtgggatcagtcctggtggtagctcaggaagcagagcctggagcatctccactatggcctgggctccactacttctcaccctcctcgctcactgcacaggtggctgcctgcaaggaattcagggagcgttcctggatgtcacctgggctgatgatctgttcctcctgcctgggaaccagtcttcatctctcccgactgatctctgtgttgctctcttcttgcaggttcttgggccaattttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcacacagtgctccagacccatggggaagtgagacagaaactccccagagcatctctacctgggccagtctcagcctgtctccaccagagagggtagctctcccatctctcctgtctaagtgcttgaggtgaactttgcttatgacttcctcttttccttttcaaaataccaatctgtttttccaca

SEQ ID NO: 267 - DNA, 544 bp, Homo sapiens
gctgtgtccactatggccctgactcctctcctcctcctgctcctctctcactgcacaggtagggacagggctcagagcccagggtggtccccagcctgatctgtccctcatggctcagatccctcagcagctgcgccctgaccctgctcctcactgtgctgtgtctgtgtctgcaggttccctctcccggcccgtgctgactcagccgccctctctgtctgcatccccgggagcaacagccagactcccctgcaccctgagcagtgacctcagtgttggtggtaaaaacatgttctggtaccagcagaagccagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgctaatcacagtgagacagatgaggaagtcggacaaaaaccaaggttttaa

SEQ ID NO: 268 - DNA, 477 bp, Homo sapiens
gggaatctgcaccatgccctgggctctgctcctcctgaccctcctcactcactctgcaggtgagagtggaccttacccagggatctgcacccacctctgctccagcttctccactccctggctcagtggactctgatcctgctctcacattcctttctgtcccctctacagtgtcagtggtccaggcagggctgactcagccaccctcggtgtccaagggcttgagacagaccgccacactcacctgcactgggaacagcaacattgttggcaaccaaggagcagcttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcattggacagcagcctcagtgctc

SEQ ID NO: 269 - DNA, 500 bp, Homo sapiens
ccaccatggcctggactcttctccttctcgtgctcctctctcactgcacaggtagggaaagtccttataaactgagtctcagtgtccaacctacaccatcccctgtggctcagacctacaagaagctttaccctgggaactgccttatcacccatgatgtctgtgttttcaggttccctctcccagcctgtgctgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctaagactca

SEQ ID NO: 270 - DNA, 509 bp, Homo sapiens
tgagcgcagaaggcaggactcgggacaatcttcatcatgacctgctcccctctcctcctcacccttctcattcactgcacaggtgcccagacacagggtcaggggaggggtccaggaagcccatgaggccctgctttctccttctctctctagaccaagaatcaccgtgtctgtgtctctcctgcttccagggtcctgggcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctggcacagtgctcc

SEQ ID NO: 271 - DNA, 515 bp, Homo sapiens
gctctgcttcagctgtgggcacaggaggcagcactcaggacaatctccagcatggcctggtcttctctcctcctcactctcctcgctcactgcacaggtgactggatgcagatcgaggggagggtccctgggaagcctatggattcttgctttctcctcttgtctctagaagcagaatcatgatgcctgtgtctctcccacttccagggtcctgggcccagtctgtgctgacgcagccgccctcagtgtctggggccccagggcagagggtcaccatctcctgcactgggagcagctccaacattggggcgggttatgttgtacattggtaccagcagcttccaggaacagcccccaaactcctcatctatggtaacagcaatcggccctcaggggtccctgaccaattctctggctccaagtctggcacctcagcctccctggccatcactggactccagtctgaggatgaggctgattattactgcaaagcatgggataacagcctgaatgct

SEQ ID NO: 272 - DNA, 493 bp, Homo sapiens
atggcctggaatcctctcctcctcctgttcctctctcactgcacaggtaggaaaaggcctcagagaccagggtcagccacacagcctgattctgactcttgtgtcaaagatcactaaaaaaaatattaccttggtttctgtcttaaagcctatatatgcctgtgttccaggttccctctcgcagcctgtgctgactcagccaacttccctctcagcatctcctggagcatcagccagactcacctgcaccttgcgcagtggcatcaatcttggtagctacaggatattctggtaccagcagaagccagagagccctccccggtatctcctgagctactactcagactcaagtaagcatcagggctctggagtccccagccgcttctctggatccaaagatgcttcgagcaatgcagggattttagtcatctctgggctccagtctgaggatgaggctgactattactgtatgatttggcacagcagtgcttct

SEQ ID NO: 273 - DNA, 522 bp, Homo sapiens
ggggaagctcagcttcagctgtggtagagaagacaggattcaggacaatctccagcatggccggcttccctctcctcctcaccctcctcactcactgtgcaggtgacaggatggggaccaagagaggggccctgggaagcccatggggccctgctttctcctcttgtctcctttcgtctcttgtcaatcaccatgtctgtgtctctctcacttccagggtcctgggcccagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaagtctggcacctcagcctccctggccatcagtgggctccggtccgaggatgaggctgattattactgtgcagcatgggatgacagcctgagtggt

SEQ ID NO: 274 - DNA, 473 bp, Homo sapiens
tctggcaccaggggtcccttccaatatcagcaccatggcctggactcctctctttctgttcctcctcacttgctgcccaggttaagagagatttcaaataccagcctttggagggatccctttttctccctttctaattcctaatatatgtctgttttttttgtttcagggtccaattcccaggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgacccttttgggtgcgcagcctgaggatgaggctgagtattactgcttgctctcctatagtggtgctcg

SEQ ID NO: 275 - DNA, 520 bp, Homo sapiens
actgcgggggtaagaggttgtgtccaccatggcctggactcctctcctcctcctgttcctctctcactgcacaggtaggaatagacttcagagaccagggtcagccacccagcctgattctgactcttctggcaaagatccctgaaaaactttaccctggtttctgccttagcacccattaatgtctgtgtttccaggttccctctcgcaggctgtgctgactcagccgtcttccctctctgcatctcctggagcatcagccagtctcacctgcaccttgcgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagcgcttct

SEQ ID NO: 276 - DNA, 581 bp, Homo sapiens
ctgatttgcatggatggactctccccctctcagagtatgaagagagggagagatctgggggaagctcagcttcagctgtgggtagagaagacaggactcaggacaatctccagcatggccagcttccctctcctcctcaccctcctcactcactgtgcaggtgacaggatggggaccaagaaaggggccctgggaagcccatggggccctgctttctcctcttgtctccttttgtctcttgtcaatcaccatgtctgtgtctctctcacttccagggtcctgggcccagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtc

SEQ ID NO: 277 - DNA, 472 bp, Homo sapiens
tctggcgccaggggtcccttccaatatcagcaccatggcctggactcctctctttctgttcctcctcacttgctgcccaggttaagagagatttcaaataccagcctttggagggatccttctgtctgcccttctaatttctaacatgtgtctgttttttgtttcagggtccaattctcagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattactgcctgctctactatggtggtgctcag

SEQ ID NO: 278 - DNA, 517 bp, Homo sapiens
gctctgcttcagctgtgggcacaagaggcagcactcaggacaatctccagcatggcctggtctcctctcctcctcactctcctcgctcactgcacaggtgactggatacaggtccaggggaggggccctgggaagcctatggattcttgctttctcctgttgtctctagaagccgaataatgatgcctgtgtctctcccacttccagggtcctgggcccagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttc

SEQ ID NO: 279 - DNA, 496 bp, Homo sapiens
ccaccatggcctggactcctcttcttctcttgctcctctctcactgcacaggtagggacaggcctcagagatcagggccagccacccaacctgattctggctcttctggtaaagatccctgaaaaacctcaccctgaaccctgcccatcaaccatgagtgtctgtgtttgcaggttccctctcccagcctgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggatccaaagatgcttcagccaatacagggattttactcatctccgggctccagtctgaggatgaggctgactattactgtatgatttggccaagcaatgcttct

SEQ ID NO: 280 - DNA, 507 bp, Homo sapiens
gctgcgggtagagaagacaggactcaggacaatctccagcatggcctggtcccctctcttcctcaccctcatcactcactgtgcaggtgacaggatggggaccaagagagaggccctgggaagcccatgcgaccctgctttctcctcttgtctccttttgtctcttgtcaatcaccatgtctgtgtctctctcacttccagggtcctgggcccagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgaatggtc

SEQ ID NO: 281 - DNA, 520 bp, Homo sapiens
ggctagaggcaggcccggtgctggggtctcaaggcagcgctctcgggacatctccaccatggcctgggctctgctcctcctcaccctcctcactcagggcacaggtgacacctccagggaaatggccttggggacctctgagctaatgcttggtcttctgctcctgctcctcagggtcactggacccagtactgacccagtagagtgtgtttctccctctttccagggtcctgggcccaatctgccctgactcagcctccttttgtgtccggggctcctggacagtcggtcaccatctcctgcactggaaccagcagtgacgttggggattatgatcatgtcttctggtaccaaaagcgtctcagcactacctccagactcctgatttacaatgtcaatactcggccttcagggatctctgacctcttctcaggctccaagtctggcaacatggcttccctgaccatctctgggctcaagtccgaggttgaggctaattatcactgcagcttatattcaa

SEQ ID NO: 282 - DNA, 504 bp, Homo sapiens
gctgtggactcagaggcagagctctggggcatttccattatggcctggacccctcccctgctcgtcctcactctctgcacaggtgctgcctcccagggctcagcccccagtgggatcaagatcagcctggccctgaccttcaactcaacatagggagtgatgcagggtgtggggttctgggaatgaggccctcatcctcagactcacctctcctgtcctctcttgtgggctccgttatttcctctgggccaactcaggtgcctgcagtgtctgtggccttgggacaaatggccaggatcacctgccagggagacagcatggaaggctcttatgaacactggtaccagcagaagccaggccaggcccccgtgctggtcatctatgatagcagtgaccggccctcaaggatccctgagcgattctctggctccaaatcaggcaacacaaccaccctgaccatcactggggcccaggctgaggatgaggctgattattactatcagt

SEQ ID NO: 283 - DNA, 519 bp, Homo sapiens
gctgtaggctcaggaggcagagctctgaatgtctcaccatggcctggatccctctcctgctccccctcctcattctctgcacaggtgctgcccctaggctcagtctccacagaccccaagttgagcctgacctgaatcctgagcaaagccctgccactgcctctgggggggattcctggcaatgcgtcctttgtcctcaagccccctctcctgtcttttcttgcagtctctgtggcctcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacaacaat

SEQ ID NO: 284 - DNA, 546 bp, Homo sapiens
gctgtgctgtgggtccaggaggcagaactctgggtgtctcaccatggcctggatccctctacttctccccctcttcactctctgcacaggtgctgtccccaggccctgctccaggccctgctccagtcttattccccacagatcccaagttgagcctgccctgaatcccgagcaaagcccagacgcagcctctgggtgcgactcctgggaatgggtcctttgtcttcaagccccctctcttgttcttccttgcaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagatgaggctgactattactgtcaatcagcagacagcagtg

SEQ ID NO: 285 - DNA, 619 bp, Homo sapiens
tctctgagcccaggcccacgtgagggtggggtgaggagaggagcccaggatgctgattttcatggaggccccgccctcctctgaggcaaaggggataagacagggctggggcagggccagtgctggggtcacaagaggcagcgctctcgggacgtctccaccatggcctgggctctgctgctcctcactctcctcactcaggacacaggtgacgcctccagggaaggggtcttggggacctctgggctgatccttggtctcctgctcctcaggctcaccggggcccagcactgactcactggcatgtgtttctccctctttccagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcag

SEQ ID NO: 286 - DNA, 558 bp, Homo sapiens
aagagaggcctgggaagcccagctgtgctgtgggctcaggaggcagagctgtgggtgtctcaccatggcatgggccacactcctgctcccactcctcaacctctacacaggtgctgcccccagaccctgccccaggctcagccctcctaagcccctggtcttaccctgaaccctgagctcagcccaggcatagcctcagggcgatactactggaatgggtttgttatcttcaagccccctctcttgtcctctcttgcaggctctgttgcctcctatgagctgacacagctaccctcggtgtcagtgtccccaggacagacagccaggatcacctgctctggagatgtactgggggaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctggggatgaggacaatccctca

SEQ ID NO: 287 - DNA, 1515 bp, Homo sapiens
gcacagaggagctgtgccctggaatggggcctgtacctgtccaaggcttgtgccgtcccctgtgggagatgagaagcgtccctgcattgggctcttggggacccgtcttggacatgagtgagaatgaagagggtccctgcattgggctctggcatgtgactttaaatggatttaggcctgtaccagacatctcatgtctgacataaaatatttacaatcaggacattactagagaagcagaaaaaagctaaccacctccctcctgagccaggatggaatgaaggaggggactgtggaccccagataattcccctgtcaccactgtgactctaacaacctcttaaatcacggccaacatctatcccataggaaggtctttatatcccctagaaaatacagaggaagtcagctctgagcttttccacgaccaacccagccaaggagcaaggctgggcacaacctgggtaaagatgtgagcccagaccatgggaccagtgggtgaaggaaaatcgcatgggctgagggggtgggtaagcaggggccagccctcctctctctgtttcctttggggctgagtccttctctggaaaccacagatctcctccagcagcagcctctgactctgctgatttgcatcatgggccgctctctccagcaaggggataagagaggcctgggaggaacctgctcagtctgggcctaaggaagcagcactggtggtgcctcagccatggcctggaccgttctcctcctcggcctcctctctcactgcacaggtgatccccccagggtctcaccaacctgcccagcccaagggttctgggtccagcgtgtccttgattctgagctcaggagggcccttcctgtggtgggcaggatgctcatgaccctgctgcagggtgggaggctggtggggctgaactccccccaaactgtgctcaaaggcttgtgagagcctgagggactgcacctgccaggagagagtagtgagttttcagttcaaagtctccatacaacaggaaagtcatgggccactggggctggggctgattgcaggggataccctgagggttcacagactctctggagcttgtctgggacagcagggcaagggatttcataagaagcatctttcacctgcaagccaacctctctcttatttatttatttatttatttatttatttatttatttatttttatctttgcaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatcccacg

SEQ ID NO: 288 - DNA, 523 bp, Homo sapiens
agctgtgggctcagaagcagagttctggggtgtctccaccatggcctggacccctctctggctcactctcctcactctttgcataggtgctgcctcccagggctcaaccccatattatcatgctagctgtgccaacctggccctgagcttcggctcaacacagggagtagtgtagggtgtgggactctaggcgtgaaacccttatcctcacctcttctgtcctcttttgcaggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtg

SEQ ID NO: 289 - DNA, 490 bp, Homo sapiens
gaatatctccaccatggcctgggctctgctcctcctcaccctcctcactcagggcacaggtgaggcctccagggaaggggcttcggggacctctgggctgatccttaactcctgctcctcaggctcacctgggcccagcactgacttactaaaatgtgtttcttcctttttccaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccatctctgggctccaggctgaggacgaggctgattattactgcagcttatatacaagcagcagcactttccacagag

SEQ ID NO: 290 - DNA, 529 bp, Homo sapiens
tctgtgggtccaggaggcacagctctgggaatctcaccatggcctggatccctctcctgctccccctcctcactctctgcacaggtgctgaccccaggcccttccccaggctcagtccccacagattccaagttgagcctgacctgaatcctgagcaaagcccagacacagcctctgggtgggactcctggaaatgggtcctttgtcttcaagccccctctcttgttcttccttgcaggctctgaggcctcctatgagctgacacagccaccctcggtgtcagtgtccctaggacagatggccaggatcacctgctctggagaagcattgccaaaaaaatatgcttattggtaccagcagaagccaggccagttccctgtgctggtgatatataaagacagcgagaggccctcagggatccctgagcgattctctggctccagctcagggacaatagtcacattgaccatcagtggagtccaggcagaagacgaggctgactattactgtctatcagcagacagcagtg

SEQ ID NO: 291 - DNA, 519 bp, Homo sapiens
gctggggtctcaggaggcagcgctctcaggacatctccaccatggcctgggctctgctgctcctcaccctcctcactcagggcacaggtgacgcctccagggaaggggcttcagggacctctgggctgatccttggtctcctgctcctcaggctcaccggggcccagcactgactcactggcatgtgtttctccctctttccagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctccacagtg

SEQ ID NO: 292 - DNA, 763 bp, Homo sapiens
gcctcagccatggcctggacccctctcctcctcagcctcctcgctcactgcacaggtgctctgcccagggtatcaccaacctgcccatccccagggctctgggtccagtgtggccatgactatgagctcaggagggccctgcctgtggtgggcaggatgctcatgaccctgctgcagggtgagggactggcggagctgaagtcccctcaaactctgctcagaggcttgtgagagcctgaggggctgcacctgccaggagagagtactgggttttcagttcaaaggctccatgcagagggaaagtccatgggccactggggctagggctgattgcaggggataccctgagggttcacagactctctgaagcttttccaggacagcagggcaggggatttcatacggatcttttacctaaaagccatcctctcctttttttttttttttaatctttgcaggctctgcgacctcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcagggatccctgagcgattctctggctccaacccagggaacaccgccaccctaaccatcagcaggatcgaggctggggatgaggctgactattactgtcaggtgtgggacagtagtagtgatcatcccacg

SEQ ID NO: 293 - DNA, 517 bp, Homo sapiens
tgctggggtctcaggaggcagcactctcgggacgtctccaccatggcctgggctctgctcctcctcagcctcctcactcagggcacaggtgacacctccagggaaagggtcacaggggtctctgggctgatccttggtctcctgctcctcaggctcacctgggcccagcactgactcactagagtgtgtttctccctctttccaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacactttccaca

SEQ ID NO: 294 - DNA, 539 bp, Homo sapiens
gtgggctcaggaggcagagctctgggaatctcaccatggcctggacccctctcctgctccccctcctcactttctgcacaggtgcttctcccaggccctgccccaggctcagtgcccatagaccccaagttggccctgccctgaaccctgtgcaaagcccagacacagtcttagggtaggacccctgggaatgggctcttgatcttcaagccccctctcctgttttccttgcagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtaatcatagcaca

SEQ ID NO: 295 - DNA, 747 bp, Homo sapiens
cttgactctgctgatttgcatcacaggctgctctcttcagcaaggggataagagagggctggaaggaacctgcccagcctgggcctcaggaagcagcatcgggggtgccgcagccatggcctggaccgctctccttctgagcctccttgctcactttacaggtgctgcccccagtgtcccagccacctacccagctccaaggctctgggtccagcctggcctgacagtgatctcagcagggccctgcctgtggtgtgcaggatgctcatgatcctgctgcagggggaggggctgctggaggtgaaatccccccacactgttcttctgtgctcatggtcccctgaggacacttctattcctgaaactcaggccaggcaggtgggaaggcattgttgggttgagcctctcagtttcaagtctattctattctctccccttttcttgcaggttctgtggcctcctatgagctgactcagccactctcagtgtcagtggccctgggacagacggccaggattacctgtgggggaaacaacattggaagtaaaaatgtgcactggtaccagcagaagccaggccaggcccctgtgctggtcatctatagggatagcaaccggccctctgggatccctgagcgattctctggctccaactcggggaacacggccaccctgaccatcagcagagcccaagccggggatgaggctgactattactgtcaggtgtgggacagcagcactgcacaca

SEQ ID NO: 296 - DNA, 635 bp, Homo sapiens
tctctaagcccaggcccaagtgagggtggggtgagaagaggagctcaggatgcagatttgcatggaggtcccgcccttctctgaggcagagggataagacagggctgggggcaggcccagtgctggggtctcaggaggcagcgctctcaggacgtcaccaccatggcctgggctctgctcctcctcaccctcctcactcagggcacaggtgatgcctccagggaaggggccacagggacctctgggctgatccttggtctcctgctcctcaggctcacctgggcccagcactgactcactagactgtgtttctccctttccagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatttccaca

SEQ ID NO: 297 - DNA, 529 bp, Homo sapiens
ctcgaatagagctcttggaagtccctccaaccatggcctgggtctccttctacctactgcccttcattttctccacaggtcagaacatcccagggaattcagggaaatgttttcactgctattttcccatgagcaccagtcctcaggggcattctttccagttcttctgtgcattcagcatcattcatgacattctgtttacaggtctctgtgctctgcctgtgctgactcagcccccgtctgcatctgccttgctgggagcctcgatcaagctcacctgcaccctaagcagtgagcacagcacctacaccatcgaatggtatcaacagagaccagggaggtccccccagtatataatgaaggttaagagtgatggcagccacagcaagggggacgggatccccgatcgcttcatgggctccagttctggggctgaccgctacctcaccttctccaacctccagtctgacgatgaggctgagtatcactgtggagagagccacacgattgatggccaagtcggttgagc

SEQ ID NO: 298 - DNA, 691 bp, Homo sapiens
aagaacctgcccagcctgggcctcaggaagcagcatcggaggtgcctcagccatggcatggatccctctcttcctcggcgtccttgcttactgcacaggtgctgcccctagggtcctagccactggtccagtcccagggctctgggtccagcctggccctgactctgagctcagcagggcccccgcctgtggtgggcaggatgctcatgaccctgctgcaggtggatgggctcggcggggctgaaatccccccacacagtgctcatgtgctcacactgccttagggctctttcatccctggatctgtgtccaggccaggcacgtgggaagatttacttggagttcagctcctcagtttcaagccttttctctcccgttttctctcctgtaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgcacaca

SEQ ID NO: 299 - DNA, 127 bp, Homo sapiens
cccagcaggctcctgctccagcccagcccccagagagcagaccccaggtgctggccccgggggttttggtctgagcctcagtcactgtgttatgtcttcggaactgggaccaaggtcaccgtcctag

SEQ ID NO: 300 - DNA, 460 bp, Homo sapiens
gtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaaccccaataaatatcctcattgacaaccagaaa

SEQ ID NO: 301 - DNA, 175 bp, Homo sapiens
gtgtgggggccatgtggactccctcatgagcagatgccaccagggccactggccccagcttcctccttcacagctgcagtgggggctggggctggggcatcccagggagggtttttgtatgagcctgtgtcacagtgtgtggtattcggcggagggaccaagctgaccgtcctag

SEQ ID NO: 302 - DNA, 462 bp, Homo sapiens
gtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataggttctcaaccctcaccccccaccacgggagactagagctgcaggatcccaggggaggggtctctcctcccaccccaaggcatcaagcccttctccctgcactcaataaaccctcaataaatattctcattgtcaatcagaaa

SEQ ID NO: 303 - DNA, 176 bp, Homo sapiens
gtgtgggggccatgtggactccctcatgagcagatgccaccaggaccactggccccagcttcctccttcacagctgcagtgggggctggggctaggggcatcccagggagggtttttgtatgagcctgtgtcacagtgttgggtgttcggcggagggaccaagctgaccgtcctag

SEQ ID NO: 304 - DNA, 462 bp, Homo sapiens
gtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcataggttctcaaccctcaccccccaccacgggagactagagctgcaggatcccaggggaggggtctctcctcccaccccaaggcatcaagcccttctccctgcactcaataaaccctcaataaatattctcattgtcaatcagaaa

SEQ ID NO: 305 - DNA, 33 bp, Homo sapiens
gtatttggtggaggaacccagctgatcatttta

SEQ ID NO: 306 - DNA, 72 bp, Homo sapiens
cagagagggtttttgtatgagcctgtgtcacagcactgggtgtttggtgaggggacggagctgaccgtccta

SEQ ID NO: 307 - DNA, 70 bp, Homo sapiens
ggagggtttgtgtgcagggttatatcacagtgtaatgtgttcggcagtggcaccaaggtgaccgtcctcg

SEQ ID NO: 308 - DNA, 46 bp, Homo sapiens
tcactgtgtgctgtgttcggaggaggcacccagctgaccgccctcg

SEQ ID NO: 309 - DNA, 438 bp, Homo sapiens
gtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctcttaggcccccgaccctcaccccacccacaggggcctggagctgcaggttcccaggggaggggtctctgcccccatcccaagtcatccagcccttctcaataaatatcctcatcgtcaacgag

SEQ ID NO: 310 - DNA, 317 bp, Homo sapiens
gtcagcccaaggctgccccctcggtcactctgttcccgccctcctctgaggagcttcaagccaacaaggccacactggtgtgcctgatcagtgacttctacccgggagctgtgaaagtggcctggaaggcagatggcagccccgtcaacgcgggagtggagaccaccacaccctccaaacagagcaacaacaagtacgcggccagcagctagctacctgagcctgacgcctgagcagtggaagtcccacagaagctacagttgccaggtcacgcatgaagggagcaccgtggagaagacagtggcccctgcagaatg

SEQ ID NO: 311 - DNA, 546 bp, Homo sapiens
gagagactgaagaacccagcattgcagcagctccaccatggcctgggctcctctgctcctcaccctcctcagtctcctcacaggtcagggtgggcagtgggctgggcccccaaagggacccccacctcccagcctccatctccccatccctgctcttcctcctccaacagctcatcagccacccaccaacaggagccctcatgggtgtctgtgtttccagggtccctctcccagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaagatgagagtgactaccactgtggggcagaccatggcagtgggagcaacttcgtgtaa

SEQ ID NO: 312 - DNA, 244 bp, Homo sapiens
ctctaagctgactcagctgcctgaagtgtctgtggctttgggacagatggccaggatcacctgccatggagaggacttagaaagctattatgcacactggtaccaacacaagtcagtccaaacccctaatctcattgtatacaatgatagaaagctgtgctcagagatcactgagcgattctctggttcctgctcagggggaacagccacactgaccattactggggctcacgttgaagacgag

SEQ ID NO: 313 - DNA, 283 bp, Homo sapiens
cccagtctgttctgactcagcctcgctcagtgtccaggtctcctggacagtaggttactatcttctgcactggaaccagcagtgacattgggggttatgaccttgtctcctggtgccagtagcacccaggcaaagcccccaaactcatgatttatgatgtcgctaattggccctcaggggcccctggttgcttctctggctccaagtctggcaacacggcctccctgaccatctctgggctccaggctgaggacgaggctgattattactgcagctcatatgc

SEQ ID NO: 314 - DNA, 452 bp, Homo sapiens
atggcttggcccctctgctttttgacctcttccctccctgcccagctgaggcacatcctgctctggggagaagggtctatgcggtcctcagcccacctctgctccactccctttctcacagggctcattgttttctctttctctccaccctcctgggtctgtggtccacatggcactgacagcctctttcactgaccaagcctccgggactgacaattacaatcacccaccctggaaacagccataatactgtcaatcaaggcacagcttggattcaggagcacctgggacatgtccccaaacctcagacccagagggggtaacaaccatccctcagggacctcagggaatttcccagccccatgttaggcagtttggcctccctggccatctctgggctccaggctggcgacggtgctgattttcactatttagcacagaatggcagcctc

SEQ ID NO: 315 - DNA, 244 bp, Homo sapiens
gtggacagtcagcaagggtaacctgccagggagaaaacctaagaagccatggtacaaactggtaccagcagaaccctgccagatgcctgtgcaggtcatacatggtaacaacaaccagccctcagggatcccagaccgattctctggctccaagtcaggaacacagccaccctgaccatcactggggctcaggttgaacatgaagctgactattaccgtcactcatgggacaacagtggtactc

SEQ ID NO: 316 - DNA, 277 bp, Homo sapiens
ccagtctgccctgattcagcctccctccgtgtccgggtctcctggacagtcagtcaccatctcctgcactggaaccagcagtgatgttgggagttatgactatgtctcctggtaccaacagcacccaggcacagtccccaaacccatgatctacaatgtcaatactcagccctcaggggtccctgatcgtttctctggctccaagtctggcaatacggcctccatgaccatctctggactccaggctgaggacgaggctgattattagtgctgctca

SEQ ID NO: 317 - DNA, 518 bp, Homo sapiens
atggcctggacccctctcctcctccagcttctcaccctctgctcaggtgactgcctgtggaatgccaaagtgattattggggacacatgggatgacttttctcttatattttaacattgtggggtgggtagtgaacccagactcacctctctgtgcctgcctcctctgttccagggtcctgggcacagtctgcgctgacccaggaagcctcggtgtcagggaccgtgggacagaaggtcaccctctcctgtactggaaacagcaacaacgttggaagttatgctgtgggctggtaccaacagatttctcacggtgctcccaaaactgtgatgtttggaaattctctgccctcagggatccctgaccgcttctctggctcaaagtctgggaccacagcctccctgactatctcgggcctctagcctgaggacgaggctgattattactgttcaacatgggactacagcctcagtgctcacacagtgctgcaggcacatggggaaccgagacaaaaacct

SEQ ID NO: 318 - DNA, 301 bp, Homo sapiens
gcctgtgctgactcagccgccctccctctctgcacctccggatcagccagactctcctgcaccctgagcagtggcttcagtgctgatttctgctggatatactggtaccagcataaaccagggagcctccccagtatctcctgagccactaccaaaattcacttcatgaccagggctccggggtccccaggcacttctctggattaatggaaggccggtccaataaagggctcttgctcatatctgatctccagtctgaggatgaggcttactattactgtatgatcgagcacagcagagc

SEQ ID NO: 319 - DNA, 592 bp, Homo sapiens
atggactggacctttctcagcctcctcgctcactgcacaggtgctgccgccagagtcccagccacccgcccagccccgggctgtgggaccaggctggccttgattgtgagctcagcagggctctgcctgtggtggaaaggatgctcatgaccttgctgcagggtgaggggctggtaaggttgaaatcttcctgtactcctgtgctcatgggcactctgaggggcacagtcaggctccctttcatcccagaagctctgtcccagccaggcaggtgcaaaggaatcctgaggatcagctcctcagcttcaagccttttctccctcatctcctgcaggtttcatggccacatatgagctgtctcagccaccctcagtgtcagtggccccattacagatggccaggatcacctgctgtggaaatactgttggaggtggatatgtttattggtaccagcagaagtcaggccagacccctgtgccggtcatctataaagacagcaagtggccctcaaggacccctgagtgattctctggctccaacttgtggaacacagccactctgaccattagtggggcccaggccagggacgagg

SEQ ID NO: 320 - DNA, 244 bp, Homo sapiens
catatgtgctgacacagccaccctcagtgtcagtggccccaggacagacacccaggatcacctgtaggggaaataatattggaattaaacctgcttaatggtaccagcagaaaccaggccaggcccttgtgcaggtcatctatggggatagcagatggccttcagggatctctaagtgattctccagctccaactcggggaacatggtcaccctgaccatcagtggagcccaggctggggacga

SEQ ID NO: 321 - DNA, 250 bp, Homo sapiens
ctatgagcttacacagccaccctcagtgtcagtgtcaccaggacaggcagccatgatcacctgctcttgagataacctcaaagatgagtatgtttactggttctggcagaagccagaccaggcccatactggtgatatatgaaggcagcaagcggccctcaggaatttctgattttctgagtccagctcagggaacatggccaccctgaccatcagcagggctcagactgaggacgaggctgactattac

SEQ ID NO: 322 - DNA, 435 bp, Homo sapiens
atggcctgggctctgctcctcctcaccctcctcactcagggcacaggtgatgcctccaggaaaggggcctcagggacctctgggctgattcttagtctcctgctcctcaggctcacctgggcccagcactgactcactagagtgtgttttttcctttttccgggctctcgggctcagtctgccctgactcagcctcactcagtacccgggtctcctggacagtcggtcaccatctcctgcactggaaccagcagtgacgttgggcattataactatgtctcctggtgccagcagcacccaggcacatgatttatgaagtcagttataggctctctggagtctctgatcacttctctggctcccagctctggcaacatggcctccatgaccatctctgggctccaggctgaggacgaggctgattattactgcagt

SEQ ID NO: 323 - DNA, 211 bp, Homo sapiens
tctgacttagtctccctccaccttatgggcacctggcagtcggtcatcatcagctttgctgaatcagcagcaacattgagggtaaaaattgtgtctcctggttccaccagaaataaagtagagccccacacagctgaggtgtggggtcaaaaattaaaactaagagacataagactcattctcaggctccaagtctggccagtgagcttct

SEQ ID NO: 324 - DNA, 223 bp, Homo sapiens
tatgagctgacacagccacccgcggtgtcagtgtccccaggacagacagccaggatcagctgctctggagatgtactgagggataattatgctgactggtacccgcaaaagccaggccaggcccctgtgctggtgatatataaagatggtgagcggccctctggaatccctgagcgattctctgggtccacctcagggaacacaaccgccctgaccattagca

SEQ ID NO: 325 - DNA, 451 bp, Homo sapiens
atggcctggactcctctccttctccttctccccatgtacctcctcacttgctgcccaggttaatagagatttcaaataccagcctttggagggattcctgtgtctccctttctaattcccaacatgtgtctgttttttgtttcagggtcaaattctcaggctgtgatgactcaggaaccctcactgactgtgtccccaggagggacagtcactctcacctatggctccagcactggagcagtcaatgggggtcattatccttactggttccagcagaagcttggccaagcccccaggacactgatttatcatgcaagcaacaaacactcctggacccctgcccagttctcaggctcagtccttgggagcaaagctgcccagacactcttgggtgtgcagcccgagaggtgaagctgagtactactgcttactgcaccatagtcgtgcttgg

SEQ ID NO: 326 - DNA, 304 bp, Homo sapiens
ccagcctgtgctgactcagtcacccactgcatctgcctccctgtgggagcctcggtcaagcttacctccactctgagcagcaaatacagcacctacattattgagtggcatcagcagtagccagggaaggtcccttggtacttgatgtatgttaccagtgatggaagccacaaaaatgggatccccagttacagttctcaggatccagctatggggctgatcggtaggtcaccatctccaacatccagtttgaggatgaagctgattgtatctgtggtgcagatcatagcattggtgtgacata

SEQ ID NO: 327 - DNA, 494 bp, Homo sapiens
atggcctggtcccatttcctgctcaccccctttattcactgcacaggtgactggacatggggccacggaaggggccctggggagcccatggagagctgctttctcctcttatttatagacccagaatcaccatgtctgtgtctttcccactttcagggccttgggtcccatctgcgctgattcagtcaccctcagtccctggggctctgggccagagggtcaccatctcctgcactggaagcagctccactttggttattggtgtgatatacactggttccagcagctccaaggaatgacccccaaactcctcatctataaaaacaattggtgacacctgtgggtccctgacaattctctggcttcaagtctggcaactccattttcgtgaccatcactgtgctacagcctgaagatgaggctgattatcactgccaattctacaaaaacagcctgagtgctttcacagtgctccgggttgaagtaagtcagac

SEQ ID NO: 328 - DNA, 249 bp, Homo sapiens
ggaccgggatcctgactgctctgactcagtctccgtctacctcatggacacctggcagtcggtcatcatcggttttgctgaatcagcagcaacattgggggtaacaattgtgtctcctggttccaccagagacagagtagagacccacacagctgaagtgtggggtcaaatattaaaactaagagacataagattgattctcaggctccaagtctgacaagtgagcttctttgagactccctgggatcc

SEQ ID NO: 329 - DNA, 244 bp, Homo sapiens
cctatgagctgacacagtcaccctcagcgtcagtggccccaggacagatgaccaggatcacctgtggggaaagcagtattggaagtaaaagtgctcaatggtaccagcagaagccagccaggcccgtgtgtgggtcatctatggggatagcgggcggccttcagggatctctgagagattctctggctccaacttggggaacgtggccaccctgaccatcaacaggacccagggtggggacaag

SEQ ID NO: 330 - DNA, 325 bp, Homo sapiens
cccaggcagggcagactcagcagctctctgtatccaagggcttgggatagacaaccacactcacctgcactggggacagcaacaatgttggcaaagatggagctgtctggccgcagcagcaccagggccatgcccccaaacacctgatcaacaggaaaaacagccaactctcagggatctcagagagattccctggctcccggttaggaacatggcatctctgaccatctctggcctccagaccaaggacaagcctgcctattactgctcagcctgggacagcagcctcagtgctcacacagcgcctcaggggaagtgagacgaa

SEQ ID NO: 331 - DNA, 515 bp, Homo sapiens
aagctctgcttcagctgtgagcacagaaggcaggactcgggacaatcttcatcatgacctgctcccctctcctcctcacccttctcattcactgcacaggtgcccagacacagggtcaggggaggggtccaggaagcccatgaggccctgctttctccttctctctctagaccaagaatcaccgtgtctgtgtctctcctgcttccacggtcctgggcccagtctgtgttgacgcagccgccttcagtgtctgcggccccaggacagaaggtcaccatctcctgctctggaagcagctccgacatggggaattatgcggtatcctggtaccagcagctcccaggaacagcccccaaactcctcatctatgaaaataataagcgaccctcagggattcctgaccgattctctggctccaagtctggcacctcagccaccctgggcatcactggcctctggcctgaggactaggccgattattactgcttagcatgggataccagcctgagagcttg

SEQ ID NO: 332 - DNA, 514 bp, Homo sapiens
catggcctggcccctcttttccttggtctcctgactcactgcccaggtgctgcccccagggtctcacccacctgcccagccccaggcctccaggttcagcctggccatcagtctgagctcagcagggccctgtgtgtggtgggcaggatgctcgtgaccctgctgcagggggaggggctggttgggctgaaatgcccccactctgtgctcctgtgctcatgggtgccctgagagctcttttattcctggggctcactccagccctggcaagtagcaagatatcctggggttgagcctctcagtttcaaattttttatctcccctttccttcttgcaggctctgtcacctcctgtgagctgacacagccaccctcagtgtcagtagctccaggacagatgactaggatcacctgtggggaaaacagtattggaagtaaaagtgcttaatggtaccagcagaagccaggacaggcccctgtgtgggtcatctatggggatagcaggcggccttcag

SEQ ID NO: 333 - DNA, 550 bp, Homo sapiens
atggtctggtttcctctcctcctcactctccttgcacactgcacaggtgactagatataaggccatggctaaagccctaggaagcccatgggccctgctttctccttttgtctctcaacccagaatcaccatgactgtttctctcccacttccaggatcctgggctcagtctgtgctgactcagccaccctcagtgtcttgggccacaaggcagaggctcactgtctcctgcactggaagcagctccaacactgggactggctataacgtaaactgttggcagtagctcccaagaactgaccccaaactcctcaggcatggtgataagaattgggcctcctgggtatctgaccaattctctggttccaagtctggcagcttggcctccctgggcaccactgggctctgggctgaggacaagactgattatcactgccagtcccgtgacatctgctgagtgcttgtacagtgctccaggcttgcaggggagtgagacaagaacccccttcctcctttcccaggagggtgagtgcccagcagctactgcaca

SEQ ID NO: 334 - DNA, 460 bp, Homo sapiens
tcaccctttgtcctgattcctcacccacgatcatctttgcttgcaggttccctctctcagcctttgcttattcagctgccctccctctctgcacatctgagaaatgctataagacttccctgtaccccaagtagtggctgcattgttggaggctgtcacatattcttgtaccagcagaagtcacggagccttccccagtatctcctgagatactactcagactcaagtaagcaccaggactctggggtccccagtcacttctgtgaatccaaagatccctcgggcaatgtgcagggattctgcacatttctgagcagcctgagatcaagtccgactattactattttacatatcacagcaacagtggcactttcactgtgctccagacttacggggaagtgagattagaacctcccctgcattctctctgccttgtgcaggcaacaatacactgtctggg

SEQ ID NO: 335 - DNA, 494 bp, Homo sapiens
atggcctgaatccctctgctgctcaccctcctcagtctctgcacaggaggctggagatagaaaggcagggactggcactgggaggaccagggctctgccttgctcccccggctcaccgagccacttcccacaccctgtgtctctgtcctgactcttagggtcctgggcagtcagggctcacttggtggcctgcacagtttgtctgtgactaaaccagccaccatctcctgcactggaaacagcagcaataacgtccttggaattgtgtcctggtaccaacaatgaacaggaagtgtccttaaacctctgatctgtggatgtaaatatccacctgcagatccagaactgattcttgagtgatcagtctggcaaggaggccttcctgagcatatctgggctccaggctgaggacaaggctgatcactaacgttggatttggacagttctctggaggcccccacggtgctgcagtctgtggggaagtgagatgggaa

SEQ ID NO: 336 - DNA, 451 bp, Homo sapiens
ccgtggcctggacccctcccttgctcaccctcctccgtctctgtgctgcctcccagggctcagcccccaaaggaccagagatcagactggccctgagcttcagctcagcacagggagtgatgcagagtgtggggctctgggaatgaccctcatcctcataattaactctcctgtcctctcttgtaggctctgtggcctcctccatgctgactcaggagccagtagggtctgtggccctgggacagtcagccagggtaacctgccagggagaaaacctaagaagccatggtacaaactggcaccagcagaagccaggctaggctcctgtgcaggtcatacatcgacaaaataaccagccctcagggctcccagaccaattctctggctccaagtcaggaacacagccaccctgaccatcactggggctcaggttgaacatgaagctgactat

SEQ ID NO: 337 - DNA, 721 bp, Homo sapiens
tgttgggggcagcactttctcactcatccagaaagtgtgaggaatctgtacagaactggggacagggcccatttttatacccttctataagcccagcccttgtctgctcactagggagccattcaccaaggccacaggagggaaggaagtagatttgcatgaagagcatccccttcctatgttaagagaggcctggaggccccttcccagctgtggactcagaggcagagctctggggcatctccaccatggcctggacccctcccctgctcaccctcctcactctctgcacaggtgctgcctcctagggctcagcccccacaggaccaagaatcagcctggccctgacattcagctcagcacagggagtaatgcagggtgtggggctctggaaatgagacccttatcttcagactcacctcttctctcttctcttgcaggctccgtggtttcctctgagctgagtcaggagcctgcagtgtctgtggccttgggatagacagccaggatcacctgccagggagacagcatagaagactccgttgtaaactggtacaagcagaagccaagccaggcccctgggctggtcatctaacttaacagtgtccagtcttcagggattcctaagaaattctctggctccagctcagggaacatggccaccctgaccatcactgggattcaggttgaagacaaggctgactattactgtcagtcatgg

SEQ ID NO: 338 - DNA, 487 bp, Homo sapiens
atggcctggacccctctcgtgcttgtcctcactccctgcacatgtagggaaaaggcctagagacctggggcagttcccagcttgtgtcagcccctctggctcagacttgccaacagcttaaccctgacacctgctccaacaatgtaaatgtttgcatttccaggttccctcttccaggctgggctgacccaggtgtcctcactcccagcatcttcatgcagatcaaacactcacctgcactcagagcatatcggctttcatatcggtggcaaaaataccttcttttccctacagaatccagggagccctccaactatgttctgagattatgctcaggctaaaatgagtaccaggcctctggggtccccagacaattctctgggttgagaggctcctccagagtctcaagttatttggtcgtctctggccttcaccttgaggatggagcagatcatctctctcagatgggctgacagggcatggctta

SEQ ID NO: 339 - DNA, 229 bp, Homo sapiens
ctctgagctgactcagctgcctgcagtgtctgtggctttgggacgtacggccaggatcatctgccagggagatagcataggtgactctgatacaaactcgtaccagcagaagccaggtcaggtccctgtgctggtaatttatggtgacagcaaccagccctcagtgattcctgagcaattttctgactgcatatcagaggacatggccaccttgattattaatggggca

SEQ ID NO: 340 - DNA, 248 bp, Homo sapiens
acaaggccacactggtgtgtctcatgagtgacttctacccgagagccatgacagtggcctggaagatagatggcatcaccatcacccagggtgtggagaccaccacaccctccaaacagagcaacaagtatgcggccagcagctacctaagactggcacccgacagtggaagtcccacaacctctacagctgccaggtcacgcatgaaaggaacactgtggagaagacagtggcccctgcagaatgtt

SEQ ID NO: 341 - DNA, 293 bp, Homo sapiens
gccacccccttggtcactctgttcccgccctcctctgaggagctccaagccaacaaggccatgctggtgtgtctcataaatgacttctacccaggagccatagaaggaaaatggcaccctagtcaccaagggcatagagacaaccacaccctccacacagagcaacaacaactatgcggccagcagctacctgagcctgacgcccgagcagtggaagtcccacagaagctacagctgccaggtcacgcacaaagaaagtaccatggagaagacaatggcccatgcagaatgtt

SEQ ID NO: 342 - DNA, 151 bp, Homo sapiens
gtgtcctggtatcagcagtgcccccaaactcctcatctatgacagcagtcattggtctgcacaggtcccagcgaagttctcaggtcccaggttggggatcatggcatccctgagcatctctgggctccaggcagagaatgaggctgattct

SEQ ID NO: 343 - DNA, 462 bp, Homo sapiens
atggccttgaccccactcctcctcctcattgtcctccttcactgcacagtccaggacggcacaaagcatcctgatcccccagctcactgacaccacctcccaactcatgccagaactgtccttccctgttctgctttattcagtgtataatggctgtctgtgttttcgggatccctctggcagcccgtgccgactcagtcgacctctgcatctgcctccctgggagccctggccaagctcgcccacactcagcagtcagcatagcagctatgccattgaatgctttcggcagcagccagggaaggcccatcagtacctgatggagcttaagagtgatggaagccacaccaagggggctgggattcccagtcactagttctcagtctccaggactggagctgaccactatagtgtcatttctacaatcccgtctgaggatggagctgactatatctgtggtac

SEQ ID NO: 344 - DNA, 271 bp, Homo sapiens
cctctgagcggactcagttgcctgcagcgtctgtggctttgggacagagggccaggatcacctaccagggagacagcatagaatacttttatgcaaacttttgtaccagcagaagctaggacaggtccctgtgctggtaatctatggtgacagcaactggcactcagtgattcctgaacaactctctgactccatatcagagaacatggccaccctgataatcaatgggccccaggctggaaacaaggctattactgtcaatcatgagaca

SEQ ID NO: 345 - DNA, 316 bp, Homo sapiens
gccagcccaaggccaccccctcggtcactctgttcccgtcctcctctgaggagctccaagccaaaaggccacactgctgtgtctcatgagtggcttctacccgggagctgtgacggtggcctggaaggcaaacagcacccctgtcacccagggtatggaagtcaccaaggcctccaaacagagcaacaagtacacagccagaagcgacctgagcctgacaccccatcaatggaggtcccgcagcagctacagctgccgggtcacacacaaagagagcgctgtggagaagacagtggcccctgaagaatgttcttag

SEQ ID NO: 346 - DNA, 483 bp, Homo sapiens
atggcctggacccctctgctcctcatgttcctctctcattgctcaggtgagaactggttttaggtgtctagggttagctccttagcttgcgtcagcctctctggctcagatccccaagacatgtatctctagttcctgccccagcccccatgagtgtctgtgcttgcaggttccctctcccagcctgtgctgactcagatgacctcactctctgcatctccgggagcatgagccagacttacctgcaccctgagcagtggcttcagagttggtaactttgcaatatagtggtcagctgaagccaggcagccgtcccaggtgtctcctgagatactactcagactcaaatatcactcagcaccctggggttcccatccacttctctggatccaatgatacattagccaatgcagggattctgtacattcctgggctgaagcctgagggtgaggctattactgttgtacgtgtcacagcagctcc

SEQ ID NO: 347 - DNA, 493 bp, Homo sapiens
atggcctgcaccccctcctcctcaccctcctcagtcgcggcacaggtggctggagacagggagtcagggactggcactggcaggaccagggctctgctttgctcccctggctcactgagctgcctccctcaccctgtgtctctctcccgactctcagggtcccgggcaatcatggctcatcaggtaacctgcaccgtctgtctgtggctaaaccagccaccatctcctgaactggaagcagcagcaataaggttcttggaattgtgacctggtgccaacaatgaccaggaagtgcctccaagcttctgactcatagaagtaaatatctgcccgcagggattcaggacagacgctcaggctaccagtcttgcatgaagcccttcctaagcatctctgggctttaggctgaggacaaggctgatcactcctgttggcttcagacagccccctggaggtccaaacagtgctgcagtctgggaaagtgagatgagaa

SEQ ID NO: 348 - DNA, 130 bp, Homo sapiens
catgatttatagtgtcagtattcaggcctcaggggtccctgatggcttctctggctccaagtctggaaacacagcctccatgaccatctctgggttccaggctgaggatgaggctgattattactgcaac

SEQ ID NO: 349 - DNA, 250 bp, Homo sapiens
gcaccctgagcagtggctgcagtgttgacatttatctcatatcccgctgtcagcaaaagccagtgagcccttcccagtatctcctgatctacctctcaaaagtcaagtaaaactagggctctggagtctccagctgcttctctaaatccaaagatgccttggccagtgcaggcaatttgctcatctctggggtccagccagaggacaagactatctgttctatctattactgtcagacctgggatattga

SEQ ID NO: 350 - DNA, 450 bp, Homo sapiens
atgtatgggtctccactgtggtctctcccccgccttctccttcactgcacaggtggctagggctcagtgtcagggctggtgatcaaaagaccaaggtttatgcatgtgtctctgtccactgacccacctctcaccctgtgtctgtcttaatgtccagcgtcctgagcccagcctgtgctgacccagccacctgcagtgcatgcatctgtggggcaggtgggtaccagctcctgcactagaagcagcagcaatgttgggcacgggcatgtgctctggtacaaacatgcctccgagagacccagagctccacatatataaaagcagtcattgacccttaggggcataggcccaatgctgaggctccaggttggagaacatggcctctctgagcatctctggactccaggcagaggaaaaggctgatttttattctcagcttgggacacaagc

SEQ ID NO: 351 - DNA, 97344 bp, Homo sapiens
agaacatttctttttcacttcccctttcagactccagaatttgtttgccctctagggtagaatccgccaagctttgagagaaggctgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctgggtgagtcagggcccccaggagggagagaggaacgggaacctcagttggggataaccctgggcaaggatgaggggtggcatgggaagaccgtcaggacacccaggggagggaaggcaggctggtgaagatgaaaccctgatgactctgctggctttggaaagtcatccaatgtggcagagttcagggttttttcagtgtctttcacccaatcttactgaacacccagactcttgatgttctgttgctttccacatcagaacccgctctgagaaaagtctagtaacctatacttgaatgataaatgaatggccagagtgtttgccttctttgaaatttatgcttcacaaaagaccaaatcttaggcaggagggccagtgctgccttgggtaaggggtagggaggaagttgtaagatgcatttttgggaggaggtggcggtggccattctctgtgcccctgaaaccactttgtgtagcagaagcctattgtcttcatgtgtaagaatattcccctaggcagaagcacagggagatctgggttatccagggaaaagggactctgagaatacaaaaacctgggtaagtctggagtcatctgttgtgggaccagagaaatcatgcatgctgcttttgaccacacagaccatgatggggaagtactgcatctgatcagcaagagagacagggtctttggccaaaatggagggctcttttctaaccatgttctcagctgttggataggggacgacgactgattttgctgagtggtttgaaaagcctaggggaggccaagtaggggagacttactgccaggactatctctccaagctcagttcctggggcttccaccctcacattctagaggaaagcatattgccactcagccaagttgtgtgatgtgattactagtgaaacgtgatcagctctgggggccctcggctcttggctgtcaatgcaggatgatactgggctacaggagaaagaggtaaggaagacagagtattcccccatgaataggatggaatggattaaagtagaagagaaagtgaagtgaactacctcatttgtcatgtggggaagttcaggcctagagaggtgatgtgcttctctaccacctgggcaagactcctgggaaagatctttggtattttttcccatttgccttttactaagtcatcaaagatttaccccattttttccattcttattggggctgccacatttacgtcttcatcacttgataactcaatttttatagcaccctctgatggggtcttgattgatcctgtctcccctcccctgcatccatgctgcccaccaaggccacggcatcttcaggtccagctatggctgtgtcagtgcatttaataaatgccttccgtgctgctccattgcccactgcaaaaactctaattctgccctgcacactgtgttctccattgcaccccacatgaatcttcttctacagccaggcagtatgtacactgcactttctgtttttaccacctttgctcctgctgactctccaaattctatgtgcaggcactgttctaggacttggagacttatcagtgaacatgactgacagccttcctgaccggaaatacgaggtcaatgaacttattgtgaagcaataagtacaccgggtgggaggatatttggtatttactactatttattaactgtggaatggatacataattggtgacttctctctcctttcctcatcttttccttttttttctctcgctcttcctcttcttttttactctctctcccactacaccgtcccccttgccaatcctacatactcaggtttttagctaccacttctatgtcaataactcctaaacctatttctcttgcttgcttctgtcaagtataattttatatttccactgctggttggacacctctaaaatgattctccagctcaaaaacaaagcatattcaaaatgcaacttatcatctcctccttacaaatgttctcttcctcctaacatttgtatttgcgtaagcgcagccacccttttcctagttatccaacttaaatcacccccacagtctattaaatgccaacttctctctgccacttaaatttcttctgcatctgtttcctcttcttcacctcctattgtcagtacaactttgggctctcttatctcccacctagattcaaccagtgaatgatttccagagcaatggcacatcaaattaatatggctactgctctctttgaatttatattctactgagggatataaacggtaagtaaacaaacaagaaggcataagtacaaatggaaaagggctatgaagatgtaaacggggtactgtgataagattagttgtggggaagagaagagagcagcccactttaaacaggatgttatgtaaagagttttctgagggggtgacatttaagctgagactttcaacatggtaaggattcagccatttggtgatcaaggacgcatttcagggtagagggattggcatacagaaaatccccaaatttgaagaatgccaggaaggccagtgttaatgaggctcaatgagtaggtgaaaagggatctgagctgaggctggagaaggaagcacggacccaatttgatagggcttgcaggccatttccattttattttaagaccaaagaaaggcaactgaaggcttgtaagttggggagtgatatcatctgatttcgttttttttttttttttaaggaactagcttctttatggaaaatggattgtagggtgaccataagaagtgaggggacaaattaagatatgggaaaaagctgatggtgacttaaactgagtagtgtctataaagggggtgaagagaagttagtgggtgcaagatctaagttggaagcaggatcaacaagacttcctggtgtggaagggactggattttgggagacagagaggttaaaagatggcttgcaggtttctggcctatgtagctgggtggataacgaagatacatattgacatggggaagacggagagaaacagaatgtgtccacttgctatgacaacatgaagccattggtgattttgacaagaaaagttttagtggactgctgagggccgagtccaaattgcagagaattagacagtgaatgagaggagaagaaatcaggacagcctatgtaagaaaaacaatggagaaatttagttttgaaagggatgagacaggccaggcacagtggctcatgcctgtaatcccaacacttggagaggccgaggtgggtggatcacttaaggtcaggagttcaagaccagcttggccaacatggtgaaacaccatctctactaaaaatacaaaaattagccggatgtggtggtaatacaaaagttagccgggcgtggtggtgcatgcctgtaatcccagctgcttgggaagctgaggcaggagaattgcttgaatctgggaggcggaggtcgtagtgcactgagatggtgccgctgcactccagcctgggtgaagcaaacaacaacaacaacaaaaaccgagagaaatggggcagtagctggaattatatgtggtgtcaaggaaaagtttttttttgttttttgtttttaatggaagatactgaaataaatttaccattgatgggaagatccagctaagagagaaactggtgatgcagaggagaaagtgaataacagaaagggaaatctttgagaggattaaagggaatgggatccagagtacttgctttgagactgaccatagacaggaggagagatgctttctccagtgaaatgcgaggaaggagaagacaggtagagatgcagaaaagactggtagatttagtcgggggacgatgtgagatcttctgtgtaacctcttttgttttctctgtgaaatatgaggaaaggcatcagctaaaaatgagagaggactggaggcagagggtgggatgagaaagcttggggaatgaggaaaagatgagtgtcactactcagagtagcagagcaaatttcttggaaaaaagtgccacaatggcagttcagtgtccttttaaatgcggtgatcgcacatttactgcgtcaacagtttgccttcttgtgtggtaatttcaataacacgcagctgagcaagtaaaggcatggcgaatacaggtgcatttggtagagatagagaaaggcaacgaagttaaggggatttgcaaggaggtaattataatgatgcctcattgaattcaagctagatgggggagggtgggaggtaaaggcaaacatgtgctcaaggataggcagtggtaagatggatgctttggggttcttgataaggtcaaagattattctggtggctgtacttgagcagagaaagttcatctccaaagaaagaaagtttactgatgatgagcagttcagggaatgaagaggccagttgtttgatgggttatccacatattctggatcactacagtcatctcttttttttttctttttctttttctctgacctcattcttccatcacaattagtttctttcttaattaagctctttggcatttgccctgttccaatctatttgacactgcactttcagccccaatttgaaaattctaagtgacttcccactgtatactgaaccaaggagtgaacttataaaaaaaaacttaaatttatttgaaattcaccatgtgtcatgtagcacactaaatgccttctctggattatctcatttaatcctaacaaccaccctatgaggtagatactgctgtcattatcttcatttacaagcaaggaaactgaagcagagaaaagttaagtaatttgtgaaaggtcacttagcagtagcggagtcagcatttaaactcagtatgtgctttcccccactgccacaccacctggcactaggagccctccagagtatgacttctactttgctttcctgctttgtccctcattattggaagtgcttgaggagagaccagaaatcaagtagaagttgggctgcaacttgctgggaatgttgccaagtacttgctgctccttcccatggaataccttttccctctcagccaaaatcctatcagtcctggaaggtccttgatgaacctgaaaggtcccatcttctccataggattcccctccttatgaaccccaaaccctcccaaacacagagccctgggatcttttctttctctgaacctccatagcattttatccaaattcctctaatgtcatctcttttacatcagattacacatgtgcttatctccaccgttagattcttgccttcagtggaagtagggacttaacgttcttttcccttaggtgaactcagcatgcattgcagggcagtaggaagccaatgcaggtttgttgattaattttggatgcaaaggaaggaagtgattggtccaagtgtatatttcgagatattggagcatcgggaccagaatccagttctgtaaactttgaagccaacactttctccacattgccccctttttacctcttggttctgattccatttccttccgtacttttgtccctgaaaatatacatgcacttggaagcttcttgactttctctcagcccagatgcaagagaaaaccttcacccatggacagatggacacacacacacatacacacacacacacacacagagctctgattcacctaaggacccagctttgcttctttacccaataacagcacccacaaatctttatctaccctagcccacactttgcctccactacggaagctcttttcttaacccagtggcatccccctacccctgcatgaagtcacagatctagtgcccttttgcagtctcttcctccttttatcagatatttctaatagcaaaaatctggaagacctaaatgccaagcaaaagagttgttaaataaatcacaggacagccaaatagtaggatatagtgtagccatttaaaatgacaacatgggcggggaacggtggctcacacctgtaatcccagaattttgggaggctgaggtgggtagatcacttgaggtcaggagttccagaccagcctggccaacatggtgaaaccccttctctactaaaaatacaaaacttagctgggtgtggtggcgcgggcctgtaatcccagctcttgggaggctgaggcaggtgaatcacttgaacctaggaggcggaggttgcagtgagccaagatcgcgttattgcactccagcctggtgacagagtgagaccctgtccccccacaaaatgaaataaaataaaataaaatgacaacatagaaacagattcatcttctagaacttgcattgctcagtgaaaaatcaggttaaagaacagtttttagagtatatcctcatttacacttatgtatgtctgtatgtgaacagcgtgtgtctgtgtgtgatcacagaaagaaatccaacaggatgtatgccaaggtgataatattttgctcctgcgtattttctatttttctgtagtgatcatggattacctgtgcaatttctaccccctcccaacaaaagaacaaatcttgctctcaggataaactctggcaaaattatttatactgatgcataaatcatatgtaaagcccaacagagacctctttccagaggcatatttattttaatcagtcaagaggggtaagccaaaggaaaatgccacaaaacaggtggaagagggtgttatatacttttatttcatttttgtatgttactgggagttctcagtccttttaaaagtgcagctcatccaggcagtcccaggggatatggccacgagggctgtgctgtaggtgaagggcgctctgggcctgggcagtctctgggccaaagtgggcaggtgtcagttcagacactccactgtgggctgatctttgctttctgtcttacagctcctgttgctgggacacctggtaagtactccacccacagcctttccttccctcgggtccccttttcctctcctcccagtgccctgtctggaggtgctctaaatgcaccagcaactgagcccagtaccaagtcagggccaggaaagggtaattgctcccgaaagatcccctctccctcttccactctcctccttccttttcctccttccacggaggcaagtggtaggcagccacggtgttcaaatgggggagctgtcacagaaaatgagaactctgatctctctctcaactgccttccgctgtccaaataaaaccaagggcttcctctctccaaataaaattcaggcacatgcaaaatcacatggcctgcatatgttgtccccctgtgttgctaaatccttgactgtgcatgtttctgagagctccaaggcctgttccctgacagagtggtctctgcatacctctggctacactttgccgggcacttctgtgtttgtgccactcagcctccaccgctccaggactggccctccggcttttctccctctctctttatccttctgaggccagagaggctcgtgtatgcttgggtgtgaggacgggccatcttgacctcgtttttaaagtatacagaatgacattaggtcagaacggaaacctgatatccaactcccatgcctgccatctccaccagagcccccacttatcttcagccagccccaggggaaatttatccactagtgtccaaatgcctttgtttatcggggagaaaagttagtctcgaaagagtatgtatgtatggggtgtctgtgtgtctgtgctggtggggagaggttggtggggagagagagaaggaactggtgaagatatctcaggtaaagtatatgtatttcgagggtgtttctcttgcctgctccctccttcttccctgttgccctgtctgagtcctgggttccctggggcccttgtggtgggatgtatgagcaaaagcaactgccttcagttgcagaaccattctgggcctggctcagcttttggtgcccccagtaggcctacaggtgcttttttgtctgagattcagggcctctcaggctcttgggcttcctcttcctcacactacctcctctctctgcccctcagcagctcccccaaaggctgtgctgaaactcgagccctagtggatcaacgtgctccaagaggactctgtgactctgacatgccgggggactcacagccctgagagcgactccattccgtggttccacaatgggaatctcattcccacccacacgcagcccagctacaggttcaaggccaacaacaatgacagcggggagtacacgtgccagactggccagaccagcctcagcgaccctgtgcatctgactgtgctttctggtcagtggaggaaggccccagggtggacctgggagggccaggatggatgaaatctgctttcaggcagaggtttgcaggaaaggagggtggcctgcttactgggaagtatcgctgtgagttgcctcagcacatgtcagtggttgctttgcctcagtcctgattgaacagaagaagattacaaggccaaaaacaggcagccaagtgtgagagaagcagaaggaaatccctactgcataaaatccatttccattttaatggcagaattgaaaagcacagaccacaactgaatcctagccctggaaatgactcactatacaacatgatgaattcatttaacccttgagtttccatttcttcacctgctccgtggggcactaacgcctccctcagaggcttctggtgagaatcagtgtttccctgcccccgccccgccctccatgccccttctccacgttctcactgtgctaggtgctcttctctgtctttctcttccaccagcctgtgggaaacctgagatgaaagtcgtgtcttacccatctttgtatttccagcatctgaaactgggcagagcttaataaatattttgctggagaggttgatgatcttacaaagctcccattgaaaggtggctctctgtaaagcaaagttacaatgagattgtgatgaacattgtccttgtggcttttcacttagtcccctcccttcacctgaagagcaaattttcctcaaaagtacacagcaaacaaatgacccactggtgacactgctgcctttagaccctgctggaaagaatctccacatttattaacattcccaaagtaaatttatcaggtagcattcatcaggtaacatttgttgcacattcatgacttttctactgtccacaaaggcatatgtccttatcatatgcagactccttggccacactggattcctccttccctcctcgacatggaagagatggcatcttagggtctcttgtgttcttcctgaagaggcctgtcgggcaggaaaaggctgcagctgccttcctgggagaaggaggagatgagtgtatcctgaacacctattatgtgctaggggctattgtagatacatgacattatcatgctcattttcacaaatgaggaaactgaggctcagaagacttaaattatttgcccaagagttcataaatgatagagccagcattagagtccaggactgtctgatttcagacctaagctgttccctctgcacatcatgtcccaccagtaaggaagatctgggtctcagagctgagccaagacctcccgggtcctctggggttttctgtgtctttcagagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaaggtatgaggagtctgccaagatgtagggaggggagaagaggggatggacaagggctgaggtcacatgggcctacatggaggtctgagaaaggccacagcacaaaattgggcactggagcaaagaggagtggtgtggaggcctggctaagtattgaccaatgagcaggagtaggggccagagcttggagccctcaggtgataggtgaccaggctgttgttccactttgaaatgcaggccccagactaaggacggcagcgaagcagagctccctcgttggtgcagaggttccctaagctcctgggcattcgtaagaactgaggtttgcctttattcttctcatggctcatgttatagccattcactccagaaagcctggcacgtcatggactgttcaaggctgtgctccatagagtaatgatgcctccagctatgcgaggctttgggcccacccttcccactgcccctgagggctaaggggagcccttccttctgctcctgcctgctcaccagtgtgcctttattagttcggtggagaaacctcggtaggcaggaggcataagtccagccacagaaaccctgtgcagatgaggctggggatgtagtgagtgctgcagaagtgagtgactcagacacagaagagcttcgggtgacaagcactaggacatagcattggatgggggggaggtgggacaaggagagtactgcctgtcctgatgtctgtcttccctagctcccagctcttcaccgatggggatcattgtggctgtggtcactgggattgctgtagcggccattgttgctgctgtagtggccttgatctactgcaggaaaaagcggatttcaggtttgtagctcctcccggtccctttggttatcagtttccacttggcccaggccctaaccccagacattgccagaatccctctctttgggctagatacacattcagatctaggcccgtattgtattatagtcattcattcgtttattagatcattcatttgacaagacttgaacaaactagcttatgtgtcagccaatgcgtgagacatggtgggtgatgccaagagaagtccagtccctgcccttggggagttctcagcattgtgaggaagacagggtcattataataagatgggataagagcaatgatagggacatgaaaagcctaggatagaagtacagaggaggctccatagcccaacaagggctgacgcagttggagaagttctcagggagagcagtgtagtgtagtgatggagtgcacatagtggggccagactgcctgggttcaaatctagttctacagcataccaactatatgacccaagtgagtcactccacctctctgtgcctcagctgtctcatgtggaaaatggggacactaacaggacttacctcacagggttgccatggggatgaaagaggctgatgctcttacacagtgcctggtaggcagtaacagcacacaaacagggctgttgccattctggaggaggtggtgtgtgagggcagcgcttagctagggaaggaggaccctccaggcactgggccaaggcagggattgaagccgggtggggctcatatgggtgtcgaagggggagaagagagggtactgcaagccaccaagaaagaaagaatcccgctaacacctcacaaagcacttttcaattggttcatagccaacacctcagttactgatgataagtaaatacagagaaacagagagagagagactgagacacaggggtgtttttaaaaggcagagcaagcctcagacagatgccatggcgtggcctttctgacactcctgggcatccccatgggtgagctgaattctgcctctggactagcccttttccaggcgggagcggcccctgagcaggggagctgggggtgggaggacaggaaacatctgccagagggaaggcctgagctggtcccatccaaccctggccctggtccttggtcctgaggactcaggccccaccgcctaatcctactaacctcctgtgtgcccctcccagctctctcaggataccctgagtgcagggaaatgggagagaccctccctgagaaaccaggtgagtacaggttgtctcagggattcagtgatggctcaccagggctgccggctggactgcagccagcgagaaggggcttgtgcgagttcagctgggagccagggagggagcagcggtgggaggatggccggggctcaaatcgcttggttagctctgagtctaactcctgggcctaaagatgacctctctggagatgagaagagaaacaccagtcccagatacagaggagagggctgtgtccgaatttctggtaccaggaatctgatgatatttccagagcaagaaatcagagatactttggtctttctgtggagctttggcagagctggcagaggatggggttaggggctgtaagactgaggccaatcggacgtgggaggcaggagtctaaggggaaaggaggaggaggcctggaaacccctcaatttgctgaggaatctgcctctgtggagggatggggtggagtggccaggctcagctgtctgtggaacactaagaggaggtttgggcttgagaaaattctggggggctaggggcactagtgggctctactctgtgggcaaagctcggttccaatgcccatgcactcaaggttgactgaattttggcctggttctgcccccatcacacagtggagccctgagcaagtcagtctccctgatggggttcagtctcctcactgaggaaatgagtgggtggccagggtgacctctcaggccttctaggtctgacattcaggtgggagtgtgtaaaggaacttccaggaggatgccaggtaacttccagactgtagttaaagtcagagcataaaggaaaccagagctttctccgggggtttccatgacagtaggaacaggcaggaaaaaggctgtcaaagaccccacctcagatggctggagtatgattcagagcagagccaacagatttaagagcttgagcaaaatatcacttgttcagctgtgcttgcagcaaggttgcacgtccgctggccaggcccagtggtgataggggcctgtgttcacaccagggccaaaacagatctggaaaatacaaagtccaagcaactggattatccatcttgttgtgtggttctgtctgcactggcataagcacatttcatgaggcatttttgcagccaggcattggggctgcataaatggtttcttaaaaatcctttcccaaaaggcaaagctggtttgctggaattgttggggaatgtattagaatgggaattcagaatgtggtttgctgcagaatttacagcatggcaataaaggctctctgtgttcagggggtgagagaagagactagatgcattgtgtcagatgtctcccgacttcctgagaaatgccactttgcaaatactggggctgcttttcacactggccaagtcagtttatgacaaaaacatgaggcaattaggtgtgttttggacactaaccagagaaagtccttccttccctcccttcctccctccctccttccctccctctctcccttcctgccttccttccttcccccttccctccctccctttctccctccctaagctccctccctgcctctctttttctctctcatgttactttctctttctgtcttcctttttaatgccatggagtactatattcttcaaagttccaacaaagatgcactacatttggacaatgtggaaatggccctcagccttctcttcctgatgtggtcagcaaaaatctggactttacttcactctgatgctgaacaccctgctccacatcttccccagtatctcagatccccaagctgtctggtttgcttctaggaaagctcagcaattccctgaaaagagtgtggcccaagtgactgcttccctccaccagtgtggcccgtggggaaggctgtggctgggtgaccccaagggtgggtacatgaggccatatttacttagcccttggccttacaggactgtgtcaaggggtcagtagtccttgctttgagtctggttatggttttgcagcctcagcatcagcgtgggcaggcccttttcaacagcagtgccctggctaatccttttctttttccccacagccaattccactgatcctgtgaaggctgcccaatttgagatgagtaatcccagccatctccttttcttcctgccttgtcccttctctcctgtttcctctctttttgcctttgttaatgcaaaattaaaatggagactgggcctgaaaactcctgagcaaacaaagccacccgggccttagaaatagccttatcattgcttaaactgcaaacataagtgaaactcaagttggattgtaactaaaaataggtaatacttaacttggatcatttctggtaaatatttatgttagacagaaataagatttaaccctagccaatcgtaagcagccaactaacataattatgtgactaagaacacttcaataaggtacctcacccaaaagacaattatgtaactgcaaacctatcaaatttctttattttacttccacattttcccaattaatacctgtctctgactttctgtcattaaaacattagacctcttttggtttggtgtcacccaattcatgaattgcttcttactcaaatgaactctttaaaattgtattgtgccttagatttttctttaacagtttggtgtcagaagtaggatataaagtagaatctcccccaaagatccctaagagcaatgggtgaccaggcataggtacccattaagcccattgtgttcactggtttcttcctgcatttgtgagtcactaggtaagtccctctcagatatcaggcttgcaacttgtgtcctgagctctctgagtttatttgagtaattttatttctcatttgattcagcggttaatctgggtatttgacaagttcatctgtttccaacaggaactatactaggtccagtatagtgtactagtttccagacaaggtctgatttctggattgggatccagaggtcaaattgggtacttgacagattgaactaggtgttcaacagaaactgaactgggggtccagttgcagtcctcaggtaggtaaatttcagaagggcaagatattatggctttgtcagaatgtacagagtctgggactcctccatctgaaacacagtgatttctatgttcagataatatgggcccagaacctgtgactttctagagaaataggtgtgccttacctattgagccttaccagagatgacttaaagttgcaatggtcacagtgaggatatttaaatctagaaaaaattgttcatttaagggatgtattgggaaaaaatgagatcccaaatgtctcagaaacaatgataaataattttgattggtatgtaaaggtttctaaaagaatgatttaaaaaaatagtctctctaagtaaatctttacaatgtgctaataagaaagtattctaaacctattaacctctttgattgcttgctttttccatctgaacctactcaatgctaacctccttaaaaaattagatcctcaaatgagccaggagtatctacaacaactaaatttaactcttgttattgcacacatgaactattataaaagcaaccactaaggctaaaaataataaaaactaactggaaataggccagataaactagatgtctccttagtcactcatttaaaatttaatccagtctcaataagattgactcctaataataggtgaaaatgccccaaaactccttcttggagaagcttcgtaccctttctccgggcctttgaattgtgtaaatgtttttaaaacacaagcttcagcgaaatgactcatcaaaaagaaagaaggaggaattttttagaaacaaactggcaaatgaaaaatcttaatagtcctctccacaaatatcaataaaaagtgtcagccatctgaacagctaactttaactagaggctagatccaactaattagttttatattattatacctggcacatggctaaaatttcagaacaaaagccatgaatttctgtttgcatctttctgtatgtttacatatatctacacatgtgtatgctatttgtacatattattctatctccagatggtatttattagaaacagtattaaaggagctcaactggcctagagaaaaataagcacttatataaattacatattttctcagaagaaaagaactttgccaaaatgcttttcaacttcatatgacctgagtaatcttttataaataagaatattggcattaatgaaagtgaatattctacctagttttacccaaataagctcatgttgtctgctatacaatttgtcaaaaaaataccttgagatgacaggtagttggttttgttaatattatgtttgccactttaactatgttaaatgaaatgacaggtattcattaaatatctacaccatttccagataagacaaactactaaaacaaaaataaaaaagtgttccacttatctttttctctctacctgattgtttcagaatttggaaactcttattaagtatttttattttcaatctgggtgtttgcataggttcaataagaatctattctccttatgacaggacataattgggcaagtccttggcttggcttcttagcctagagaggcttttaaaggtctaatctgagatttctcaattactagatagtttttaaaaactaaagttgactgataacaaagtcagtaaagtctcttggatatcaccaaagctgtggctaaaatatattttaaaattactgtttttattatacctatataaataatcaggtcaaaattaatgaaactagatttatttttgcaaaaaagtcaactttgatttttggtaaaaatggaaaataaaaatatttttctccagaataaaaaagattatattttagtagaaaactattgtgcatccattgtcaaattctaggcctgttcattttctttgaagttttattatctccctataaaccagattgactcctgaatttttgttttttagttccactagaaactaaaactgcccttttccaaagctctgcaaactgaaactggtgactttaagcttcagaaaaatcactgcaacagagcacttatgccttaatgccaatcttaatgcctgctgctatctgggtcactcagagagtttaccagaatgtttaatgaaataaccagagacattcaaattgcaaaccagtaaagcacatcacattgcaactgctatcttcagtctaccatttaaacttgcctcaaactcacctctagaaattgtttcacctagctgccctctaaactcaaaaactaagatcataatttgctccaaatattaactttgtttttttaatagaagaatactctgaattcctttcaagcaatacaatctaaaatgagcaagttagcctcaatagcaccccaaaatagaagttcttggtatcttaacagcttaacaaggaggagcttgtgttcctactgatgtcaaaagaaatgcttaaagatctcagttggctttatggtgattctagaactgggcaatacttgccaccttaaattagaataaggtttccaatgagttacagcagaggagattggcttcatagacagaaaaaggtctgaagaaagcagaaacaaagaatttaaagtggattggctattttaaagctggttaaagttgcaaaagacaggaatagggaaacagaataataaataactggttggttaacatcaggttactcttttgtaaggatgccaattgaaactggcctgtttggaaaattagatttttaggttattaggttattatctctctctcctgatttttccaaaggccagataagaatgtagtttctgtttggtgacttgaaactttatcgtgggtgattccattttgaattttagtctgttctgtttgggcctagtgcaggagcttagtgcaaaacaatagcctcctaaaatttaaaagactttaaagaacatacatgagtttttcatcagataatatttatttgtattcattaatttatttgattggttaagtcttggctcccgagaatctttgctcagaggaatttttcaatccttggctattattctccttatagttattgtatttacctccccggtgtattgaattatcctatgggttttaaatgctttcctgcacccacctggacgtcaaatgattgccatcagaaagagacaacctgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcacactctcagcttgctgagtggatgacaaaaagaggggaattgttaaaggaaaatttaaatggagactggaaaaattcctgagcaaacaaaaccacctggcccttagaaatagctttaactttgcttaaactacaaacacaagcaaaacttcacggggtcatactacatacaagcataagcaaaacttaacttggatgatttctggtaaatgcttatgttagaaataagacaaccccagccaatcacaagcagcctactaacatataattaggtgactagggactttctaagaagatacctacccccaaaaaacaattatgtaattgaaaacccatcgattgcctttattttgcttccacattttcccaataaatacttgcctgtgacattttgccactggaacactaaacttcatgaattgcgcctcagatttttcctttaacatcttttttttttgacagtctcaatctgttacccaggctggagtgtagtggtgctatcttggctcactgcaaacccgcctcccaggtttaagcgattctcatgcctcagcctcccagtagctgggattacaggcatgtgccgtcataaccagctaatttttgtattttttatttttttttttagtagagacggggtttcgcaatgttggccaggccgatctcgaacttctggcctctagcgatctgcccgcctcggcctcccaaagtgctgggatgaccagcatcagccccaatgcccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggtctaaattccccttgaggaagacgaagggatgctgcagttccaaaagagaaggactcttccagagtcatctacctgagtcccgatgctccctgtcctgaaaaccacagacaatatggtcccaaatgactgactgcaccttctgtgcctcagccattcttgacatcaagaatcttctgttccacatccacacagccaatacaattaatcaaaccactgttatgaaaagatgtagcaacatgagaaatgcttatgttacaggttacatgagaacaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaacattctgtttaccttttcagggctgtattgattggggtgtagactgaactatccggggtctgtttcttttcggtgatgaaagtcttgagaaggtagtaatggataagatgtgaaggagaggagagatggagatttggagtgtagggtgagtgcccctcttcttaaaactgaatactcttcttctaatgaacttgtattcttgtttccatgtcttcttgcctttccttctatggcaaataaaacactcactttgttttggaacacaagttctcagaaaggcaaactttaggtgaatcgtcagtggagactgctgacttcctgcactgctattttcccagtgcagttaccagaaggatgtgaccttctcagagaagtcattccaggcagattagaaacatgacccacagtctccttgatggtttggtgagtgcccttaaagagccttccattttcctgggacacagcatcactgtgcacaattcttgcatttgaaaagtagcagctttctctgttggatagtttacatcgatttttaaggaggctatggagcttccacccacccttccaaactctatgtattagtctgtctctatgtattagtgtgttctcatgctgctatgaagaaatacctgagactgggttattcatgaagaaaagagggttaattggctcacagttcctcatcgctggggaggcctcaggaaacttacaatcacagcagaaggcaaaggagaagcagtcaccttctgcacatgatggcaggacagagtgagtgcaagcagggaaggtgccagacacttataaaaccctaagctctcgtgagactcactcactattatgagaacagcatggggaaaccgtcgccatgacccagttacctccacctggtcccacttttgacagatggggattatgaggatgacaactcaagatgagactttgggtggagacagagccaaaccatatcaccctagacagaggctcctcaaatatgtaaagccttgttaaatcctgcttttacattaaaatgcacccaacaatctgactgcttctcagtattctactcctaccaccctggtccaagccaccatcatttctcacttggattactgcaatagcctcctgactggcctccctgcactcacccttgccatcctatagtctattctcaccacaacagctattgtgatcttttaaaaatgtgtcatatttgtcacttcttttccccaaatcatatactatcttctccttgtgcttggagtaaaggctagagcttttgcaatattctacaagatgctacaggatcttgctcttcactctctctgacctcatctcctactgctttttcttgcttgctgttggtcactcttgctcttccttgaacgtgccaattatacttctgcccagagcctatgttatttcctgtttctggaatgttctttctcatagacccacattatgcctcattatgtcctttaggtctttactcacatgtcaccttatcagtgaggtctccttgatcattcggtataacccgtcgccctcccatactcttaatgtccctttccttcttcatttttctccattgtgcttattactactgatgtactattaatatatgtttactgtttgttttgtgtctgacttccccactcctctcattagaatgcgagctccaggagaggtctttgtctgttttgttcactaccacatactcagagcccaggtcagtgtctggtgcatggtaaagggcttaataaatatgtgtggaatgagtaaattctttgacgtttgaaatcagagactttaaactggaaagtccttagaaacaatgtagtccaatctcttcattttaaaacggaggaagctgtggcccagacaggtgaaatgacttgttcaaggacaaacaggtagtggatgtcactgacctttatatatatatagtttggattatactataacttttgttctatagtgaaatggtttggctatgtccccacccaaatatcatcttgaattcccacaacacatgggagggacccagtggaaggtaactgaatcatggggcaggtctttcccatgctgttcttgtgatagtgaataagtctcatgagatctgatggttttaaaaaggggagtttccctgcacaagctctctcttctcttgtttgccaccatgtgagacatgactttcaccttttgccatgattgtgaggcctccccagccacgtggaactgtaagtccattaaacctctttcttttgtaaattgccccgtctcaggtacgtctttattagcagtgtgagaatgggctaacacatacaacttgctttttttttgtactcaatattgagtcgtgagctttgcaccactttacaatgtctatttaagtcattactttaaggtcgattctatttttaaagctactctaactaagctactaaacataagtggatatatttaagtgtatgtataaaatttatactaggccagctgcggtggctcatgcctgcaatcccaaagctgtggaaggtagaggtgggattgattgaggccacgagttcaaggctgcagtgagctgtgattgcatcactgtactccagcctgagggacagagcaggaaccagaaaaaaataaaataaaaagaaacaaacaaaaaaacccccaataaccctgcagtggctcttttacaaaaaacaaacaaacaaaaccaaaactgtactgcatgcataagctcccctatgctatgtttgaaccactctgaagagatcaattaaaaggaagtgagtgacattgggagcatgcctctgtgatgctgtggtaacattcataggctgcgttagggctatgcctgtaactcttggagatgagtgggtaagtggggttttgaggtggctgggggctggaagagaaggttggaggagcccacacaagacagtcccttaacacgccggggcacagaaccccaggctgggccaacttttccctgctgaggtgaagacccatctcttgcaggccgtcggcaaacgtcttgactctggcatccaggtgtgaccagcttagaccctgagagtgagtgaatttaaagctgacagcttctttcccttttggaattatgaaataggttacttcttttcaaggacagtttgattttccactgtggaagtcatatattgcacatttctttaaacattcccttttttcctgaactgatcaccttaccagtacagctgatctctcaagcagcaatctctaccagctgtcactggtgctctcggagagaggattaaccaagaaacccagcccaggaacagtactgacctctacttctggactcctgcctccctcttaaaaagtcccttgaacttcctagtgggttctaacctgtcaaaggagaaaatagccacctatggagtaagggtttttagtttctctttttacaaatggaagtttcctttgaatcaggcaagtaacgttaaatagaagccaacttttaagtttctccttataacacactgctaaattataacaccagactgtaccacatactctccagctgccagctattgcagttgccatccttgttactatagtggtaagtatctctgcctgtcatgcatgagagagggggtcgattccctgacggggaggttacggaaaattgtgtggggattttgtcaaccttcaaaagtctcagaaatgtctccttgttttggctttcagcggaaatccgaacgccagaagatctgaatggaatgttctggattgaagaaagtgggaaatggcctcaattcacaaagtcacagcctgatagaaaccagtgtgactttactgcccagtgaacccatctcgtcctccagcctttaggaggtaggttggactggagcctgcagtagtttactctccacctgagtcctggtctccggctgggaacccacttaggccatagagaaaaacgcacactgtgcctctccaccgggcctctggagacgaggctcctcggggatacaaacagtggggagaacatgagggacatcctgaccgtacactgcgtcctcctttcccaggtgttgcgttctctcttgggttgagtggcgaggtctctcccgagtcccagggccacagtgcaatgtcacatctcctttgtggaaagtgactggtaaaagagaacaaaactggaggaacctaaagtcttcggccacctggtttaatttattcaagagtgattaatcctagatgagaaaaagaattgaaatggatcggaaaaaaccaagcgtgcattggccggtaatcggacgcgggcctcccgcgttgcgggcgagaagtctaccactacaccaccaatgctaatgtcgatgaaagagctgcagtgtcatctcttaaagctgattatctctggccattccttaaggaaacaggcactgtcttaaatcgtggtttggaaaatattttgttcaagataaaactgttttaagatatatgtatatatatcttatatatctgtattcgcatggtaacatatcttcggccttcctgagccgctgggctctcagcggccctccaaggcagcccgcaggcccgtgctcgcctcagggatccgacctcccacagccccggggagaccttgcctctaaagttgctgcttttgcagcctctgccacaaccgcgcgtcctcagagccagccgggaggagctagaaccttccccgcgtttctttcagcagccctgagtcagaggcgggctggcctggcatagccgcccagcctctcggctcacggcccgatccgcccgaaccttctcccggggtcagcgccgcgctgcgccgcccggctgactcagcccgggcgggcgggcgggaggctctcgactgggcgggaaggtgcgggaaggttcgcggcggcggggtcggggaggtgcaaaaggatgaaaagcccgtggaagcggagctgagcagatccgagccgggctggcggcagagaaaccgcagggagagcctcactgctgagcgcccctcgacggcggagcggcagcagcctccgtggcctccagcatccgacaagaagcttcagccatgcaggccccacgggagctcgcggtgggcatcgacctgggcaccacctactcgtgcgtgggcgtgtttcagcagggccgcgtggagatcctggccaacgaccagggcaaccgcaccacgcccagctacgtggccttcaccgacaccgagcggctggtcggggacgcggccaagagccaggcggccctgaacccccacaacaccgtgttcgatgccaagcggctgatcgggcgcaagttcgcggacaccacggtgcagtcggacatgaagcactggcccttccaggtggtgagcgagggcggcaagcccaaggtgcgcgtatgctaccgcggggaggacaagacgttctaccccgaggagatctcgtccatggtgctgagcaagatgaaggagacggccgaggcgtacctgggccagcccgtgaagcacgcagtgatcaccgtgcccacctatttcagtaactcgcagcgccaggccaccaaggacgcgggggccatcgcggggctcaaggtgctgccgatcatcaatgaggccacggcagcagccatcgcctatgggctggaccggcggggcgcgggaaagcgcaacgtgctcatttttgacctgggtgggggcaccttcgatgtgtcggttctctccattgacgccggtgtctttgaggtgaaagccactgctggagatacccacctgggaggagaggacttcgacaaccggctcgtgaaccacttcatggaagaattccggcggaagcatgggaaggacctgagcgggaacaagcgtgccctgcgcaggctgcgcacagcctgtgagcgcgccaagcgcaccccgtcctccagcacccaggccaccctggagatagactccctgttcgagggcgtggacttctacaagtccatcactcgtgcccgctttgaggaactgtgctcagacctcttccgcagcaccctggagccggtggagaaggccctgcgggatgccaagctggacaaggcccagattcatgacttcgtcctggggggagggctccactcgcatccccaaggtgcagaagttgctgcaggacttcttcaacggcaaggagctgaacaagagcatcaaccctgatgaggctgtggcctatggggctgctgtgcaggcggccgtgttgatgggggacaaatgtgagaaagtgcaggatctcctgctgctggatgtggctcccctgtctctggggctggagacagcaggtggggtgatgaccacgctgatccagaggaacgccactatccccaccaagcagacccagactttcaccacctactcggacaaccagcctggggtcttcatccaggtgtatgaggttgagagggccatgaccaaggacaacaacctgctggggcgttttgaactcattggcatccctcctgccccacatggagtcccccagatagaggtgacgtttgacattgatgctaatggcatcctgagcgtgacagccactgacaggagcacaggtaaggctaacaagatcaccaatgacaagggccggctgagcaaggaggaggtggagaggatggttcatgaagccgagcagtacggggctgaggatgaggcccagagggacagagtggctgccaaaaactcgctggaggcccatgtcttccatgtgaaaggttctttgcaagaggaaagccttagggacaagattcccgaagaggacaggcgcaaagtgcaagacaagtgtcaggaagtccttgcctggctggagcacaaccagctggcagagaaggaggagtatgagcatcagaagagggagctggagcaaatctgtcgccccatcttctccaggctctatggggggcctggtgtccctgggggcagcagttgtagcgctcaagcccaccagggggaccccagcaccggccccatcattgaggaggttgattgaatggcccttcgtgataagtcagctgtgactgtcagggctatgctatgggccttctagactgtcttctatgatcctgcccttcagagatgaagggcttgggggggtcttccctccaaagctagaactttctttccaggataactgaagtcttttgactttttggggggagggcggttcatcctcttctgcttcaaataaaaagtcattaatttattaaaacttgtgtggcactttaacattgctttcacctatattttgtgtattttgttacttgtatgtatgaattttgttatgtaaaatatagttatagacctaaataaacttttaaaactccttcttgcttttcattccaaccaatcaaagtacaaaagtacataaaggctttcagaagcagaaaatgttggggtgggtgctgaaggaggaatgtgaagaatattcctgagaccgtgtgcatgattcctataggggaaggcagggtttggaaaagagtttgaggccaatacattggaacagtactgaagagttagggctggtaaagaggagaggattgagatataatgcaggaagagagagggagagatgtggaattggaaaagcagagaatgaagagaaacttaagtactggcagtgtttccatgtgtgatcctatgattcaaattctgtatttttgtcataggaacctggttgagtttgtcagtctagctgttttaataacactaacaaatagtttacatgcttattagctgtttgtaatcatgtcactttatccattgttcttttagagaaaagactctgagtcctggactctggaggatggtatatgtcagaggaagtagatctggtggtacgattaaagttactattgactttatctatgtcagagaaatagtatgatcccatgtggtttctgcccatggcataatgaggatgttggaacaagactctatagattttcagccctgccactttatatactgtgcaaattaaactctccaagcttcagtttctccttccctgcagtggggatgatgatgatgataacagtaccaacctccagactgttgtgagggttcaattaattaatatatgtaagaggcaaagaagaatgtcaggcgtataatatactatcaacaaatattagcaattactattaattgttagttgggtgataactatgtactaggtacttgacatacacaatctaacttaatcttcacagtagcattatggaatactatcttctttttgaagatgagcattatgaggttcaaagaggttaaacaatttattcaaagacacaaagctataaagtggggacaggaaggctggaatgaagaaccctgtcctgcctgagtctagagcctcagcatgccaccttacaaataggccataactccacttattaccagaccttcccctagatgttttgaaattggtcatattattcctttgaaacacagctggatgctgagccccgtgagaaaaagtgtgcattttattgtatacttgcagagacagagtcttgctctgtcgcctaagctggagtgcaaaggtgcgatctcaactcactgcaacctctgcctcccgggctcaaccaattctcctgcctcagcctcccgagtagctgggattacaggtgcctgccatcacacccagctaagttttgcatttttagtagacatggggtttcaccatgttggtcaggctggtctcagactcgtgacctcaggtgatctgcccacctcagcctcccaaagtgctaggattacaggtgtgagccaccacgcctagctagttgtgtgttttttatagcaagtgacggaatctgcaaaatatccttaggcacaactttactgccagttgagtcaatgacaatataaaagcaaggatatttgcctttgctttgttggtgtaaacaaaataatcaaaaggataaccttgtgttagttcccagtcaatccaatccagagtatatttgccctgtgcacattgggagatttattttcatctcagaaattatgggagagcttggctagaacaatgctacattatacattatatttcttaggttgattttttaaagacggagagaaggttacactaacaacgcacttgtccctggctgtcatttcacatttttaactgcccttttttcctggccctggcccaagtcttacgcagcctggcttcacatggaaggaacctgaaaaaaaaaaaaaaagagagagagatggagtgacacgtacatcctgcattacattcttcctttcctgaatctcatctcaattctcaacattgacccccctcaacctgtttgaacttctcaagaggattgatggtactcacttttatatagtttcttagtattttgatagcatgccttttctccttttaaaaaacccaacacacacggaatataagaagaaagatttttatcgtgtttagttgtgacatctcagatcctcccatttgggtgcaatctatttttctacagagaaatataaacaaactttatttacttttaaatgtctgttgatcattttggtttagtttctttggggactgtttcttgtatactaggtatctaaaaatccttatattgtatgtagtcttagtttgattattgtaatcacaactatgtcacccagttccaaagggggggaaaaagtttgaacaaattaaatcagaacacatgcccattattaaaaaaatcaattcttggtacaagcagtttcttgcccccttcccaggtcctactcctcacaggcaaccactttcaagttgttggttttttaaaagaatttttgattttgcaataattttagatgaacagacaagttgcaaagatactacataaagttattactctatatcctttctacttcccctaatgttaaaaccttacataaccatgttatatttatcaaacctaagaaattggcattggtataacattaatgacttttttttttttttttggacacagggtctcactctgtaccccagcctggagtgcagtggcacgatctcggctcactgcaacctctgccccctgggctcaagagattcgcctcaggctcccggagtagctgggactacaggcgcgaaccccgggtacttgggaggctgaggcacgagaaccgcgtggaccgggaagacggaggctgcagtgagccaagatcgcgccacagtactccagcctggggtacagagtgagaacctgtctcaaaaaaaaaaaaaaaaaagctggggagcggggcaaggcggtggagaatctgatccttaccaaagtttgacactactgcgttagcgttaaaaaaaaaacccagctaagactgtagagcaaattaaaggatcctgtgttgagggcgttctcttgtttagtcaaaggagatggtatctgcctgccttagtgtgcttgacgcacagaaagggctcaacacattgttgttgaataaaagaatggataaattgacactgggaagttggagtccaaagttaaacttagtctcaactgctccctgttttcatagaccagactccagcctacaatacaggaaaaatagatttagttctatatgtgcagagaagcacaaataattttcgtaaatgtagatacccaggataaaacgcagtgttgaccgatcgaaaagtctttctctaagaattcaaacataattgctggttggttcaaatcaggaggaaaagtaaggatggaaaacatacgttgtcaaaagtgggattcgaacccacgcctccagcggagggtgcgatttgaacgcagcgccttaagactgctcggccatcctgacacacgttttgctaaacttcctaatttctcctaattttatcatatactgatggtgcacgctatcaggtcacattaatgtgtctatttactgtttcaaataaaattgtaactctctctagaccttgtcgcaaagcgggaaaaatgaaacagcctccgacagctctttcctctttcctcactacccaaactaaaccttaaggctccattttccctggcgactcttcgagcgcccctctgcttctgtagaggggtcgagccatgtcaaggtagaccctgtgtcggcccgtctccctcggatcctccgcaccaatcactgttgctgaatccgacacccggcggatccagtgcggagtctcgaacagctgcggagctgggagctacgggacatgaggagtgcgggggggaagagaagacggcggaggaaaatcccccggcggtgctcaactgcggctttctctctcggctgtgagccggctccgccctccggcttccagagcaagtggcttctgcgttcaccgccccccgccgtttgtggggcggggccgattcataagaatcggttctcaccaatggagggcttagcatgtttaacctcaggatcataaacaaaagacactgctagaacggtcgggaaagtcatacgctttgcttatcttatatatagatttctaaaattccaaaccggggacgcgttggtggtgtagtggtgagcacagctgcctttcaagcagttaacgcgggttcgattcccgggtaacgaaacgtttttgtctttccttctacgaaaaacttttctgagccggagcctccagcgcgctgtgtattcgttttacgcctcaacgaaactgcagcaatacctcactttccgtactcgcttcctgtctttcccctggcctctttctaaacccaggctttttttgaagggattaaattctgatggttctttcctcccttccttcctttgtaaacttccaactcttgaggaatctttgggatcatttcaatcctgggatgagtcttagcttcagaaaggggctcttgtgtcttcacttgcgaggttcattcgctagcctctacaaatcatcacttaagcccctaattattcccggccgaggtcctaggctaaggtcccgggccaagctttctaattagtcccaggccaaggtcccaggccaacctaaatcacgcattctccaaaacagccggcaaactaagcacattccttcccgtttccagtccataaacccccccccccaagtggcctcatagtaagcaactcattcgggccccctctctgctggcaaaaagctcagatgtactggactgtgcatttgatttggaactgagttacatgggagagaagcagggattcagtttggctgggaatcaaactcttttgataatttcctaataaactgatagtcattagatgacttgtagtctcgataagttgaaactttttcctaacatgctgtttatgatactgagttctttgtcaccggttgaactaacagcaattgtattcacaaattttccagcctttaaaatactgtctgagggttttatgtatccgttatcttttattatacaaaagtcatttattggaatgacatatataattagattgaccctaaccattcaggctggatgaggcaacacagtgtgaagattaagtgcatgggctctgttgtgcttcctgtgtttgaatcttggctctctttgtctccatttcctcctgtaaaagaggataatgatgataattttaattcttcaatgggttaatatataaacatatattacaaatgtataaacattgccaggagggtccattgttaatgcctgtagtgggatgatgtttgagattttaagtctcattccctaaaatggaggtgaaattcaacagggatgggaagaaagaacatctgcacctcagccaccctttagctccaaacctcccttatgctctcatctgccccacagcctccatcctgtaacaagaggaccagctgtgccagtggaggccacagcatctagcttatgcctccaatgtaacctgttactgcccacctgttctccctgatattctctgactcttagtactaaggtcccacagaggctgcagtgcccacaggcaagaagaaccaaagggtagtactgactggtagtggctagccacagctgtgtggggccagattgacactgcgcaatcgctaagtggatcagtgttcaggctgccctgtcttgggagacatatagggacagggacctataaccaacacctgccataggctggcttcagttagcccttcacgttgggattcactgagtggtttttctggaagtggccacctagagttccctgtggccagccaaggtatgggggctggctttttgggatgtctagggaaagccaaaagcaaaacccagaagataattctttttgtggaggagttaacagatatagcactgaccaatcagaatagccactggctatacatttccccattataacaggattcactgcattccataaattttgtttttttaaatttccaaatatatgaaggcttttaaaagttattttttgttattgatttctgagttaaattccttatgttcagaaaatgtgcttcatatagtactgattccatgacatatgttgaagcttactggccttagccaggtgcggtggctcaagcctgtaatcccagcactttgagaggccgagatgggtggatcacttgagatcaggagttcaagaccagcctgaccaacatggtgaacccatctctactaaaaataaaaaataaataaatgaaaaatattagccaggtgtggtggcacacgcacctgtaatcccagctacttaggaggctgaggcaggagaatcacttgcacccaggaggcggaggttgcagtgagctgagatagtgccatcatactccagcctgggtgacagagcaagtctccatctcaaaaaaaaataaataaataaataaaagaaacttatcagcctcatataaagtcagttttcataatatcccatgtgagtttgagaagaatgtacaactaataattattgattgcagttctatatatatatatctgttaaattgagcttgttaattgcattcatatgcttaataaaagtaaataagaaaaagagacacacgcttaataatttttttctgtttgatctagtaagggttgaagtatgcggaattctctcactgtggcgacggatttgttcattttcccttgtaggcctaattcttgctttcatattttaatgccattttatctgttatatattcatcagtagtttaatcttttattatatgatgaccatcttcatccctaatgatgcattatttcttaaactttattttgtctgatattgtatagctatatgccaactttctttttgttagaatattcctggcattcccttttccatttagtctttctgtttctttacattttaatgtcattcttctaaacagaataaaactgatcttaaaaattcactttatcttttaactggaaggttttgttcagttgcattattataattactgttataggccgggtcatggtggcttacacctgtaatcccagcactttgggaggctgaggcaggtggatcacttgaggtcaggagttcaagaccagcctggccaacatagtgaaaccgcatctctactaaaaattaggtgggtgtggcggcatgcacctgtagtccccaggaggctgaggtgggagaatcgcttgaaccgggaaggtggagattgcagtgagccaagatgctaccactgcactccagcctgggtgacagagactctgtccacccaccctccaaaaaaaaatagctgatatatttgaatttatttcaccacctcgttttgtacttttgacctcaattattcttttatttttatttttttttaattgatcattcttgggtgtttctcacagagggggatttggcagggtcataggacaatggtggagggagggtcagcagataaacaagtgaacaaaggtctctggttttcctaggcagaggaccctgcggccttccgcagtgtttgtgtccctgggtacttgagattagggagtggcgatgactcttaacgagcatgctgccttcaagcatctgtttaacaaagcacatcttccactgcccttaatccatttaaccctgagtggacacagcacatgtttcagagagcacagggttgggggtaaggtcatacatagatcaacagcatcccaaggcagaagaatttttcttagtacagaacaaaatggagtttcccatgtctacttctttctacacagacacagcaacaatctgatttctctatcttttccccacatttcccccttttctattccacaaaaccgccatcgtcatcatggcccgttctcaacgagctgttgggtatagctcacagacggggtggcggctgggcagaggggctcctcacttcccagaaggggcagacgggcagaggcaccccccacctcccggacggggcggtggcagggcagagtcgccccccatctccctcccagatggggtggctgccgggcagaggcgctcctcacttcccagacggggcggctgccgggcggaggggctcctcacttctcagacggggcggctgggcagagacgctcctcacctcccagacggggtcgcggccgggcagaggtgctcctcacatcccagacgtggcggcggggcagaggcgctccccacatctcagacgatgggcagccgggcagagatgctcctcacttcctagatgggatggaggccaggaagaggctctcctcacttcccagactgggcagccgggcagaggggctcctcacatcccagacgatgggaggccaggcagagacgctcctcacttcccagacggggtggcagccgggcagaggctgcaatctcggcactttgggaggccaagtcaggcggctgggaggtggaggttgtagctagccgagaccacgccactgcactccagcctgggcaacattgagcactgagtgaacgagactccgtctgcaatcccggcaccttgggaggccgaggctggcagatcactcgcggttaggagctggagaccagcacggccaacacggcgaaaccccgtctccaccaaaaaaatacgaaaaccagtcaggcgtggcggcgtgcgcctgcaatcgcaggcactcggcaggctgaggcaggagaatcaggcaggtaggttgcagtaagccgagatggcagcagcacagtgcagcttcggctgggcatcagagggagaccgtggaaagagagggagagagagactgtggggagagggggaggggagggggagggggagagggagagggagagctattcttttattctttaaaaattcttcctttttactctcctgcttttgcattgctgtcacatacatgtaaaatgtagcacaggaaatgtatgtgtattcacaatcaactggaaactaataactttttatttctgctgtcaatccaacaatggaggtaaagcacagagtggtagttccaaacttgaacttcacagatgaacaaaatttccccacaatgttggttactggccaggcgaggtggctcaagcctgtaatcccaactacttgggaagctaaggcaggaggattgcttgagcttgagagttgcaggctgcagtgagctaagatcgtgcagctacactccaacctaggtgatagagcaagaccctgtctctaatgacatcagaaaagttggttactagtatagggtggccaacttttcattttgccaaattgtgaaattcataaaacaaatagccacaaaactatcatctatcctaattttaattttaaaaaagaaaggacatttaaaaacaacttattttggcaaatgaaaacttattactattgggttttcaccattaaagctgatgagcttggtctttcctccttgcttttgatagggccaaaagagagacattggctactttaacaactttaaggtggactccaggaatatcaccaacagcatgaccttttctgccaaatccagcaaccagaactgttgcaggaagtcagggaccctgaacggagggaccagctggagccgaggcagaagaacataaattgtgatgatttcatggacatttgtcagtttccaaaattaatacttttataatttcttacacctgtctttactgcaatctctgaacataaattgtgaagaattcatggacatttatcgcttccccaatcaatactcttataatttcttatgcctctctttaatctcttaatcctgtcatcttcgtaagctgaggatgtgtgtcacctcaggaccctgtgatggttgcgttaactgtacaaattgtaaaacatctgtgtttgaacaatatgaaatcagcgcaccctgaaaaagaacagaataacagcaattttcagggaacaaggaaagataactgtaaggtctgactgcctgtggggtcgggcagaatagtgtcatatttttcttcttgcagagagcctatagatggacatgtgagtaggagaaatattgctgaattcttttccccacaaggaatattaataattgatagccctggggaaggaatgcattcctgggggtaggtctatagatggccgctctgggagtctcagtcttatgtggttgagataaggactgaaatacaccctggtctcctgcagtaccctcaggcttactaggattgggaaattccagcctggtaaattctagtcagaccagttgtctgctctcgaaccctgtttcctgttaagatgtttatcaagacaatgtgtgcacagcgggacataggccctcatcagtaattctaattttgccttgccttgtgatcttttatcgccctttgaagcatgtgatctttgtgacttactccctgtttgtacaccccctccccttttagaatccctaataaaaacttgctggttttgtggctcaggtgggcatcatggaacctgccaatatgtgatgtcacccctggcggcccagcagtaaaatttttctctttgtactctttctcttcatttctcagaccggtcaacacttagggaaaatagaaaagaacctacattgaaatattgggtgctggttcccctgatacagaacttcatcatttttttcaataaaattcaagcaatcatcatcaggtacaaaggctgtgattttcttgctgttctctcatctgcctcacagcctccaacctgtaacaagaggatcagctgtgccagtggagaccacagcatctagcttatgctggatgatcagcttggccctggcacacttctcagtggcagagctgggctatttggctccaatccctactttttccagcccaattccctttgcatgagaagcacctccaaaagggctggtcttcaggactgtgcccgaatgggctttcttgtaccatttaccatgccacttctgatcctgtcggtgacaatggagcttcctggaggtagacagtccatgacacttgcccatattgccagctccacaggtctgagcaaaagaacagagacaaaaatttaaaataaaagaaatgactctaggcctggtacggtggctcttgcctgtaatcccagcactttgggagtctgaggcgggaggatcacctgtggtcaggagtttgagaccagcctggccaatatagcgaaagcccatctctgctaaaaatacaaaaaaattagctgggcgaggtggcaggcgcctatagtcccagctactcgggaggctgaggcaggagaatggcgtgaaccttgcggggcggagcctgcagtgagccgagatcgcgccactgcattccaacctgggcgacagcgagactctgtctcaaaaaaaaaaaaaaaaacacaaaaattagccgggcatggtggcccatgactgtaatcttctcagctactcaggaggctgaggcaggagaattgcttgaatgtgggaggtggaggttgcagtgagccgaaatcgcaccactgcactccagcctgggcaacagagcaagactccatctcaaaaaaaaaaattaattaaaaaaaaataaatgactctagtttaaagatcatttggcaaatttatttatttacttatttagtatacatatgatacacatatatgtattttacataagatataaaatatgtgtacacataaacatatatgcatatataatttctgcatatgcatatctatgtttgcatgtcttctcatttcactaaacatcattgaaaacttccacctgcaactaaactggagcccactgatgacagaggatggcagggcagaaagaaaggagattctgtgtggaggctatggagaggccctgggtcttgggcagtatagaaaatggcttttgtccaagtgttcttattgctcaattcccacctatgagtgagaacatgcggtgtttgattttctgtccttgcgaaagtttgtttagactgatggtttccagcttcatctatgtccctacaaaggacatgaactcatccttttttatggctgcatagtattctatagtgtatatgtgccacattttcttactccagtctatcattgatggacatttgggttggttccaagtctttgctattgtgaatatttccgcaataaacttacgtgtgcacgggtggggaacatcacacaccgggacctgtcgtgggtggggaaggggggagggataacattaggaaaaacacctaatgtaaatgacgagttaatgggtgcagcacaccaacatggcacatgtatacatatgtaacaaacctgcaccttgtgcacatgtagcctagaacttgaagtatatatatatgaattaaagaaaaaaaaggctttttagacccagcactgacgagattccctaggtcgatggtggtggaattaggggtctctgtcctcagacatttggatctggatatgtcagcatgaaagtccttaagttgcaggcattttttaaaaaatattttttatttccaagctgaataccattaattggaatgttacaggctttttaagctccgtgttctgtctgcatggctaatatgcccgtagaaacctttcaaaacagcgtgggttgaagactaattttgtaacacaaaactcacttacttagatatcacattttgctggacgtgattggacctgaaagaaaatatttttaatgctcacgacaataacctttttatgagtcagcactaaacgtgtgcacatgcatacataagttgtctacatcagcaaaaaaagcttatcgtcgtatttctctgaccaaaatcaacggaacccccgaaatcacagagagcatccattttggattccccgaagacccttcgttcctgcatcctcttctgctctccctttctcagcctcttctgctggaagctgagtcctgctccagatctaggcaagtgctagcgcggaaaaaagacctgcctcgctcagggctgtgagccgcgccctgaagcacggaaagctaattgtgtcactggtttcaaatcaacttcaaattttttggagacgtaagagtgctgagcattttttcttcagtgaagtgacttggcagcccaggtcgccaacgcccgtttctgtagcgcgatcggttagcgccttcggctgttaaacgaaaggttggtggttcgttcccaccccgggacagaagtcccacttttgtgaaccttgagtttttgaaactttcactgaaaaaaaccgcgtgcgatgctatccgccgggagcgctggagccttggctctcaaaaccagccgcggtgctaaccgccgggatccctggcagctgacctccgcgttgtgtggttcccaatgtcctcttctgccttagtgctgtacgggtaattttgaggtatttggtttttccgactagggttgtagtgataactcttagctgcttaaccactgcaattacgttatggaaactgacactttaagaaaatttactgaccaaaggaagtaagtactaataataccaaaacaaattgtttgtctttccaccaaacctgtacctgccttgcctttctatttcctaactcagaaaacgggcactatgtgtggaacctggtccttagtcatgccatgtactgccggctgccaattcttggagagtcggcctcctaaataccttgttgattaagcaccttcctctccagcctcaccgccagttacttcctcattgctccctttgggttattgcatcctgccttgcatgccctatctggtttccggtcttcagctctcctgtcccgtccatccatcaagtagttgccagagaatccttctaaaatactatacggtataaacctggtctgcttaaactctctcaatgtattgcagggtctgatacgatcttcttagtttggaaggtaatgcccttcatgatctggccctgaaactctttcctctccctcaccgacacagaaccaaactgctttcttgaactcacactctggcttttgaatctttgcctatgaaccttgggcttttcttctcttctttgcctggcgaactcctactcatccttcatgaccacaccccccaaatcaagcctcttttctgcagccctttcttcattctcttcctatttaactgtttttctcactagaaataaagcttctccagggaatgaccctgtgttgttcatctggtatcttcagcacctgaactcaagcttgcacattgtaggtagtaaataaatgtgagttgaatgtccaaggtttccaaatgcacctgtgtcgtgtcggaatcttatgtaatatttatgtatgtaatctagcttgaatcgtcttggtatatagctcataattcatacaatcaggctgaccctctacctctgcccaggcctctacctcctgtgtagctgtgccttctcctatctgccccaatgctctaaaacgatctctaatgcttattcaccctcctatcccatacttcccataagaatcccccttagcccaattttctcagcaagatttggaaagcaagctggctaattcatatgagttgtggtgagatggctgctgggaggagggggtgtttcttaccaatccaaaccaatctctgttacaatgttggacaaagggaagaagaaagaattttatcattcatattttattaccatggttttgccatcttctatctaagagtagcatgcaagatcttgtaaaatgctttattggaaccaagaaatgttgcactgaaagcttacaaaacagagacagctaaagctttctttcataagcaacaattgtcttctccatccccacctcattggaactgacatgaagaaggatttgaaagtttcacagcgtaactcagtgaagctcagtagtacatttagtattggttatacaacatttgtttaataaatgcaatgaacaaagctatacaggaactagacattgaagcagaaaaggtggttttacagtccctgcattaacctctaattcttactaccccggccaagaaagcattttcacctcctgcgctttccttcctgtgtgcttctggttggttctttcttctcaggctttctcattctgatgctgagatagttctgttcacttagcttaacttgagacagtgacacagggtttgttctgtactttcttttccaccccacccccaccccaatcctcagtccccttcctaggaccattttctactcctagcattagaggactcatcgttatatacttggaaatggtccagttctgatagagtcccctggaagactcaattctacgtcaccctcatgatttcctgttaattccactacggctaatgttctaggaagacacccttatctctgggctcagatgggaacacctcccttagactatcctggactaccctgctatttctcagccatgctttcattggtcccactgaattctctagatccccagcagttcccacactctgtagggtcctgcctcaaccattaattctacttatccatttgtttaggaataattattttctttttttccctctaaactgggtaatttataatacgagcaatttttgtatgtttaaaggattaccatccctagcctgtattgttgctttgctgtgagggaatggttgggacagaaaaagtgtttgtgtagctctgaaacttcaatttctaggaatgcagctactcactggggcttccctgcttgaagatcatgggcttttcccttccactggagaccaaggaaaaatcgagagttggataaaggatctggctctgagttctatgtttcctgctgcttgtagagaggcctgaggatgatggggttgcaaatccagagaaatgttcagagatgctgctgccactgctcttattacccccatgggatgggggtcatgtgtcttgagggtcctttctccatttaagtttatggtccttccagtctcttgttgagcttcaaatgtttgtcttcacagagaaatatagtcctgtgtccactgcaaaaaggagtaccatcaccaagcagaaagagacttggtacccaggtggagagaatgatgagatggttgacactgccaaacctattaggagaagtggagagatgaaaaaaaatgacagtcactaaggcagatatttggaacaaacagtgaggtcaccagtagagagtctttgacaagtgccaacaggcaagtggtaggaatggtggggaggtctgggggaaagtattgcttcctcccattggttcctgatcttagtgctatctgagcagaggacagctcaccaaacacttagcaaaggctcctgcttgtttgacagagatgtgacagggagcgttaacaagttaggttgtaagctgggttttgtgtgacagttaagaaattgtcagacaatgctatggtctagaaactgggataaatttgttgattttgcatttcaattttttaaactcttgattttgatatatttccaaacttaaaaaaaatgaccagaatagtataaagaaatctcgtatatcctttacccagatccactcattgtttacatgttaccccatttgctttatttgctctctttccctaaccacttgggagtatttactttcagtttaaagtgtcatgaaattatttttgtacaaattatggcattgtggtgtcaaaatctcaaaaggtgttttgctgcctttctacatgcaaattgtttacaatttatgtcttgggctagttacagatagaagttctgtgaaactggaaagtccaggcacaccactctagagctctgattctggaggctggtgctatggaacctagagatgttttgtggatgacttaatgggatcataggatattagtgcttcttcaaatcttttacttactggttaaatatacaggctttgaagtctttgatgtgaccttaggggcaacttatttatttatttttgcacctcggttacttcatctgtaaaatggaatattacctatctcatgttgtgaaggtctactgtggtagtcaaaccaggtgcatgtaaagaattgtttagcacagagtctagcacactgaaaggtgcccaataaatgtcagcttatttttgttacggaagaagaaattggggttcagagagactaagtggctcacctctggtcagatggttaattagctgcagggccagaacccaggttctgggctctttctgtgaggggatgaggggctcctgccagtttggatcgtggctaaaaggcttggataagaaggaggccagcacgataggaacatatgacaccgtgggtgtgattagggtaaggaaagacagaggtatttattggggaggagatgtggcttctgctcctgccatcatgctgcagagtgaatgacacctcctagctaccccaaaagaatggactgaaacagagctgcaaacctaccctgcaatcagggacttttggggacctcctggtgatcaccaggagggaaccacatatgaagaagtgcgtgtaagaatcaggaatctcctcccaactcaacttcccagtgtgagtgcaggttccacacacaggcgtccctgggcattccagggtggcacatgtctcaccttgagtgatggtgatgttcacagtctctgaagacacatttttactcccaacaagccccctgcagaagtaggagccgctatctttgagtgtggcttttggaatgtggaagtcagaattatgatgaaaatacttcctgtctttgccattctgtaaatatgtgaccttatgcagagcagtgttcttccagctgtgacacctcaggtgaatagggtcttcctccttgaacacccaccgaggggcctggagcaacagccagcctgaaagacacagagacaccccaggcccgggaggcctcagctctcagtgcagagctttgtgaaggggccacgtaccacccagatcctgaggcataagggaaagccagattgggagtcaaccctgcatagctccctttggggaagagctgatggggccctgcaagagaactgaagtcataccaagacctttgtctaatggggaagagggacacacacacatgtgatcaacacacagggttagagcagagggactaagcaatgaggtaagtgagaagcaacgatgagcatatctgcaggatccttaagtgctagacttagatttgctgtggcaggtgacaaggattcacagtaagttctagatcagagtaaaaattgcatttgaaaatgatgagttgctctattagaggaaaaggtagatttcagaaggaataggcaatcaaaggaatattgaaagactcttgtggccttcaggaataagctgacggtcgccacagagtggctgcagaaattgtgaaggagaactaactcaatgtaaacatcagggtggcgaagggcgggactggtagtgctcagagtggcaattcgtggtttctaaggtgtcacagggcctcggtgagaccaactttattactgagcatggccttcaagagaggaaattcttatatcgccagagcttattctcacaatcatgtcaccaagtaatcagacttcacaaagagagaacatgaggtcatggtcgggaaatggcctgaataattaaaaaaataatgatgttataggtaagtattataatggcataagaaaatattcatgagacaatgttaagttaaaaaagcataatacttcaaatattttaaaaagtattatgcacagaaaaaagaaggatatgcacttacatattaacaggggttttctctgaaggagtgggaccaaaggacattttaaatttctcctgtttacttttatatatttttgaaattgacccgaaacgtaataagagcaaaactaaatttactgtaattttattttttaaatctacattctcaggttgaattactataattttaaaaatctactacctgatgctaaacaaaattggtaggacgtgtgttggtcatgattctctaacacaaagatttgccaaacagaaagtaatcttcattacctattaagagatatcatttatcaaaagaagccatgtgcctatctatccacttactttttcagcaaagagatgaatcattattagcataaagtcatggttagtatatagtctggtggcctttggaggaacattcttgttcgaatctgtcctgtcatggactcagtgaatgcccatgtgtatattccttcaagtgatatttcatcaagcactcactatgtatgacacactgtggactggagatacccagatgatgggacatatagttctcagcctcaaagaatctacagcctagacatagaaacataaatattcagaaataatcacaatacaatatgacgagtgctacaacaggctaagaataaaggactgcggggccgactagattggaataaagaaattctgcctgaaagaagtaaaaaatgcaggctgggcgcggtggctcacatctgtaatcctagtactttgggaggctgaagtaggcagatcacgaggtcaggagatcaagaccatcctggctaatgccgtgaaaccctgtctctactaaaaatacaaaaaattagccgggcgtggtggcatgcacctgtagtcccagctagttgggaggctgaagcaggagaatcgctggaaccagggaggtggaggttgcagtgaaccaagattgcgccactgcactccagcttgggtgacagagagaaactctgtctcaaaaacaaaaacaaaaacaaacaaacaaacaaagaagtaaaaagtgcttctcagaggaggacataagtgaaatgggtcctaaaggaataaaggatgctcagaagtttacctggtgaagctaattctcatggtcacagtttaatatagccttgattggctagacttctaaagccagtttctagagccaagttcaaggcaaactagtaactcctagacttgatttttctattgctttctcttggtaattcccccattttatttggttgtaggtggacatctcttacctagctagaaatggacataccttcttgtagctctggagagtgaagaccatgtcagttgagtggtaatgtcagaggccaaagagccacaaaaatcagtttcagaggcccaattccatggagctctcttgcagatccacctccttatgcccttcttcccccaaagcttgttccacccataaacattgtatgaatggaacagccgtggaagtagaattaggtttgcagggcgacactgcagggaccaggctatgtggtaagattgtagggacaccaggaaagacccctgccttcaaaatatttctcctacctgtgtctgatgtctatattctgttaatagtacacaaggactttcatgtcatgattaatgtgcaggctgaacatgtatctgcctctattggaagagctatcacattaccaaatttatgcttaattataggtttgagtatagcattgatgaggagacagaaagatatgattctaggccactaggattgctttgggaggtggcttagggcattacatgtctgagagcgagaaggagattgaggtcctaacaccaaattcattaatttattcaataaaaattattggccaggtgtggtggctcacgcctgtagtcccagcactttggaaagccaagaccggtgaatcacctgaggtcaggagtttgagaccagactgaccaacatggtgaaaccctgtctctactaaaaatacaaaaattagctgggcgtggtggcgggtgcctgtaatctcagctactcgggaggctgaggctggagaatcactacaacccaagggggcagaagttgcagtgagctcagattgccgcattgcactccagcctgggtgagagagtgatactctgtctcaaaaaataaaattaaaaaaaatgaaaataaataaataaataactattattgagcatctatgccatggcctaaccttcacatgacacattcacattgtatgcactccatatggggattcttggaattgtgcaatgcagcagcctatatctactgtctgacaggctttgacattttgcccaagacctacttagagctaggactacaactctgataccattcagtgggaccacacatcatctcatcttagcttttatctctaagaatatcatctctggctcttaccaagtatttcaggaccctttgtttcaccctttattggtgattttcctcttccccttcatcaactcaccgatatggacttctagctgcaccgggtcactgagggtggagaggtttgtctggcacctgtactctccactgtcgttgactgtggcagcgtcaatgaagtagctcgaggcctggcttgagatgaggttctcattgtgaaaccactgtgtggaattgtcctcaggggagtaggctccctggcacttcagagtcacactgtccttctcaagcacgctgtaccattgaggctccaggaacaccacagcctttgggagatcttctgaggagccaagataatgtggggtgaggacagggagaggagcaggctctacactgccattcccagggagcctcaaagccagaatgagctcattgcaaacccatgcttggtggctcagtcttagagcatcttggccccatttttggcctgttcagtatcttaaggaaagctggccagagaagcacagggccaagttctgctgtgttggaggaactatccctgctaaccccacatcagcattttcccattcaacaagcatttcccaatatcttatggccattgtccccatatgtgccccactgggtcaatccaagaccatgaagctgactcaccagtccgcatgccagctgaaactgcaagaaaaaagagtaaatcaaatattgagtaggggcagagatcagagtgattagaacatagagtgagtttaaaactcccctgccctcctctgccccaggagcccaattttcccaagaatcaggatgtttctggtggaaaccttgctacctgctctctggtctccactgttcatgcctcttgcgccactgtcaacacaaatccctattttcaacactgctcccttaccccttgctccctgtgcaaactcacaaattaagggtacaggttgaatttccctgaaccaagctacagaaagagcctcaacccatatccccacaagaaagggtagaaattaaaaaccatagaggagaaccctggaatgtcaaactgaaagagacagaccctagggaccatctagtcgaagctctttggttccacatagtgattctgggacccagaggggtgaagtgactggcctcactcatgactatgacccaattggaaccagcattctcctcatttctagccccatcttggcttgtcctggtagctcaatccacagctatagatgtggtgaggggtcccatccctttgtgggagtctcattcgtagcctgaaaaggggtgtctgatgaacccaaggcatctcaaacttctccctcaaccagggagatcctgacttacctagaagtagcagagcagttgggaggagcagctgccacatgatgccacactggagtggacaagtcaccaaagatatccggagccctaaagggaccaagccgactagacaggagggagtaaacagcctttccccagtccctccacccatctctgtcacctgccagtttccttttcttgaaacttcatctgatttctcaatctgaagtctcgcaatggagccccaccatagaacaggaataggaaggaaagagcctggaggcaaggtgggtgggtgtgccccctttactctcccaaaggtctgcggctgagcatctgaggacacacacagaatctgccagagtgtgccctcagctttcccaggatgcttgcccccatctcctggatttagatccacccagcaccaagaatgggacagcaagaccctggggatgagattcaaggtgggaggagcattctctgagggcttcctgcatttcacctcagaacttctcactctcctgcctcgtccagacccatctatctccagccgaggccctgcctgcacacagaaagttgtcctttcaaatctttgaccactagcagtgtctctgcctcaatattatctccacgcagaatttctttcaaaattcaaaattcaaaatctatatgctcctgggatatgtaatccacaggagctgactttttagtgtgatttgatcattagatttccaggttagaagaaacccaggtagggtagagaaatgggccctggaagaacaagtcaccagtgaaaggctgaaaagatcacagaaaaggtgggggtggggaggggtgaggacaggaactctttaccttcctcgtgttacccaggtcctgcggatttagctcaggcccctccgggccactggatctgggctggtctgtcagcctaggatccagggctccagggctccagggctccttaccagaaaaggtggaggggggtggccaggaagtgggagggttgttaacctcttctcttctctccagattctcccccgtaaccccatgttggttactctcacaatggtccaggtcccaggcagaaaatcagatgactctgcttgatagtgccactcccccagtggattcgtggacatctgggacaggtctcacttggcttagaaaagcccaggaggcgagcagcaggcccgtgtgggcacctgatacttgttaggggtggagtggaggcaggggctgacacaggtgcccgccaacctttgctataaatgaatgctctttctactccagaatgacctaaaaaccactactcaggttttgttttttatttgtgtgtttcatttggctcctgggtggagttaattgatcctcccattgccatccacgtacccacccctccccctgccacacacagagtcttgcagcagccccttctccacaggcccttggattggacaacagaaatgaacccaggccgccattccagttctccttctcaagtgactcatctacgccttgcaaaatccagacaagtatctggaaacttgaagttccttgctgtagcacttcagatgctcatctgggaaacctaaagcagaaacaaagccttcagggctaaggatggtctctgaggcaaaaagcggatatccctcaattctttcttcttttcagatatccaggtggctttctgccacgtgacttctgatgcaaggccttcactttgttttccttctttgaggtcttattttcttatttgactcctctttggtctgtgactctccaatggagggaggaattcttagctgccaaaagggtgggctagataggaagaagaggagagagcacaggaggagagaaagggactgcaacaggatgggaagctttcagggggttttcattaagtggttgttgaacaattctcgaattgagtgttgttgggtttgtaagggttaattttacagtaatggataaaatgcaaaattttggcctatggtggcttattgtaatcccagcactttggaaggccaatgtgaggtggaagaattgcttgaggccaggaatttgagaccagcctaggcaacatagaaagaccccatctctactaatatagtaataataataatagccagatgtggtggtgcatgcctgtagtcccagttacccaggaggctgaggcaggaggattgcttgagccccggagttagaggctacagtgagttatgttcatggcactgcactctagcctgggcgacagagtgagaccctgactcttgggggggaaaaaaaagagcaaaatttttacaaaagggtagatggtcttgggatatcatatactgaagtgtttatcttcatgtttgcttttctttcttctccttccctttttcttccttcccctcctcttctctccttttctcattggaaggccaggcacagcagaagtttctgactatggaattcagtcgattgtcatcctctaggacttacagtttcttagggggagaacatcagataagtatttgaagtgctagagggactgtgacagtatttatgaaatgctgtgtatgcacaaagaagacagtggctaattctatctgagggaggagtgtacatggaagagagaacactttaattagatcgcaaaatattcagcaggaagatttttgagagaaataggcattccaggcaagaggagcagcatgagcaaagacttggagtgaagtagactgtcatgtttgcagagctggctgtagttccacaagtgtagttggatgtagttccacaagtgtagtgagtactacaaaggagaagcacaggttccaaaaggattaagatgtctgggtctcacatgaatctggaggaaatcccaactctgccacttatttaaccttctagccctcagtttccttatctgtaaagtgaggctaacaataatggcactcatggcttaaatgagataatgcagataaaattgttggttccatatttggtaccacacctgctgattactattgtaagtgcaagatgggaggttgagaccttcctcaattttctaaattaggttctgacccccaaccccaccccagctcctttcggagcttgtgcttctcctctgtaaactcattgcatttgtggactgaaaggtcttggagagcagggaacctgttcaccttgtttacccctgtaccctcaacatttagcacaagggcaggcacatactaggcactcaattagtatttatcacgaagagttttgtgtgtcaggatgaacagtacatattttattctaaaaggtaatgggaactaataaaaaggctttagactggggaatcacaagatctgttttatattttatgaaaagtactctgacagcagtccaaggaatgagttagaggggagagagatggaaggtggagggaaaagttagaagattatttcaacagtctagttgagacaagagccactctgtttaaaaagtggatatgcaatggaagcatccaggagagaagttaggaaggaaggatggacaagacttggtgagtgattggctgaggggtgatgaagggggagaggtctgggtgatgctcggatttctaatttgggtgataaggaggatggcagtagctttcatggacaaaagaaaaatgggaagatgagcaggctttgggagggagagacaataatttcagcttttgatgttattgagtttgaggtagctgtgaaggtttcaggtgaagatttccagtaggcagtgagacacatggccctggaactcagaagacaggtcttgacaaaagacacaatttaggaggcaccaacacggttgaggtttcaaacctctgataaaaacctttgggccttctcccaagaaaggatgcaaatatacacattatgtttcctttaatttaagaagctctatttgaatccatccagagatcctaggttaagataaagtaaggataagatctctgaaactgtaagagtattgagagagaattaaagggaaacagtgagggaaaggaaggagggattgagagggagaggagaagaggagagagtcaatgacagaaacttgacatgcaaacatttttgaagcgtgcacaggaaaaatagctgacaaaggagtttgtataggaggggctgaagaggagggaacaaggaagtttagtgggaacagatcttcaaggaaggagtagtcaacaataacactattaatgtgtagaaataattcaaacaagagtttgattgaaatatggcaatcaaggaactattaatgaccttttcctgagcaatttcaggggctggggctgagaaacagaagtttgacagcttttggttgaagacggagtaggaatgaaatagtgtttagtgaagtgcttctcctcttcagaatctccattatgaaggaatagtgcacatatcatctggctgtccaggatcacttcctcctccccttcttattagcatatcattcttcctggagaagccccactgtgagtacttaatagaaagcagtgattgctttctactatggaaacccgagggtccagatcttccttttccccactttggggcactattaaggactaaattgtgtctctcccagttcatatattgaagtccacatgtggaactccctatacctcaggatgtgactatatgtggatatagagcctttaaagaggtaattaagttaaaataaaatcattaggtgggctctagtccaatatgactgatgtccttattagttgggacacagacccatacagggagaagatggacacctacaagccaaggagagaggcctcagaagaaaccaaccctatggactcaaagggagaacaacagacacactggggcctacttgaaggtggagggtaggaagagggagaggatcggaaaaaataactattgagtaactaggcttagtacatgggtgatgaaataatgtgtgcaacaaacccccgtgataggagtttacctatgtagcaaacctgcacgcgtacccctaaatctaaaataaaagtttttttaaaaaattaaaagaaaccaaccctgtcaacaccttggtcttggacttgcagcctcaagaactgtaagaaaatacatttttgttgtttaagccacccagtctgtggtactttgttataaaagtgctagctaactgatacaggcagacagaggacaggcatataactgaggtttggcccattagagtctcttctgagatgaatcctgaataagagacacttgtttactcataagggagattcacttctaggagagggagatggttgggtcccagtcatcacagcagtgggatgggctgacctcctctagtttccatccaataaatttgtttcctctacttaaaagatctggattctgataaagttgtttataacccagagccctaagtgacacaataagaaaggagaagtggaggatggtaactagacagagctgattcatcaagacaggagaattgcaatagagaaagagtaattcatgcagagctgactgagccagagactggagttttattatcactcaaatcagtcttccagagtattcggggagcagagtttttaaggacaacttggttggtggaggggaagccagtgagccaggagtgttgattggtcagggatgaaatcacaggaagttgaagctgtcttcttgttctgagtcagttcctgggtgggcaccacaagatcagatgagccagtttattgatctgggtgttgccaggtgatccatcaagtgcagggtctgcaaaatatctcaagcaccgatcttaggatcagtgcttagggagggtcagaatcttgtagcctccacctgcatgattcctaaaccataatttccaatcttgtggctaatgttagtcctacaaagacaatctagtcttcagaaaaaaaggaggtctgccctgggaaagggctgttatcatctttgctttaaaccacaaactataaactaagtttctcccaaagttagttcagcctatgcccaagaatgaggaaagacagcttggaggttagaagcaagatggagtcaattaagttagatctctctcactgtttcagacacaattctgcaaaggtagtttcaagagaatgggagtttttgttttccttaagtgaaagatacaagcttggttataggtctttgggaagaagccagcagggtgggagaagttggatgcctaacagggacggaatacctagagaagcaagtgtgggtcctgaggagatggaaatgggacatggacagggagttggctgtgaactggatacggattacctctcgctctgagctgaaggcaggggctgagggggtacatatgcaaatccattttcagatgttgagtgaccatccacatctgctggtcctgattttcttggttaaggaggagtcaaagacacctgtcgagaaagagtgggtaacagttgtggtgggggtttgagaacaccagagttgagaatggccattgtggtgcatgggagaaggagccgactgtttgtatgtacaagaattaccaagaattccaaacaattgtaaggattgccaagcaatgccaagggcccacctgaggtgggtcactatggatttgtagctggatcagtcttcagtgctggtaacatttctccagttgtactcagtgccaactgctgtctgattagcctgctgaaaacagtcctgagcaggagtggagggaggtcctacaacctgtattacctccaaagcagctcaaccagactgaggaaatgctagaatgaaggtatgtgggctttcagtgagctcatccaagacaagtagtcaggaaggctgtgagaaaggtaggctggcctggcagtctttggtatagtccagcagttgagttccagttacctattgctgtaactgtagaaaaaacaaactcagttcctcccactatgctctcacaacacatttctgacaacagatatgtggggatttctctccactggcaagcaagcaagcaagcaattcagcagtgggcaccaactgggtgtcttctaatccagtggtccccaaaatttttggcaccagggattggcttcatggaagacaatttttcctcggacaggggtaggggggtgggggatggtttcaggatgattcaagtgcattacatttattgtgcacttcatttctattattattacagtgtaatatttaatgaagtaattatacaacttaccataatgtagaatcagggggagccccgagcttgttttcttgcaactagacagtcccatctagggtgatgggagacaatgccaggtcatcaggcactagattctcataaggagaacgcaacctagatcccttgcatgcgtacttcacaatagggttcatgctcctgtgataatttaatgccacagctgatctgacaggaggaggagctcaggcggtgatgtgagccatggggatctactgtaaatacagataaagctttgctccccacctgcccctcacttcctgctgtgcagcccagttcctaagaggtcactgacaactacaaatctggggattgggacttctgctcgaattcaattgaattccaacactatctaactggaaatagcatcaggtgacacaagtgaagggctcagtctcacaagacacttctgatattgcagggtgaagccccaggttgttttatctgtgcttttgaccaaccagttataaatgggggttcccaccacctgcatcttgggttcaattaatttgctagagtggctctcagtactcagggaaacatttacatttatcagtttgtgataaagaatattacaaaggacacaagtaaagagtacatagggcaagacctgtgggaaggggcttggagcttccatgccctctggtgcactaccctccaagaacctctctgtgttcggctctctggaggatctccaaaccctgtccttttgggtttttatgggagctttattacttaggaatgattaattaaatcattggctattggtgatcaattcaaccttcagcccctctccacttcccagagggagtttggagggtggagctgaaagccccaatcctctgaccttgccatgatctttcttgtgcccagcccctgttatgaagctacctaagagctgccagccatcagttacctcattagcacaccaaaagacatcactttggagattctaaggattttaggagttgtatgccaggaaaaaggatgaagactgtataaaggacccttgacataactaactccatcttagaaaaagactccattttatatttcatagggcatttggccaacaagataaaatgttctaagaaacaaattaaaaatgataaagactgcagccgaccaaataaggccacagacaagcacactcttccaactttcagttcttatcacaggactccatgactaaaagagaaggccttcagcagcttgaaatggctatcttagctgacactgtcttgcagtcactcatgatgataatttggcatctgccactgaaggctctgccacctcagactcttctttgcaagaccaacgggtagccaggcccagaccaggactcctttggtcttcttagatcctcatcaacaggcttattaaccctttctcctgtctcttttccctcttgatgttaaatagtacttagtttgttgtggaacgtttaacctataacatttatgtaaatgttataggtagagaggattgccatatttgggagagagggtctctctctctctctcccactggacgtgaacaagggctcattttgtcctaaggtcttgctggcagctatccttaagactttataacatttaggagctatacagcttctctttctgctgtattctaatcaccagaagttataagcccacccagattcaagggtagaggatgtaggcctcatttcttgatggagagagtgtcaaagaatttgcagccgtgttttagtgctgccacaactagctactctaatacactttaaagatttcttgattcttcggtggtgtgattagagtaaaatcctgaaaaatagaaaggcctgggggaaggggagactgtaagatctagggaagggaaaattttttatcctattctaagaacaatcacaggaagaagggaggtagttggtactaactagaaagaagcaagtcagacagacattatccattcatcccctcccaggtccaagagtttgcttacgattataaacagcaagaagactgtatttcgtgatgctctcttagctcagggctacagagcaatgctgttgtatgtaggaaagaatgatttcttgaacttgaatccacagtaggttctgagttttttccaactcaacaattgctatgctcagttaactcaacaaatagaatatgatgtactagcctgatatccatccctctccctcccttctaatataaccttgattctattcaggaatcaccctcatatgcagaggtggatcttgactgatctaagccactcagggtgtagcattcccctggcttttattggttaagtgggagaagacggaactttgtcctaaatagggccaatctggtagaggggagtgccatgtttgggagagatgatctctctctcccactgtacatgaacaagggctcattttgtcctaggttctgctggcaaaacctaagattttgaaggcagccagtctgaggtcaatgccaaaaaatcaaggaggacagagtggagggatagaatatggtcttggtgacatcactgagcttctaacgcaaccaacccagatttcttacaatttcaagtaaatttccctgctgtttaagccaatttaagtcagggcttgttaccttcatccaaaggcatcctagtgaataccttggtatttactgagtacctactaaaaggataagaaactctttttctggaaggagctaataatgaacaggggaggaaacttgacatttaatgaagaagaaagaaatgctgacatggagaccaggagctctagacctagctatgtcacccagggtgaccaccaattaaattgtctagatctcagtctctacaatcatgaaatgagaaagtggagtgtggactgtatgtttgctaagatctcctctggctaaattactgtgttttaatgtcaactagaggaaatatgacgcccccactttttttttttggtaagcatcagtggtccacaaagaatttaacaattggtaccaacagagaggcaaaaaataccttttttttttttttttagacaaagcctcactctgtcgccaaggctggagtgcagtggcatgatctcggctcactgcaatctctgcctcccgggtacaagcgattctcctgtctcagcctcccaagtagctgggattacaggcatatgcccccatgcccagctaatttttgtatttttagtagacacgggttttcaccatgttggccaggctggtctcgaactcctgacctcaggtgatccacccatctcggcctcccaaagtgctgggattacaggtgtgagccactgggcctggccaagaaggaatataattgccttttaagaaaatattctgcttgctttcttttttagagatgaggtctcactgtgtcagccaggctgggttaaaaaactcctggactcaagcagtccttctgcctcagcctcctgagtagccagcactactgcctggcttctacttgcttattttaatattaataacaaaatatagttagctctgagctttaaatacaatagatatcaaaattatttaataaaaaatattcatggtcccagcatggtggctcatacctgtaatcccagcacattgggaggctgaggcaggagcattgcttgaggccaggagttcaacaccagtctgggcaacctggcaaaaccccatctcttaaaaaaattcaaaataagccaggcctggggctacatgcctgtggtcccagctacttgggaggctgaggcgggaggatcacttgagcctgggaagtggaggttgcagtgaactgtgatcgtgcaactgcactccagcctgggcaacagagcgataccccgtctcaaaacaaaacaaaacaaaatattcaccattatgtgtctagtaaagtgaagaaaagaaataggaaaggaaactgtcaatataaaagaaaagggaggagaacaggcagagttagagacataaagacacaaaatgggatgggacttagaggaaaaccagtgagagaaaactcagaaagacacagttactgggacagtaaaaaacaaaacaaaacaaaaccccacaaaaaactgagagagacacccaggtttacaaatatggtgtcttaaaaatagatggaaaatgcatgaagagcaaggcatctactgagagatctggaaacagacacacctcgagatacatcatacaaaggcagtcatgggacaaggagagaacactttcacaaaaccaggaagagatagacagacaacaagggaaaaaaagcacatgggattgaagcagattttgtgggatgaccttaagctgcacctgttggcgttggctgtggttattaaaataatatgacctgctgacatacaagaactttccaaaattttatgctatagccaagagtgagttttaaatgccctgccttgtgctatctcacatcagaacatgcttagatgcctcccagacttgcaagtttttaaagtttcaaaaagagagtgatggcgatgtgttatgggaaggatactggtcaaggaggaaggaaatctcagttttggtttcagtctaacaggggtcagttgtcaagccacttctcttccctaaacttgtttcctcatagcaaagtgaggtaattgggctagattatatctaactctttccatcttaaatattctctaattctgaatgttgccttccagtggtagtttctagatattgcagaatgtagtagcctttgtcttctaaaaatcctaatgaaggcagcttttgggagccaaaaggattttctagcagagctagcaaattatacttctaagagttaaaagttaattataaaaactaaattcatgcttctgctcatgtgcaaaatcttcagaatctaccagaacaatacaaggtaacaccaaaaagaaaacttagtttttgaaaaagtttttgaaaaagaagtggaaatactgttttgtgttgttctgtttttaatccgtgccatcccactggagaagagagaaaggttggcaacatcattgggagtatgagcagagctcagaaccatccctagagactcagtccttgtccctttcaccaatattttgttattgtggctttaagcactttttggtttgaaaatacacgcgtgatctatatatgttcttgttgcaaataagtgaaacaattcggacgtaaataaaataaaagtaacagtgagatttaatgactccctcccccaatttcactcccttcctcagaggtaaccccttagaagcttgtagtatatctttccagaactttccccatacacttatattcatataagcacacatccacctttatgtatttatattttgctcatttctgtagttattgttagcatattacataatgcatattcttctgcaacttccttttttataatgattccacatatacataaacaccatgttgtttcaccatgttggccagctggtctcgaacaactgcaaactccactcaacatctttcacatttcacattaaatgggaggagaaatgcttaaaaaatgtatttgagggtgtgtggaaaggaagaaatggtattactttgactttcttttttttttaaaagatttgggtcattttggccaccaaaacaggaactttatcctgtatgggcagttgcctactgcacagccatttcttcccttcttctttgctaacggaacttgatttcgtttagcaatgttgtggtcatgagctgtagagaagcctagaccttttccagcctcagtgtgtgaactttcggttagtctaaaccagtggttctcaaatttgagctacatcagagccatttggagggcttgttaaaaacacaacttggtgagctctactctaccctccgagtttctgattctggtggggcttgagaatgtgcatttctaataagtttccaggtaatgctgatcttggtacaaggaccacactttgagaactgctgctctaagccaattatggtgttctattgtcttgccatgcttaggactaagcatatgatacagttctggacaattaatcctcagggataatctgctagagggattctgggactcaggaagtaacgagttctttctcagtctttggacatggtgatgcttaaagatgtgatgctgggagctactacggcagccaacttgcttccagagaagactggctgacatgctgagagtagcaaagcaaagagagggaagaatctgggttactgatgacattattgtagattaaacagctctggagctgccctaacttcaagaaacttaatatgtgagatagtaaaacatttattattatttaagccatttgagcagaattttctgtacttgcttcagaaagccacctaactgattcattcatacccttctctctcagtgctcagagagactccagctgatgtagcagcagagcaatttactttaagcatgattttggatattttaggttgtttctaattttcattatcattcagtagctctgcaaagagtaacaatgcttttgtatattttgggatatttccaaaggtcattttcccagaagcaaaattacaatgtcataagtatatgaatttccaaggttttgatagtttttccaaatctctttccaaaacaattgttttaatttctaccctattcagaaatatatgcaagttcatttaatcacgtccttttttcttaattgtgggcaatttcatagctgagaaatggggtctcataatttttatttgcatttatttgattactagtgtggagtcaacatttaccatgtgtctgtcaaccagttgcatttcctctttcatgttgctattagatggaaagcacttagcaccatgtctggccctcttggatatttattttttgtttaactaaatgtttttgggtttctctattgatatccctgcctttgcctatttatcaaaactctatgttcttctcattaatttcttatgtaataaaaatacccctttgcagggagacatgaatttttacacatttttttttccagtttgcagttagtagtttgtttttggttggttttagttttgtatcattccgaaatttaaaagtttcatgaagttcttttcttttctttctttctttttttgtttttttctgagacagagtctcattctgttgcccaggctggagtgcagtggcatgatctccgctcgctgcaacctttgactcacctcctgggttcaagtgagcacgttaggctaatttttgtattttcagtagggacagggtttcaccgtgttggccagctggtctcgaacttctgacctcatgtgatccacctgcctcggcctcccaaagtgctaggattacaggcatgagccatcacgcctggtctcttttctttccttctttttttttttttcctctattttttcctaagcttagaaatctttcttccttcagagaatttactcaagattcaattctattatcctcttgtgtatccatagcttgattcatgtgtttcactctatgatccttatgaaacagatttgcttgtattctgagaggagctgtctgcttaacaacttgcctggctcgaggggcttactaatgccttttagctccctgctttttgactctctttacaactctccttagaacccaacaaaaagagatataaaataagtgacataaaaatgtgaagtgcttaaaccatttattttacattgctgacttttttccatgtatctttcctttctgattagtacttaaaatcaaggcagaagcaccttaaagatagaaatggctaaatattcttgaacctttcaatcgtaggatgccagaacaggcctctagcgtagaaaatgtctatactgagatcaaagagtctcccctagagcagagtttgttgtattctgagtatgaggagagtaggacagtgtgatgaagctgcagtggagtaaatggtttttggtatcacagtgctttacagaacacattaaggagtttgggttttgtcgtgagggtgtggggagccactgaattatttgaagcaggaaagtgacataatataatttgtactttaacaaaattactctggttgctgcttgtaaataggctggaggagtaagactgggagcagaaagatgagttggtctcttgcggtagtcatggtggcagatgaagatagcctcaggctaaggtaatggtggtggggttgagatatttagcaagaagaaccggcacaattggatgtgggttatgaaagagaatgtgggaatcacaatgatatccagattcctgctttaggaggtgccattccctgaggtggggaatatgatggaaagaagcttagctggaaggggttggggagagatggtaagttcaggtttggatattctgcgtttgaggtgcctgtggacatagcaggagagtggtcaatatcagctgggtaactggaaggagaaatctgggctagagctagagacacagactggagctgaattgtgcttttagaaaattaactggaagccaaagagatgactccttatttgctgataccttgcagcaggtctatttccagtgacaaggaggcaagtttgaattggttagagcctcattcacagttcttcaaatgttcttgtcaagtatttacttgctactaaggaggatggcttcaaccttccccaggaccattttccagcatccttcagcatgtttggcttaggaccaagttcccaccctcctgaattttacccttgctggagacacatgcacttgatacagttaaagggcaaaacaggcctgatggggaggttccaacgcatttgcgttgcagaccgtaggtgttagaatctaactcctagttttctactacaacttcaaatgccaccctcctcactaagggtctaaagccagagtgcggatgaatgaatcaagcctttctttctgagtaccactgtctgaagtcatgctgaggtcaagagacattcaatcagaagagcagaccaagtggcttaaggtaagtgcagccccgggttctctttgctctggactcttttttttttttttttttttgagattgagtctcgctcttgtcacccaggctggagtgcagtagtgtgatttcggctcactgcaacccccgcctgccgggttcaagcaattctcctgcctcagcctcctgagtagctgggactacaggcacccaccagcatgcccgtctaatttttgtacttttagtagggacagggttttgccatgttggccaggctggtcttgaactcctgacctcaggtgattccccccaccgcctcggcctcctaaagtgctagcattagaggtgtgagccactgtgcccggcctgctctggactcttaatttcactcccctagaccattagttggctgtttcttgcattaaaccactcagatctctctttcatttccttgtaaactggattccttcgtcctgcagaagagatgtatattgtccacttttgtttcaacagagggcagtagagaacagcaaacagtttacatttctaagcccagaagaaataaaacaaatccatttacaacattctcctcaggtcaaggtacccaaaatatggcacactgtgcttcgtgtgttcataaatggggcatgtccttgtgaaagtagggcagatcccggagagtcagcgactcgtagacgacccttcgtcttgtgaacaacagtttagctatgtgtaactcatggaaggctttatggagaaggagtttgatcttgaaggataagtatgagttgggaagatagctttgttcacagaaagcagcatgggctcaaacatggcaatagcatggcaagcttggggaagttaagaataggattgggcagaatctgacaagaccgcaatatacctcaagactctaggtgctggaatcttcagtatggcacatagcatcctgtgccgtggggcagctgtgatattacatacactctcagatgctatgtgccatcccgaagtgtttgaatgtcactttgaagggtttaatatcatcctgaaagcaatgtaaaatcattgaagaattttgagtagggtggtgatctaacctattaggcaatttgagattttcttgtttgtttttaattgaggtatatcatggtcttgttaatcttttaaactttagccacccaggtgggtatacagtgatattgtgtttttaatgtgcgtttccctgataagtagtgacttattatctttttatgtgcttatttggtcatttggatatccttttttatgatgtttctgtttaaggcttttgcacacttacgaattagcttatcttctcattgatttttaatagttttttatgtattttagatatgtcttttgtcaaatatacctattacaaatattcctcctactctgtggctttcctactaacttttcaaatgatgtcttaattttttctttcttttttttgaggcagagttttgctctgtcgcccaggctggagtacagtggcgcaagcttggctcattgtaacctctatgttccaggttcaagtgattctcatgcctcagcctccagagtagatgggactacaggcacacaccagcatgcctgactaattttttaatttttatttaatagagatggaatttcatcatgtttgtcaggctggaactttttttaatattatatttcaataatgattataccaaaaatatattttgtattatttgagaaaatctgtaatgtatatttgggagattaatgaatacagttatgaaggtcactgaagcatgactcttctaaaacaagttaataatgcattctacagaaaaccttttagacattacaacctctaacctaaaaaatggaactctaaataccttttcaccatctcagtagtaatttctgacacatcactttcagaaggctcataagccaactcagatacaaccgtaatattaatgaggaaagcagttagtgtcaaaggaagaggattgaaagtagaagtgttatgaaactcctcttttacttttttgcatgctatcaaaatcactgccaataatatgaatgtcaggtcaatttccataggtaaatccgttaccttttacctctttaaaagaaaagttttgcagaagagggctgaaaatttcttgagccatttcagcacaaagaatggaagttcatttctcaccatgatacaactctaccctgctgtcatcttcattgtgatggtggcagaagtttagcagggtgcaagtgaccactaaatgacatcttttcatgaacaattgataaatctttttgaaaaccctatgaaagatgaattggaacggagcaagactgaggcaggatgactagttaaaggcttgtttcagcccttctgccattaaaggacacggaagctaccatctaagaagcagagagcgacctctcaccaaagagtctgctggcaccttgatcttgcacttcgcagcttctagagctataagaaataaacttgtgttgtttataactaggaggccgttgtactattattattcctattttatggttgagaaaaccaaggcatggggaaattaaatgacttgcctgaaggttttctactgctagtaattggcaagaggaaaagaaacgtgcaagaactttattgattggatgggaatggtagatacattaatttgaaggattttgtcttagtagatcttagagaaagaagagtacatttgggagaaataagtgaattttgttttagaaaaaaaaatatgcgtatgtgtgttttattttttagacagagtctcactctgttgcccaagctggagtgcagtggcatgatctctgttcactgcaccctccatctctcaggttcaagtgattctcctgcttcagcctcctgagttgctgggactacacgccaccatgcctggctaatttttgtatttttagtagagatggggttttgccaagttggccaggctggtctcaaactcctgacatccttggcctcccatagttctgggattacaggcatgagccactgtgccctgccaaaaaaaagttttgaagtggaaatgcctagtaggtagctatcattatattatatatattatatatgataaatatattaatgtatctttctagagttaagtagaaaagtgttggccggagataaagactgaggagtcatcagcatatagggagtgaagcaaggctctcattctcagcattattgacacagggggccagataattctttgttgtggggggctatgctctccactggaggacatttagcagctttcttggcctccactcaatagatgccaggggaagccctctccagttgtaatagccaaaagtgtctccaaacattggcaaatgtcccctgggagcggggggcaaaaccaactctgttgagaaccactggtgtagaggaagccaagaatgtagataaaatcatttagaagtagtaagacatatgcaggatcacgtttcttagccctttaaagttcattttcaacctctttgaacataaacatactttgtttaattttatcttaattttcatatctagtttgtcaagtttacaagtattaaattgtattataatgctaaaaaggcttttaaaattacacctctacctctccttccccctccagttctgatgcaccctttgagggggtctcttctcacttagaaaattattgatagagaattatgtagaggacagaaagctgaacaaacaccaatatttaatggacaggtgaagacagaggagtgttcagggagagtaaggggagtcatcagagggacaccaggaggggaaccctggtaagtcgtgatgaaacagatggtgaatgacttcagagtattttggccctgcaaactgcaagggtacatcgtaaaagactgcatagtgcccctggggttcataaatcacttcttagagaagtgagagaattctgagttctccctgggcttagagtaaaaaaggcatttccagtgatagggcccaatgcaacatttaggacaactcggggaagaaaactttgagattcagaaagaaaaatgacttcttctgccaagggagagataaggaaaactgcagatgaggagatggcctgaggttttggtcttgaagggaagatcagaaaacaaggtctgggttcccgtttattttggaagcaaagtattatcgtgcattagaaactaggctctgtactcttcttttgcttatcttcatatcttagaaaacttttcttttaaaatcttccagccagtttagttggccaagagaaagatttagatattttgacatttccgccaatataacttctgattatctcctttgtggctggctagagtggtggcactggcatcctagctctccaatcaaaatttttaaaataaagatctggccgggcgcagtggctcacacctgtaatcctggcactttgggaggccgaggggggtggatcacctgaggtcgggagttgagaccagtctgacaacatggagaaaccccatctctactaaaaacacaaaattagccagtcgtgatggcgcatgcctgtaatcccagctaattgggagggtgaggcaggagaattgcttgaacccaggaggcagaggttgtggtgagctgagattgtgccattgcactccagcctgggcaacaagagcgaaactccatctcaaaaactgaaataaaataaaataaaataaaataaaataaaataaagatctatgggcattttaataatgctctatctgtgattttcagcagtttaaatatgatatgtttaggagtgtgtgtgtgtgtgtgtgtgtgtgtgtgtgtgtgtgtgtgtgtattttagtctgcctatgcttctttgtccttcttggatctgtggtttaataacttccattatttttgaaaaattgttggccattttctctttaaatgtttcttctctcccattctttctctattctctgggatttcaattacatatatgttaggccagtttacattgtcccacagttcttgggtgttctgttctattttctttttttttactccttgaatttaagtttgggtaatttctatgaacccattttcaaagtactgatttttttttttctcagctgtatggcatctactgatgaccctgtcaaatacattcctcttctcttttactctgtttcaaaatttgctaacatttccatttgactcttcatatagtttctatctttctgctgaaattccccatctgtttatgtatgttgtctaccttttccactagagcctttaacatgttaagtatggttgtaattaatggtttgattttaaaattccctatttgatagtaccaacatctgaatcatcttttagcagtttctattgcttgcattgtctgttgacaggatttttaaaccttgcttttctgtgttggctcattgtttttattgaattctggacattatatgtaggacagtagggactgaggtaaattgcatttatgattggaaatgagcacccctcttattctggtaagctcttagtgtgggccaatctagtcaagagttgagctgggttcgggttttattattgccatagttaccttcaaattcttctagtgttatcttgtgcttgggtggaggcagcatttcagtagaccaagagacaccggtattcccggatggtattttctcaattttcctgcactaccccaactttaggactttctaaagtatgtgcctgcacctcagagattctctcttcagtggcagagtacttttgcttcttattcagtacttgctaggctgggaggtagggcagaggtttatctgttgtgaaattgcctttgcagaatatatatataaataaggagagaaatctggctgggcgtggtggctcatgtttgtaatcccagcactttgggaagctgaggcaggtggatcacctgaggtcagaagttcgagaccagcctggccaagatggtgaaatccagtgtctactaaaaatacaaaattagctgggcatggtggcaggcacctgtaatcccagttacttgggaggctgaggcaggtggagaattgcttgaaccagggaggcagagtttgcagtgagccaagatcccaccactgcactccagcctgggtgacagagcaagactccatctcaataaataaataaataaataaataaaaataaaaaataaacgaataaagagagaaatctaacatgactgactccatcctgcttctaacccacaggcgagttttttttttcttattctagcatggaggtcaaaatagctatgagtgacgtttatagttaaactttgagtcaagggaaactgatctccctccttgttcaagattgaaactgcattcataagacaaggttaaaatacggtagggactttaactttgctgaagaatagactcagttaaacaatgacctgccattgcttagtgtgtcttcctcacttccttgctttccatgtgtccttacagtagcatgttgcttactgcaccagagtcacgtaaccggggattgcaaaatttataacttccccaactactcctatagataacatcactattgtgaaccctgaagaacgagtcttcgaggtatttttcagattcaacatttcagtagaccaagagacgccactaggtcctgagatccacccactcctgggaactgacttggctgcgtgaagacagctttagacacccctgtaatttcatccccagccaatcgattgttccagtttccaagcctcctgcccaccaaagtacccatgaaaaaccttagtctctgaattgtcagggagatgtgtttgagaaattgctgcttgctctcttcacatggctggccctgtgattattaaactctttctttgctgcaatagccgctgttcttattgattttttcagggcagtggctaagaagaacgtgtggggctgtgacagctgttctagtcccgcctcagttttagtcgggccttctgtccctggatcttgaggacagggctttttcagtgatcctagatctcacccaatggtagaagacctgtaatcatctaggctcgggatggtttccagccccttccccaagggtagagagatgtttgttttttgttgttgttgttgttgttttttcctgttcctttcctccaggtgtaatgggctcttttcctgtgccctgggcccttcttccagtgatttaagacatttgttccttagaaaaaaggattcaggtgggcttcatgcctttcccagaatgatggctgctccattacctaggtatgtattccctggccacaagcttttcatgagctctggtggaggcccatgaagatgcttcaaatgcgtaggaatggcccttgtatcatgagctctcagttcttggccacatctggctttcagcgatttattaaaaattttagctgaattcttctaacccatttgaatggtagccctgccttccttccacgctgtcttacaggtgagcctgtgctcatatcctagccctctttagaaacacctgtcttttcttagatttcagggtatttggttgcctcactacctcagcactctgatgggttcaagaaaagttatcactttgtgtattatctgttttttttcaggtgtttctaattaatacaggtttttttggggggtgtttctaatgaaaacattttaatgaggctggttttcacagctgtttttataccacaaatcaaaatggccaagtccaaaatgaaaaatcaccagaatggcagggcataatgaatttaagcacagaaattagatgaagttatctgtttctcacatgacttgataatctaaaaagcagaaagtaaaatggtatgttttaaaagttatcatcaaaagtgtccttgaggtcggcactgactgtgtcctgatggccatgcaggcaggagttgtgctatgtaggtaggctctgctatttgctcttcacacctctggttagtttacaatctctccttgttctaagttttcaccaaagcctgatactggcttttgtttcccttgaggctatgttgtttctcatataaacatgatttccattttatgactgtcctaacccttcatggtgcaagcctgtttctctgagctactatattcttcatatatttatgttattacttcttactattcagaagtaccttaatattcagaactacccttcaaattggagggctcttttctgaccatattctcagctgttggacaggggacagggaccgatcatgctgggtggttggaaaagcctatgggaggccaagtaggggagacctactgccaggactatcactccaagctcgattcttgggccttccaccttcacattctagaggaaagcatattgccactcatccaagttgtgtgctgtgattgctagtgaaatctgatcagctccgggggctctcagctcttggctgtcaatgcagggtgatagtgggctacagggggaggaggtaaagaagagagattatgcagatatgtctgaaatcacaatctttctgattagatattttggctctataatcaattgtttcttctaacactcacacttttcctcaatttttatttatttatttatttatttattttgagactgagtcgcttactctgtcacccaggcaggagtgcaatggcgtgatctcggctcactacaacctccacctcccgggttcaagcaattctcctgtctcagccttccaaatagttgggattacaggcacgtgccacaacccctggctaattttttgtatttttagtagagatggggtttcaccatgttggccaggctggtctcaaactcctgagctgaggtgatccacctgcctcggcctcccaaagtgctgggattacaggcatcaggcgtcgtgcccagcctcaatttttaattctacgactttctgctctaattcaggtgaagcacaggataggtttgtattgtttttatatctgtctcctgcatgtatcctatctttcccattgtaatgagggttcctcaggacagagaccactgttcttctcatttcttcatttcttcctcccatccatccccaccccatctttcttacctagcagagtcaacattgggttagagcactgcatatgggttgagtaaatcagtcactagttgatccccatgagttattgctttcctgctcagaatttgttgctattgccactctcagtatcatttccctccagtgattcctgaagacctcattttacttctgtaattctgccagggaccaagttaactgcagcctgctcttctgctccagtcacagtaaactcttctcctagggtctctactgagactggaggccacaggaaagaacagatgctgagcaggaacctccactgtcctctcgtacaaaatacttttcccagtttctagaacgataaaccgcgacccgattgaagggcttttccataagactactcaaccagcagcaatacttaccttcatatttgcaactttactgaaataccttggtcagaggagatctccttttaatttttattgtgtatttatttagtagaggcagagatctcctttatttacattccaatcacttttaggatctgtcctgccttaacaatctgccaataaatgcacaaagagaaatggatgatgggaacttgatggtggcaagatttgtttcttttttcttttttcttttttcttttttgacagagtcttgctttgctgcccaggctggagtgcagtggcatgatcttggctcactgcaacctccacctcctgggttcaagcaattctcctgcctcagcctcccaagtagctgcgattacaggtgtgtgacaccacagctggctaatttttacatttttagtagagatggggttttactatgctggtcagactggtctcgaactcctgacttcaagtgatctggctgcctcagcctcccaaagtgttgggattacaggcgtgagccaccatgcctggctgacacgatttgtttcaaactggccctggacccggcaccctcccttctgcttctgactcctcacacatcagtccttcttctttggatacctgattaatggacatttccggttctcgacccttctgctttctctccaggggatggcttacatcttccttcctggctagcacctttttagggtggcacttacagtaagctatctctttgtcctcacccttctgtgtgttgccccagagatgagcctgcccaggggttacctaagatctcaactctcttctgtccctgacaggttgtggcagactgggcaccctcatactgaaaatcatcattgaagagagagtagaatctggagcttcatagaggtggaaagttgtgataactttccttgcccatcatgagcgtcatagctgacactcctataacaaaagatgagttagcaagagaaaagtttgtcaaagttttattttattttatcaaaattttacatgatgcaggagccttctgaaatgaagacccaaagactcagggaagactctgtttttatgcttaggttcaatgaggaatgcctagccctgtagaaatgtgactggataaagggtagagtctgatgctaacagactgatggggaaaacttagcaaggcctgtgtgtttagattcttcttggcctgtgtaccattccttcctcctgggtgtggggcagtactcctctgaaacgagggtctttaatgacttttctcagttgctttgcatttgcttctttgtgaaagatcagttgactctattcatgtgagcctatttgggggctccctattctgttccattaatctatttgtctgttctttcaccaataattggatactttttacaagttcttcctggttctaaccaccatgttcctaatgatgataagcattgactaatttccaattttacccagtgttgccagctggggcacagaaacaataccccaatatatggcactttggcctgctgagtgctttgaactaagggagattggaagacctcagaagcaaggtctctctgacattctcttgcccttctgtcctttacccttccttctcccctgaagcaagtcatagaaaccaaaatccctcttccccaaagcaagccataaaacttagaaatgttactctctccctcctccctggctgaagtgatccacccactttggcctcccaaagtgctgggattacaggtgtgagccaccactcttggccgggtatttgcatttctaatgggttgttagagatgatgatgctttaacacaaagacctgaattccctgaggaggtgtggctgatgcttagacctggctgaggcctctccaaccagagcctccatcagtcaatcatcctttttgtttgttttcctggtgcttgccttctctgccaggcttccctctcctttggggttggcagctgactgtagtgcctggctgtctcagcttgtggggaagtggctataaggaggaaactgtagagaggattgataaaaacaaccacagggattcactgagcctgtggtcaggatattaagaggaagagaaacaaaattcaaccaagcagaacaaaaagaaaggagtacattctgaatcaagaggctggaatctgagagtatgtaaaattggaaccatttgagtttataacattaatctgccttcccaaagtgggtctataaacactagtcccaactggaagcagagactagattcttctagccttttaatgataataatgattaagactaaatttatatggcaggttctgtgtttagcattatttatggattttctcatttaatcttcatgttataaggtgagtactaatgtaatctccatttcacagatgagacaacagagcttacaaagcatgaataggccaggcacggtggctcacacctgtaatcccagcgctctgggaggccgaggtgggcagatcacttgaggtcaggagttcaaggccagcctggccaacatggtgaaaccccgtttctactaaaaatacaaaattagctgggcgtggtggcacatgcctgtaatcccagctactcgggaggcagaggctggagaatcgcttgaacccaggaggtggaggttgcagtgagctgagatcgtgccactgcactccatcctgggtgacagagcaagactctgtcaaaagaaaaaaaaaaggataaataagatatccaagactgcacagctgataagagacaagatgaggctcttgatctgggtctgtctccaagcatcttcattatgggttctcatgatttttgagttattcatacttttccccttaccagaatacacattttatataaaatcgtccctttcaaagaattctcctttcttttcttccttagagaaaagtcttgctctgttgcccaggctagagtgcagtgacatgatctcagctcactgcgacttctgcctcccgggttcaagcgattctcgtgcctcagcctcccaattagctgggactaaaggcatgcgccaccacgcccagctaatttttattttttatagagacagggtttcaccatgttggccaggctgctcttgaactcctgacttcaagtgatctgcccacctaggcctcccacagtgctgggattacaggtgtgagccactgggccccgcccaagaattttcctttctgactgacatatttcagttttaataaatagtgtgcccctctattttaaccattttgttttagaaatatctccttgtattttgtgctttccctttcccagccgtgatgggaaaaagagactcatttctgttttgatttagtgtccttggaaatgccctacctgattctgtgtctatctcctttaataagtcatctaaaagacattgtctggttcttttgtctcagtcaaatgtctagtagtggtatttggatcctgagacaattcagggaagtagcatgtgcactgtgtaggacttcctgatcatttttaaatcgtggcacagagaaaaccacacaagtaaagttataaacaaatgaggctgcttacagccaggggcaactggccctacctggctattcctaggcctgagagccactcattagttctgtgtgctggttactcatacaaggcatgtaggtggtccctgcatactgtttgtgaagctcatttagtgttgtagaaaacctaagtctttagcgtcaggcagacttggtttcatattctgactccaccacttattaaccatgtagctttggacaaatcattttaacttctctgaatctaagttcttcatgtgcaaatgagggtgataatacttatcttctgggattgttgaaaattagaaataatgtgagtctagtgcctcctccatagtaataatgtgaaaggaaaataaaaactcaggattccaatacactgtgccaaaagaaaaaacaaattaaactgaaagctgagtcgtgcaagatactgactttcctttggatcctaagcagatagctacagagaaaagattaaaaatctccgtagatggccaggtgtgttggctcatgcctgtaatcccagcgctttgtgaggccaaggtgggtggatcacttgaggtcaggagttcaagaccaggctgtccaacatggcaaaacctcagttctactaaaaatacaaaaaaaaaaaaagaaagaaagaaattagcagggcgtggtggcagatgcttgtaattccagctgcttgggaggaggaagcaggagaatcgcttgaacccgggaggcggaggttgtagtgaaccgaggtcacacctctgcactcccgcctgggcgacagagtgagactctggcaagaaagaaagtaaagtaaagtaaaaagaaagagagactctggcaagtaagaaagaaagaaaaagaaagagaaagaaagaaaggaagaaagaaagaaagaaggaaggaaggaagaaaggaaagaaagaaagaaagaaagaaagaaagaaagaaagaaagaaagaaagaaagaaagaaagaaagaaagaaaggaaggaagcaagaaaggaagaaagagagagaaagaaagaaaggaaaaactccacaggttactcgtttctaccttatcttacatgaagtgccaatttaccgagagcaagacagcacataattgactattcccctacctgctacttttcccttacaacacgtggattaccatactcttcctctttcccctccagcctgcttttcctctaaatattgaaaccctcaaattcatctttggagaaagtcacagaccacatactgtttctgtgattctgtgttgttttcttccaggcatgtccttaaccttggcaaaataaacttctaaattaattgccacctgtctcagatacccttggttttacagtaagaattcacatgcttacatagtaactattaattttggtttcttagtgtgttacctatatattgtatgcctttgtttctaatgatatttataaagtattgatgccagctcattgttatcacattgccagttaaaaaaaaaactaatttttaacctaaaaattagataagagctggagatggatctgggggtagaacgggggcagtagtaaaagcacgcgtcagagtgggtggggctgtcgaaggtttctgaagaccacagagtgtgataacaaggttttacagtgtcatttccttaagtattaaagtattacagcctgcttcctgagaaggcatttgggaaagagtccccagaaaggggccccaggagagattccagagaaactcgtgttttggagatgttgagggtgaacaaatggtaatgaggatgatgacagaacgcaagaaaagagaactagcattcaccggacacccacgatgtaccaagcactttgctaaccctcatattctcttttactttccaaaaacctgtagtactgtggttctcagccaggggcaattcatcccctggggaacacttgctaatatctgggggcatatttgttttcacaactgggagtgccactggcatctaacaggtagagcccaggagtgctgcggaacatcctacaatgctcagggaaggtcctcacaagaataatttggcccacaatgtccatagtgctcaggctgagaaaccgtgcttaaatggtaggcacaataatcttcacttttacagattggaacctgacactctgagaagccacctggcattcaacccgaaacctaacacagctccaaagcccatgctctttcaccatgccgttgcagtgagaacagggatggaaatgagggtggcaaaaatgaccaagatacaaaaccagggcacagattggtgctcaatagatacttattgggatattcattaaatagaagaatgaataagaaaaagaatgaatgagggcaggggaataatgaggatgagtgtggtcattctattgccatcctgacatacctccttgtccttgttccacaactcagcagtgagtctgggattatgacaatagagaaaattaaatgatggtaggtggcctggagtccccatgctcaatttcaagaagcatccagattccagggcctgggtctccaaatggaagtagaagtactagaagattgctggtgcacgctgtcctgcatcaccctttctcaggaggatagagactgaaacaggaggttctgagctgagttttggtgaccatttccctctttctcccagaggcccaggccagctgtggcctcagaggaagaagaagggagttgtttccctagtttctaaaatttctgtgaatttgaacatgggctacaccagatttattctgggaagctctgaatcttctaggagggaaagactgagaggaaagagggtggaaagggaggagcctgtgataaaacagaacatttctttttcacttcccctttcagactccagaatttgtttgccctctagggtagaatccgccaagctttgagagaaggctgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctgggtgagtcagggcccccaggagggagagaggaacgggaacctcagttggggataaccctgggcaaggatgaggggtggcatgggaagaccgtcaggacacccaggggagggaaggcaggctggtgaagatgaaaccctgatgactctgctggctttggaaagtcatccaatgtggcagagttcagggttttttcagtgtctttcacccaatcttactgaacacccagactcttgatgttctgttgctttccacatcagaacccgctctgagaaaagtctagtaacctatacttgaatgataaatgaatggccagagtgtttgccttctttgaaatttatgcttcacaaaagaccaaatcttaggcaggagggccagtgctgccttgggtaaggggtagggaggaagttgtaagatgcatttttgggaggaggtggcagtggccattctctgtgcccctgaaaccactttgtgtagcagaagcctattgtcttcatgtgtaagaatattcccctaggcagaagcacagggagatctgggttatccagggaaaagggactctgagaatacaaaaacctgggtaagtctggagtcatctgttgtgggaccagagaaatcatgcatgctgcttttgaccacacagaccatgatggggaagtactgcatctgatcagcaagagagacagggtctttggccaaaatggagggctcttttctaaccatgttctcagctgttggataggggacgacgactgattttgctgagtggtttgaaaagcctaggggaggccaagtaggggagacttactgccaggactatctctccaagctcagttcctggggcttccaccctcacattctagaggaaagcatattgccactcagccaagttgtgtgatgtgattactagtgaaacgtgatcagctctgggggccctcggctcttggctgtcaatgcaggatgatactgggctacaggagaaagaggtaaggaagacagagtattcccccatgaataggatggaatggattaaagtagaagagaaagtaaagtgaactacctcatttgtcatgtggggaagttcaggcctagagaggtgatgtgcttctctaccacctgggcaagactcctgggaaagatctttggtattttttcccatttgccttttactaagtcatcaaagatttaccccattttttccattcttattggggctgccacatttacgtcttcatcacttgataactcaatttttatagcaccctctgatggggtcttgattgatcctgtctcccctcccctgcatccatgctgcccaccaaggccacggcatcttcaggtccagctatggctgtgtcagtgcatttaataaatgccttccgtgctgctccattgcccactgcaaaaactctaattctgccctgcacactgtgttctccattgcaccccacatgaatcttcttctacagccaggcagtatgtacactgcactttctgtttttaccacctttgctcctgctgactctccaaattctatgtgcaggcactgttctaggacttggagacttatcagtgaacatgactgacagccttcctgaccggaaatacgaggtcaatgaacttattgtgaagcaataagtacaccgggtgggaggatatttggtatttactactatttattaactgtggaatggatacataattggtgacttctctctcctttcctcatcttttccttttttttctctcgctcttcctcttcttttttactctctctcccactacaccgtcccccttgccaatcttacatactcaggtttttagctaccacttctatgtcaataactcctaaacctatttctcttgcttgcttctgtcaagtataattttatatttccactgctggttggacacctctaaaatgattctccagctcaaaaacaaagcatattcaaaatgcaacttatcatctcctccttacaaatgttctcttcctcctaacatttgtatttgcgtaagcgcagccacccttttcctagttatccaacttaaatcacccccacagtctattaaatgccaacttctctctgccacttaaatttcttctgcatctgtttcctcttcttcacctcctattgtcagtacaactttgggctctcttatctcccacctagattcaaccagtgaatgatttccagagcaatggcacatcaaattaatatggctactgctctctttgaatttatattctactgagggatataaacggtaagtaaacaaacaagaaggcataagtacaaatggaaaagggctatgaagatgtaaacggggtactgtgataagattagttgtggggaagagaagagagcagcccactttaaacaggatgttatgtaaagagttttctgagggggtgacatttaagctgagactttcaacatggtaaggattcagccatttggtgatcaaggacgcatttcagggtagagggattggcatacagaaaatccccaaatttgaagaatgccaggaaggccagtgttaatgaggctcaatgagtaggtgaaaagggatctgagctgaggctggagaaggaagcacggacccaatttgatagggcttgcaggccatttccattttattttaagaccaaagaaaggcaactgaaggcttgtaagttggggagtgatatcatctgatttcgttttttttttttttttaaggaactagcttctttatggaaaatggattgtagggtgaccataagaagtgaggggacaaattaagatatgggaaaaagctgatggtgacttaaactgagtagtgtctataaagggggtgaagagaagttagtgggtgcaagatctaagttggaagcaggatcaacaagacttcctggtgtggaagggactggattttgggagacagagaggttaaaagatggcttgcaggtttctggcctatgtagctgggtggataacgaagatacatattgacatggggaagacggagagaaacagaatgtgtccacttgctatgacaacatgaagccattggtgattttgacaagaaaagttttagtggactgctgagggccgagtccaaattgcagagaattagacagtgaatgagaggagaagaaatcaggacagcctatgtaagaaaaacaatggagaaatttagttttgaaagggatgagacaggccaggcacagtggctcatgcctgtaatcccaacacttggagaggccgaggtgggtggatcacttaaggtcaggagttcaagaccagcttggccaacatggtgaaacaccatctctactaaaaatacaaaaattagccggatgtggtggtaatacaaaagttagccgggcgtggtggtgcatgcctgtaatcccagctgcttgggaagctgaggcaggagaattgcttgaatctgggaggcggaggtcgtagtgcactgagatggtgccgctgcactccagcctgggtgaagcaaacaacaacaacaacaaaaaccgagagaaatggggcagtagctggaattatatgtggtgtcaaggaaaagtttttttttgttttttgtttttaatggaagatactgaaataaatttaccattgatgggaagatccagctaagagagaaactggtgatgcagaggagaaagtgaataacagaaagggaaatctttgagaggattaaagggaatgggatccagagtacttgctttgagactgaccatagacaggaggagagatgctttctccagtgaaatgcgaggaaggagaagacaggtagagatgcagaaaagactggtagatttagtcgggggacgatgtgagatcttctgtgtaacctcttttgttttctctgtgaaatatgaggaaaggcatcagctaaaaatgagagaggactggaggcagagggtgggatgagaaagcttggggaatgaggaaaagatgagtgtcactactcagagtagcagagcaaatttcttggaaaaaagtgccacaatggcagttcagtgtccttttgaatgcggtgatcgcacatttactgcgtcaacagtttgccttcttgtgtggtaatttcaataacacgcagctgagcaagtaaaggcatggcgaatacaggtgcatttggtagagacagagaaaggcaacgaagttaaggggatttgcaaggaggtaattataatgatgcctcattgaattcaagctagatgggggagggtgggaggtaaaggcaaacatgtgctcaaggataggcagtggtaagatggatgctttggggttcttgataaggtcaaagattattctggtggctgtacttgagcagagaaagttcatctccaaagaaagaaagtttactgatgatgagcagttcagggaatgaagaggccagttgtttgatgggttatccacatattctggatcactacagtcatctcttttttttttctttttctttttctctgacctcattcttccatcacaattagtttctttcttaattaagctctttggcatttgccctgttccaatctatttgacactgcactttcagccccaatttgaaaattctaagtgacttcccactgtatactgaaccaaggagtgaacttataaaaaaaaacttaaatttatttgaaattcaccatgtgtcatgtagcacactaaatgccttctctggattatctcatttaatcctaacaaccaccctatgaggtagatactgctgtcattatcttcatttacaagcaaggaaactgaagcagagaaaagttaagtaatttgtgaaaggtcacttagcagtagcggagtcagcatttaaactcagtatgtgctttcccccactgccacaccacctggcactaggagccctccagagtatgacttctaccttgctttcctgctttgtccctcattattggaagtgcttgaggagagaccagaaatcaagtagaagttgggctgcaacttgctgggaatgttgccaagtacttgctgctccttcccatggaataccttttccctctcagccaaaatcctatcagtcctggaaggtccttgatgaacctgaaaggtcccatcttctccataggattcccctccttatgaaccccaaaccctcccaaacacagagccctgggatcttttctttctctgaacctccatagcattttatccaaattcctctaatgtcatctcttttacatcagattacacatgtgcttatctccaccgttagattcttgccttcagtggaagtagggacttaacgttcttttcccttaggtgaactcagcatgcattgcagggcagtaggaagccaatgcaggtttgttgattaattttggatgcaaaggaaggaagtgattggtccaagtgtatatttcgagatattggagcatcgggaccagaatccagttctgtaaactttgaagccaacactttctccacattgctccctttttacctcttggttctgattccatttccttccgtacttttgtccctgaaaatatacatgcacttggaagcttcttgactttctctcagcccagatgcaagagaaaaccttcacccatggacagatggacacacacacacatacacacacacacacacacagagctctgattcacctaaggacccagctttgcttctttacccaataacagcacccacaaatctttatctaccctagcccacactttgcctccactacggaagctcttttcttaacccagtggcatccccctacccctgcatgaagtcacagatctagtgcccttttgcagtctcttcttccttttatcagatatttctaatagcaaaaatctggaagacctaaatgccaagcaaaagagttgttaaataaatcacaggacagccaaatagtaggatatagtgtagccatttaaaatgacaacatgggcggggaacggtggctcacacctgtaatcccagaattttgggaggctgaggtgggtagatcacttgaggtcaggagttccagaccagcctggccaacatggtgaaaccccttctctactaaaaatacaaaacttagctgggtgtggtggcgcgggcctgtaatcccagctcttgggaggctgaggcaggtgaatcacttgaacctgggaggcggaggttgcagtgagccaagatcgcgttattgcactccagcctgggtgacagagtgagaccctgtccccccacaaaataaaataaaataaaataaaataaaataaaataaaataaaataaaatgacaacatagaaacagattcatcttctagaacttgcattgctcagtgaagaatcaggttaaagaacagtttttagagtatatcctcatttacacttatgtatgtctgtatgtgaacagcgtgtgtctgtgtgtgatcacagaaagaaatccaacaggatgtatgccaaggtgataatattttgctcctgcgtattttctatttttctgtagtgatcatggattacctgtgcaatttctaccccctcccaacaaaagaacaaatcttgctctcaggataaactctggcaaaattatttatactgatgcataaatcatatgtaaagcccaacagagacctctttccagaggcatatttattttaatcagtcaagaggggtaagccaaaggaaaatgccacaaaacaggtggaagagggtgttatatacttttatttcatttttgtatgttactgggagttctcagtccttttaaaagtgcagctcatccaggcagtcccaggggatatggccacgagggctgtgctgtaggtgaagggcgctctgggcctgggcagtctctgggccaaagtgggcaggtgtcagttcagacactccactgtgggctgatctttgctttctgtcttacagctcctgttgctgggacacctggtaagtactccacccacagcctttccttccctcgggtccccttttcctctcctcccagtgccctgtctggaggtgctctaaatgcaccagcaactgagcccagtaccaagtcagggccaggaaagggtaattgctcccgaaagatcccctctccctcttccactctcctccttccttttcctccttccacggaggcaagtggtaggcagccacggtgttcaaatgggggagctgtcacagaaaatgagaactctgatctctctctcaactgccttccgctgtccaaataaaaccaagggcttcctctctccaaataaaattcaggcacatgcaaaatcacatggcctgcatatgttgtccccctgtgttgctaaatccttgactgtgcatgtttctgagagctccaaggcctgttccctgacagagtggtctctgcatacctctggctacactttgccgggcacttctgtgtttgtgccactcagcctccaccgctccaggactggccctccggcttttctccctctctctttatccttctgaggccagagaggctcgtgtatgcttgggtgtgaggacgggccatcttgacctcgtttttaaagtatacagaatgacattaggtcagaacggaaacctgatatccaactcccatgcctgccatctccaccagagcccccacttatcttcagccagccccaggggaaatttatccactagtgtctaaatgcctttgtttatcggggagaaaagttagtctcgaaagagtatgtatgtatggggtgtctgtgtgtctgtgctggtggggagaggttggtggggagagagagaaagaactggtgaggatatctcaggtaaagtatatgtatttcgagggtgtttctcttgcctgctccctccttcttccctgttgccctgtcggagtcctgggctccctggggccgttgtggtgggatgtatgagcaaaagcaactgccttcagttgcagaaccattctgggcctggctcggcttttggtgcccctagtaggcctacaggtgcttttttgtctgagattcagggcctctcaagctcctgggcttcctcttcttcatgctacctcctctctctgcccctcagcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctggtcagtggaggaaggccccagggtggacctgggagggccaggacggatgaaatctgctttcaggcagaggtttgcaggaaaggggggtggcctgcttactgggaagtatcgctgtgagttgcctcagcacatatcagtggttgtttttgcctcagttctgattgaacagaagaaggtttcaaggccaaaaacaggcagccaagtgtgagagaagcagaaggaaatccctactgcataaaacccatttccattttaatggcagaattgaaaagcacagaccacaactgaatcctagccctggaaatgactcactatacaacatgatgaattcatttaacccttgagtttccatttcttcacctgctccgtggggcactaacgcctccctcagaggcttctggtgagaatcagtgtttccctgcccccgccccgccctccatgccccttctccacgttctcactgtgctaggtgctcttctctgtctttctcttccaccagcctgtgggaaacctgagatgaaagtcgtgtcttacccatctttgtatttccagcatctgaaactgggcagagcttaataaatattttgctggagaggttgatgatcttacaaagctcccattgaaaggtggctctctgtaaagcaaagttacaatgagattgtgatgaacattgtccttgtggcttttcacttagtcccctcccttcacctgaagagcaaattttcctcaaaagtacacagcaaacgaatgacccactggtgacactgctgcctttagaccctgctggaaagaagctccacatttattaacattcccgaagtaaatttatcaggtagcattcatcaggtaacatttgttgcacattcatgacttttctactgtccacaaaggcatatgtccttatcatatgcggactcctcggtcacactggattcttccttccctcctcgacatggaagagatggcatcttagggtctcttgtgttcttcctgcagaggcctgtcgggcaggaaaaggctgcagctgccttcctgggagaaggaggagatgagtgtatcctgaacacctattatgtgctaggggctattgtagatacatgacactatcatgctcattttcacgaatgaggaaactgaggctcagaagacttaaattatttgcccaagagttcataaatgacagagccagcattagagtccaggactgtctgatttcagacctaagctgttccctctgcacatcgtgtcccaccagtaaggaagatctgggtctcagagctgagccaagacctcccgggtcctctgcggttttttgtgtctttcagagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaaggtatgcggagtctgccaagatgtaaggaggggagaagaggggatggacaagggctgaggtcacatgggcctacatggaggtctgagaaaggccacagcgcaaaattgggcactggagcaaagaggagtggtgtggaggcctggctaagtattgaccaatgagcaggagtaggggccagagcttggagccctcaggtgataggtgaccaggctgttgttccactttgaaatgcaggccccagactaaggacggcagcgaagcagagctccctcgttggtgcagaggttccctaagctcctgggcattcctaagaactgaggtttgcctttattcttctcatggctcatgttacagccattcactccagaaagcctggcacgtcatggaccgttcaaggctgtgctccatagagtaatgatgcctccagctatgcgaggctttgggcccacccttcccactgcccctgagggctaaggggagcccttccctctgttcctgcctgctcacaaatgtacctttattagtttggtggagaaacctcggtaagcaggaggcataagtccagccacagaaaccctgtgcagatgaggctggggatgtagtgagtgctgcagaagtgagtgactcagacacagaagagcttcgggtgacaagcactaggacatagcattggatgggggggaggtgggacaaggagagtactgcctgtcctgatgtctgtcttccctagctcccagctcttcaccgatggggatcattgtggctgtggtcactgggattgctgtagcggccattgttgctgctgtagtggccttgatctactgcaggaaaaagcggatttcaggtttgtagctcctcccggtccctttggttatcagtttccacttggcccaggccctaaccccagacattgccagaatccctctctttgggctagatacacattcagatctaggcccgtattgtattatagtcattcattcgtttattagatcattcatttgacaagacttgaacaaactagcttatgtgtcagccaatgcgtgagacatggtgggtgatgccaagagaagtccagtccctgcccttggggagttctcagcattgtgaggaagacagggtcattataataagatgggataagagcaatgatagggacatgaaaagcctaggatagaagtacagaggaggctccatagcccaacaagggctgaggcagttggagaaggtcttggggagagcagtgtagtgtagtgatggagtgcacatagtggggccagactgcctgagttcaaatctagttctacagcataccaactatatgacccaagtgagtcactccacctctctgtgcctcagctgtctcaagtggaaaatggggacactaataggacttacctcagagggttgccatggggatgaaagaggctgatgctcttacacagtgcctggtaggcagtaacagcacacaaacagggctgttgccattctggaggaggtggtgtgtgagggcagcgcttagctagggaaggaggaccctccaggcactgggccaaggcagggattgaagccgggtggggctcatatgggtgtcgaagggggagtagagagggtactgcaagccaccaagaaagaaagaatcctgctaacacctcacaaagcacttttcaattggttcatagccaacacctcagttactgatgataagtaaatacagagaaacagagagagagagactgagacacaggggtgtttttaaaaggcagagcaagcctcagacagatgccatggcgtggactttctgacactcctgggcatccccatgggtgagctgaattctgcctctggaccagcccttttccaggcgggagcagcctctgagcaggggagctgggggtgggaggacaggaaacatctgccagagtgaaggcctgagctggtcccatccaaccctggccctggtccttggtcctgaggactcaggccccaccgcctaatcctactaacctcctgtgtgcccctcccagctctcccaggataccctgagtgcagggaaatgggagagaccctccctgagaaaccaggtgagtacaggttgtctcagggattcagtgatggctcaccagggctgccggctggactggagccagggagaaggggcttgtgcaagttcagctgggagccagggagggagcagcagtgggaggatggctggggctcaaatcgcttggtcagctcttagtctaactcctgggcctaaagacgacctctctggagatgagaagagaaacaccagtcccagatacagaagagagggctgtgtccgaatttctggtaccaggaatctggtgatatttccagagcaagaaatcagagatactttggtcttcctgtggagctttggcagagctggcaaaggatggggttaggggctgtaagactgaggccaataggacgtgggaggcaggagtctaaggggaaaggaggaggaggcctggaaaccccttgatttgctgaggaatctgcctctgtggagggatggggtggagtggccaggctcagctgtctgtggaacactaggaggaggtttgggcttgagaaaattctgggggactaggggcactagtgggctctactctgtgggcaaaactcagttctgatgcccatgcactcaaggttgactgaattttggcctggttctgccctcatcacacagtggagccctgagcaagtcagtctccctgatggggttcagtctcctcactgaggaaatgagtgggtggccagggtgacctctcaggtcttctagatttgacattctgagaaccaggggccacccaagccctggcccaggtgggagtgtgtaaaggaacttccaggaggatgccaggcaacttccagactgtagttaaagtcagagcacaaaggaaaccagtgctttctctgggggcttccatgacagtaagaacaggcagaaaaaagaggctgtcaaagaccccacctcagatggctggagtatgattcagagcagagccaacagatttaagagcttgagcaaaatatcacttgttcagctgtgcttgcagcaaggtcgcatgtctgctggccaggcccagtggtgataggggcctgtgttcacaccagggccaaaacagatctggaaaaaacaaagtccaagcaactggattatccatcttgttgtgtggttctgtctgcactggcataagcacatttcacaaggcacttttgcagccaggcattggggctgcataaatggttttttaaaaatcctttcccaaaaggcaaagctgggttgctgggattcttgggaaatgtaatagaatgggaattcagaatgcggtttactgcagaatttacagcatggcaataaaggctctctatgttcagggggtgagagaagagactagatgcattgtctcagatgtctcctgacttcctgagaaatgccactttgcagatatggggctgcttttcacactggctaagtcagttcatggcaaaatatgagggaattcagtgtgtttcagacactaaccaaagtccatccttcctttctccttccgtccctcccttcctccctttctcactcactctctctttctttttaatgccatggagtaccatatttttcaaagttccaacaaagatgcactacatttagacaatgtggaaatggccctcagccttctctccctgaagtctgtggccagcaaaaatctggactttacttcactctgatgctgaacacccccctcccccacctcttccccaatatctcagatcccaagcctccctggtttgcttctaggaaagctcagcaattccctgaaaagaatgcagctcaagtgactgctccactttttcaccttggcctttgcggaaggctgtggctgggctaccctatgcatcgatcaatgaggtcatatttacccagtgcttggcctagaggcccaagacagggtcagcagtgcttgctttggctctagtttgggcgttggttttgcagcctcagcatcagcacaggcaggccctcttctccagcagtgctctggctgatatttcttctttttcccacagccaatcccactaatcctgatgaggctgacaaagttggggtgagtgatcccagccatctccccctcccttctcccctgttgccttttctgttgccttctttcctaggccctctctgtggatccttactgctggtttctgccttctctaggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaataaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaacattataaaaacaacattctgtttaccttttcaaggctgtattggttggagtgtagactgaactgcctggggtctgtttctcttcagtgatgagactcttaggaaggcaggaatggataggatagggggaggagaggagagatggggatttagaatgtagagtgagtgccccttttcttaaaactgaatacagtcacgcaccacataatgatgtttagttcaacaacagactgcatatatgatggtgatcccataaaattataataccatatttctattgtaccttttctattcctatgtttagatatatgagtacttaccattgtgttacaattgcctaaagtattcagtacagtagcatgctgtacaggtttgtagcctaggggcaataggctatacgctacagcctaggtgtgtagtaggccacaccatttaggtttgtataagtacctgctatgatgttcacacaacaaaattgcctgcatttctcaaaatgtatccccatatttcaacaatgcatgactgtactcttctgccaatgaccttgtattcttgtttccatgtcttcttctctttcctcctatggcaaataaaacactgttttgcaacacaa

SEQ ID NO: 352 - DNA, 2174 bp, Homo sapiens
  ref <308>: DATABASE ACCESSION NUMBER: NCBI / NM_004001
  ref <309>: DATABASE ENTRY DATE: 2014-05-03
  ref <313>: RELEVANT RESIDUES IN SEQ ID NO: (1)..(2174)
agaacatttctttttcacttcccctttcagactccagaatttgtttgccctctagggtagaatccgccaagctttgagagaaggctgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagctctcccaggataccctgagtgcagggaaatgggagagaccctccctgagaaaccagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaataaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaacattataaaaacaacattctgtttaccttttcaaggctgtattggttggagtgtagactgaactgcctggggtctgtttctcttcagtgatgagactcttaggaaggcaggaatggataggatagggggaggagaggagagatggggatttagaatgtagagtgagtgccccttttcttaaaactgaatacagtcacgcaccacataatgatgtttagttcaacaacagactgcatatatgatggtgatcccataaaattataataccatatttctattgtaccttttctattcctatgtttagatatatgagtacttaccattgtgttacaattgcctaaagtattcagtacagtagcatgctgtacaggtttgtagcctaggggcaataggctatacgctacagcctaggtgtgtagtaggccacaccatttaggtttgtataagtacctgctatgatgttcacacaacaaaattgcctgcatttctcaaaatgtatccccatatttcaacaatgcatgactgtactcttctgccaatgaccttgtattcttgtttccatgtcttcttctctttcctcctatggcaaataaaacactgttttgcaacacaaaaaaaaaaaaaaa

SEQ ID NO: 353 - protein, 310 aa, Homo sapiens
  ref <308>: DATABASE ACCESSION NUMBER: NCBI / NP_003992
  ref <309>: DATABASE ENTRY DATE: 2014-05-03
  ref <313>: RELEVANT RESIDUES IN SEQ ID NO: (1)..(310)
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISALPGYPECREMGETLPEKPANPTNPDEADKVGAENTITYSLLMHPDALEEPDDQNRI

SEQ ID NO: 354 - DNA, 191977 bp, Homo sapiens
aacccgctcgggtccccttccacactgtggaagctttgttctttcgctctttgcagtaaatcttgctgctgctcactctttgggtccacactgcctttatgagctgtaacactcaccgtgaaggtctgcagcttcactcttgaagccagcaagaccacgaacccactgggaggaaagaacaactccagatgtgccaccttaagagctgtaacactcaccgagaaggtctgcagcttcactcctgagccagcgagaccatgaacccaccagaaggccgaacacatccaaacatcagaaggaataaactctggacacgccgcctttaagaactgtaacactcactgcgagggtccatggcttcattcttgaagtcagtgagaccaagaacccaccaattccgggcacattttggtgaccacgaagggactatcacctattgccaagcggtgaggctatcgccaagcagtgagaccattgcctgtcactgtgcggcgagacaattgcttatcgccaagcagtgagtaccatcggacgcttttcacttgctattctgtcctatttttccttaaaattcgagggctaaatactgggcacctgttggccagttaaaagcgactagcacggccgccagactaaagacacgggtgtcaggctttctgggaaagggctctctaacaacccccgactcttcgaagttgggactgttggtttgcctagaaccagcttccacttttcctgtacttctgggctgagccgagggttgacagagaggaaagccatgcagctccggggtcctgacaacaagttggttgaccctgtggccatgagcagaactctcaaaggcatgttgcccaagcgagactctcgcccatctatcctatctatcctgatgcttgccccctgggtcctaatgcctgccagacaaacttcctcttgcctctcttctccgaggttagtcccacttctaaaaattgctacctgtctctggtgcttttctagtttctcctataagaatgatttctagaataaactccaggactctgttaccttctttaggcacccgggctcaccaatcagaaagacataatttttgcccaaagccccatcatagtggggactacctggaattttaggatccctcctcagactaataggcataacaaaagctattcctgaagctaggatatggggagcctcagaaattgtatccttcctattcatataagtgaggacaaaaggtgtcactcttccaaccctggagatcacttccctccctcagggtatggccctccacttcatttttggggcataacatctttataggaaaggggtaaagtcccaatactaacagaagaatgcttaggactctaacaggtttttgagaatgcgtcagtaagggccactaaagccgatttttctcggttggtcctccttgtggtctaggaggacaggcaagggtgcaggttttcgagaatgtgttggtaagggccactaaatccgaccttcctcagttctccatgtggtctgggaggaaaactagtgtttctgctgctgcgtcggtgagcacaactattccgatcagcagggtccagggactgttgcgggttcttgggcaggggttgtttctgctgctgcgtcggtgagcacaactattctgatcagcagggtccagggactgttgcaggttcttgggcagggggaaaaacaaaataaaccaaaaccatgggcggttttgtctttcagatgggaaacactcaggcatcaacaggctcacccttgaaatgcatcctaagccactgggaccaatttgacccacaaaccctgaaaaagaggtggctcattttttttctgcactacggcttgaccccaatattctctttctgatggggaaaaatggccacctgagggaagtacaaattacaatactatcctgcagcttgaccttttctgtgagagggaaagcaaatggaatgaaataccttatgtccaagctttcttttcattgagggagaatacacaactatgcaaagcttgcaatttatgtcccacaggaggacctctcagcttacccccatatcccagcctccctatagctccccttcctattaataataatcctcctctaatctcccctgccggaaggaaacaagcaaagaaatctccaagggaccacaaaaacccctgggctatcggttatgtccccttcaagctgtagggggaggggaatttggcccaacctgggtacatgtccccttctccctctctgatttaaagcagatcaaggtagacctggggaagttttcagatgatcctgataggtacgtagatgtcctacagggtctagggcaaaccttagaccttgcttggagagatgtcatgctactgttagatcaaaccctgtcctttaatgaaaagaatgcagctttagctgcagcccgagagtttggagatacctggtatcttagtcaagtaaatgatagaatgacaaccaaagaaagggacaaattccctactggtcagcaagccatccccagtatggatccccactgggaccttgactccgatcatggggactggagtcataaacatttgttgacctatgttctagaaggactaaggagaattagaaaaaaactgatgaattattcaatgatgtccaccataactcagggaaagaaagaaaaatccctcttccttccttgagcggctacgagaggccttaagaaaatatactcccctgtcacccgaatcactcaagggtcaattgattctaaaagataagtttattacccaatcagctgcagatatcaggagaaagctccaaaagcaagccctgggccctgaacaaaatctagaggcattattaaacctggcaacctcagtattctataatagggaccaagagaaagaggcccaaaaggaaaagcgagatcagagaaaggctgcagccttagtcatggccctcagataaacaaaccttggtggttcagagaggatagaaaatggagcaggccaatcacccggtagggcttgctatcagtgtgatttactaggacacttaaaaagattgtccaatgagaaacaagctgcccccttgtccatgtccactatgctgaggcaatcactggaaggtgcactgtgccagaggatgaaggttccctgggtcagaagcccccaaccagatgatccaacaacaggactgagggtgcccggggcaagcgccagctcatgtcatcaccctcactgagccccaggtatgtttcaccattgagggccatgaaattgacttcctcctgggcactggcatggccttctcagtgttaatctcatgtcctggatgactgtcctcaaggtccgttaccatccgaggaatcctgggatagcctgtaaccaggtacttctcccaccttctcagttgtaattgggagactttgctcttttcacatggctttcttgttatgcctgaaagtcccgcacccttattagggagggatatattagccaaggctggagctattatctacatgaatatggggaacaagttacccatttgttgtcccctacttgaggagggaatcaaccctgaagtctgggcattggaaggacaatttggaagggcaaaaaatgcccgcccagtccaaatcaggttaaaagatcccaccacttttccttatcaaaggcaatatcccttaaggcctgaagctcataaaggatgacagaatattgttaaacatttgaaagctcaaggcttagtaaggaaatgcagcagtccctgcaacaccccaattctaggagtacaaaaaccgaatggtcagtggagactagtgcaagatcttagactcatcaatgaggcagtaattccactatatccagttgtacccaacccctataccctgctctctgaaataccagagaaggcagaatggttcatggttctggacctcaaggatgccttcttctgtattcccctgcactgtgattcccagttcctctttgcttttgaggatcccacagaccacatgtcccaacttacgtggacggtcttgccccaagggtttagggatagccctcatctgtttggtcaggcactggcccaagatctaggccacttctcaagtccaggcactctgatccttcaatatgtggatgatttacttttggctaccagttcggaagcctcgtgccagcaggctactctagatctcttgaactttctagctaatcaagggtacgaggtgtctaggtcgaaggcccagctttgcctaccgcaggttaaatatctaggcctaatcttagccaaagggaccagggccctcagcaaggaacgaatacagcctatactggcttatcgtcaccctaagacattaaaacagttgagggggttccttggaattgctagcttttgccgactatggatccccagatagtgagatagccaggcccctctatactctaatcaaggaaacccagagggcaaatactcatctagtcgaataggaaccagaggcagaaagagccttcaaaaccttaaaacaggccctagtacaagctccagctttaagccttcccacaggacaaaacttctctttatacgtcacagagagagccgggatagctcttggagtccttactcagactcgtgggacaaccccacaaccagtggcatagctaagtaaggaaattgatgtagtagcaaaaggctagcctcactgtttaagcatagttgcagcagtggccgtcttagtgtcagaggctatcaaaataatacaaggaaagggtctcactgtctggactactcatgatgtaaatggcatacgaggtgccaaaggaagtttatggctatcagacaaccacctacttagataccaggcactcctccttgagggaccagtgtttcaaatacacacgtgtgtggccctcaaccctgccacttttctcccagaggacggggaaacaatcgagcatgactgccaacaaattatagtccagactcacaccgcctgagatgagctcttagaagtccccttaactaatcctgacctttacctatataccaatggaagttcatttgtggagaatgggatacgaagggcaggttacaccatagttagtgatgtaaccatacttgagagtaagcctcctcccccagggaccagtgcccagttagcagaactagtggcacttacccaagccttagaactgggaaagggaaaaagaataaacgtgtatacagatagcaagtatgcttatctaatcctatatgcccatgctgcaatatggaaagagagggagttcctaacctctgggggaacccccatcaaataccacaaggaaattatagagttattgcacacaatgcaaaaacacaagggggtggcactcttacactgccaaagccatcaaaatgggaagaagaggggagagcagcagcataagcggctggcagaggcagggaaagatcagcaagaaggaaagagagaaagagaaagtcagagaaagagagagaggaagaaacagagagaaagaaagagacaggaagtcaaagagacagagaaggagacagagaggaagaagtcaaagagaaagagaaagagagacaaaggagaagtcaaagagaaagagaaagagagatggaagtagtaaagaaaaaaaaacagtgtaccctattcctttaaaacccagggtaaatgtctatctacccagccaaggcatattctacttatgtggatcttcaacccatatctgcctctcagacagtttgcaagaaataatgaaatctatccttactttacagtcccaaatagactctttggtagcagtgactctccaaaaccgccaaggcctagacctcctcactgctgaaaaaggatgactctgcaccttcttagggcaagagtgttgtttttacactaaccagtcagggatagtacgaaatgccgcccggtgtttacaggaaaaggcttctgaaatcagacatctttcaaactcttatacaagcctctggagttgggcaacatggcttctcctctttctaggggagcagtggagggagaggtgcgggcaggaaccggggctgcatgcggtgcttgtgggccagcgcgagttccaggtggcatgggcttggtggaccccacactcggagcggccggccggccccaccggccctgggcagtgaggggcttagcacctgggccagcagctgctgtgctcaatttctcgccaggccttagctgccttcccacggggcagggcttgggacctgcagcccaccatgcctgagcctcccccaactccctgggctcctgtgcagcccgagcctccccgacgagcgctgccccctgctccacggcacacagtcccatcaaccacccaagggctgaggagtgcgggctcacggcacgggaccggcagccagctccaccagcagccccggcgtgggatccactgggtgaagccagctgggctcctgagtctggtggggatgtggagaacctttatgtctagctaagggattgtaaatacaccaatcggcactctgtatctagctcaaggtttgtaaacacaccaatcagcaccctgtgtctagctcagggtttgtgagtgcaccagtcgacactctgtatctagctgctttggtggggccttggagaaccattatgtctagctaagggattgtaaatacaccagtcggcactctatatctagctcaaggtttgtaaacacaccaatcagcaccctgtgtctagctcagggtttgtgaatgcaccaatcgacactctgtatctcgctactctggtggtgacttggagaacctttgtgtcgacactctgtatctagctaatctggtggggacgtggagaacttttgtgtctacctcagggattgtaaatgcaccaatcagcgccctgtcaaaacagacaacttggctctaccaatcagcaggatgtgggtggggccagataagagaataaaagcaggctgcatgagccagcagtggcaacccgcttgggtccccttccacgctgtggaagctttgttctttcactgtttgcaataaatcttgctgctgctcactctttgggtccacactgcctttatgagctgtaacactcactgcgaaggtctgcagcttcactcttgaagccagcaagactacgaacccactgggaggaacaaacaactccagatgggccaccttaagagctgtaacactcaccgagaaggtttgcagcttcactcctgagccagcgagaccacgaacccaccagaaggctgaacacatccgaacatcagaaggaacgaactccggacacaccacctttaagaactgtaacactcaccgcgagggtccgcggcttcattcttgaagtcagtgagaccaagaacccaccaattccggacacagtaccaagacagatatatagaccaatggaacagaacagagccctcagaaataataccacacatctacaaccatctgatctttgacaaacctgacaaaaacaagaaatgcagaaaggattccctgtttaataaatggtgttgggaaaactggctagccatatgcagaaaactgaaactggatcccttccttacaccttatacaaaaattaactcaagatggattaaagacttaaatgtgagacctaaaactataaaagccctagaagaaaacctaggcaataccattcaggacataggcatgggcaaagacttcatgactaaaacaccaaactcagtggcaacaaaagccaaaattgacaaatttgatataattaaactaaagagcttctgcagaacaaaagaaactatcatcagagtgaacaggaaacctacagagtgggagaaagttttgcaatctatccatctgacatagggctaatatccagaatctacaaggaacttcaaaaaatttacaagaaaaaatcaaccccatcaaaaagtggacaaaggatatgaacagacaattctcaaaagaagacatttatgtggacaacaaatgtatgaaaagaagctcatcatcactggtcattagagaaatgcaaatcaaaaccacaatgagataccatctcatgccagttagaatggtgatcattaaacagtcaggaaacaacagatgctggagaggatgtggagaaataggaatgcttttacactgttggtgggagtgtaaattagttcaaccactgtggaagacagtgtggcgattcctcaaggatctagaaccagaaataccatttgacccagcaatcccattactaggtatgtacccaaaggattataaatcattctactatagacacatgcacacatatgtttattgcagcactgttcacagcagcaaagacttggaaccaacccaaatacccatcaatgatagactggataaagaaaatgtggcacatatacaccatggaatactatgcagccataaaaaatgatgagttcatgtccttttcagggacttggatgaagctggaaaccatcattctcagcaaactaacacaggaacggaaaactaaacaccgcatgttctcactcataagtgggagttgaataatgagaacacatggacacagggaggggaacatcatacaccagggcctgttgcggggtggagagctaggggagggatagcattaggagaaacacctaatgtagatgataggttgatgggtgcagcaaaccaccatggcatgtgtatacctatttaacaaacctacacgttctgcacatgtatcacagaacttaaagtgtaatttttttaaaaaacatcacttttaggtggtatgttatctactgatgaagaggaaggctataatcacaagctccttagtgagcaatagggggagggtatctgatggtatagaaaggagaatggggtggcactagagaccaatttaaaccacttcacaattgggcctgaccccagctttggtttgaaaccgagggcaggagcagccaggcagcaacgtcttttcctgtcttcaagcacaggaaatcagttagattgacctgacatacttggatgataaacagtggcaggctttcccaggcagcattgtacttcttcccctgttaacacctcccactgtggaaaaatctaaacaaactagaattaacaggaatccaacatcttcttttctatagcgaaaagtttccttgcctaactcatttaggagactttttgggaagttagaaagttggaaaaagaaaagcttcacatcagtgcatagctgtttttaacttctatgtgttgaaaaagcatatctgatcaaaatttttacctattatgcatttgatatataaataagtatataaatgcacacacagacacagcaatgatggtgaacagtcttcatacaattatatggatgaatctcataaaatgctgagttaaagaaatcagaccaaagaacatatactgaaagattctctctatatacaaagttcaaaaataggtggaccaattcatggtggtgttagaaatcagaagagaggctacctttgtggggaggggacagtttaatgcccagaagcggtaaataaggaatcctctggggagtggtaatgatctggatgctggctacaggatgtgttggttgtaaaaatgcatttttttatatctagctttttccatgtgtatattatacttcaaagaagttcagttaataatttctcatgtcactgtagagtagctcagttagccccagcaagcctctggcttaatcttgttttaccttaagccatcagtcatttacaagtaggaaaattcacagggaaagttagagtataaaatccagaatgaaggtttactgggtaagagtctctccattttccaaagcccgtttatttcttgattccagttcttaagaagtctcagcattgtgtctttttcatgtatcttacaagaagacagcatgtgcttctaacacctgatacattgtatctaccagcacttggtaaacagaaaagaaccacatttttcttgtaggagaaatttggtgcctatttcctaccaggcaccaataagtgggaccaataggtgggattaaagatacagtagaaagtatttaaaacttgccagggggcaatagtctgaaaataagtaaattggtgctatagaatggaagttacaggcttctttcttttttcccacaagatctgctccttgagcccctagagacttttctgtctgttactgtttcttcattcctcatctgcagagccagccctgagaagtgcagaccaaagccagggaaggctctgcaaagatgtacaaatggaagtcaccttaataacctctgactgctgcgcataatacatttcactcaaaagaggggttaaacaatggaacagaatacagaggccagaaataatgctgaacactgacaaccatctgatctttgacaaaatccacaaaaacaagcaatggagaaaggactccctattccataatggtgctgggataactgtctagctatatacagaagattgaacctgggccccttccttacatcatatacaaaaaataactcaagatggagtaaagacttaaatctaaaaccaaacactataaaaaccctggaagatagcctgggaaataccattctggacataggacctggcaaagacttcatgacaagacaccaaaagcaatagcaacaaaaaccaaattgactaatgaaactaatgaaactctttagttgtacaacagatagtttatctgtacaacaaaataaactatcaacagagtaaacaacctacagaatggaaaaattttttgcaaactatgcatctgacaaaggtctaatatccagaatctataaggaatttaaacaaatttacaagcaaaaaaatgacctcattaaaaagtgggcaaaggacatgaacagatgcttttcaaaataagacattcacacatccaacaaccatatgaaaagatgtttaacatcactaatcattagaggaatacaaatcaaaagcataataagataccatctaataccagtaggaatgactactattaaaaagtcagacaataacagatgctggtgaaggttgtggagaaaagggaatgtttatgcactgctagtgggaatgtaaactagttcagccattgtggaagagagtgtggtgattcctcaaagaatgtaaaaccgaactgcctttcaatccagcaatcccattattggatatacaccaaaaggaatagaaattgttttaccgtaaaggcgcatgcatgcatatgttcattacagcactatttacgatagcaaagacatggaatcgtctaaatgcccatcagtggtagactagctaaaaaaaaaaaaatgtggtacatatacatcacagaatagtatgcagccataaaaatgaacaagatcatcatgtcctttgcagcaacatggatgtagttggaggccattatcctaagcaaattaatgcaggaacagaaagccaaataccacatgttctcatttataagtgacagctaaatattgagtacacatggacacaaagaagggaacaatagacatgggacctacttgagaatagagggtgggaggagggtgaggatcaaaaagtacccataggacactgtgcttattacctgggtgatgaaataatttgcacaccaaacccctgtgacacacaatttacctatatagaaaacctgtgcatgtacccctgaacctaaaagttaatggtgggggggtggggttaagctactttgtggtataaatctgagcattcatattaaaataaaatatttacctcattagagtaattaacatttattaagcaaagagccaagtaccttacacacatgatgtttaatctcacaatgatctttaatctcataacaaccgtccattgtatgtacatatgtggaaattgagccttggagagattaaatgcatggggcatgccatttgactagaaactggaagcatcaggatttaaactcagttctgaatggttttgtaggctttgttttttccacattatagcatggcctgccatgaagaacaggtcctttctggtgtttgtcttgtttggtttaagtgaagcaaatatttatttaaatattcaagatatgctgttaaatttttactcaaaaatttgagtacagtatggatcttctgaagccaaataactcttattcaatgcttagttgagaaattttatggagtagttctcaatttttatgtagttccactgcaaaggtaagtcttatggaaagattcactgtaattttttttcctcatttggacatcagctttttcttttcctcagacccgctgaaagataatttttaaaataaaaaccttgtttttatatcaagtggggacattttttccaaatgaaaaccgtgtattcattttatatgataaaatcaatgttattatttttaaaattttgatttaaaaatcattaaaaataaattttcagatattacctgaaattctaccatccagagataatagtgcttaaagatttgatatatagacacacacacatatatacatatatatcatcctaaacttctttgtataaatgtatataaagtttttaataaaaactaggagattaatgccctttgaatgaaaataaatacaatgtgtatgctttaacatcttgcctttactttataacatttatcacagcagtcatgagataatgatttacatggtcattgttagtaagctaatagctaagtgcatgaactctggagctagcctccctggattttaatcccagatctgtcactgaccagctgagcaatactaggtaaattgctcttgttccttagtttcttcatctgtaaaatagagataaaaataatatccacctcataggattggtgtgagcattaaatgagcatacgtatgtaggccacttaacaacaatgccttcacatactgaacacaaatatacgagctgttgtcttattgggctcatgtttttcctaccactaagccgcatgcatgcaaggaccatgttggttttgttccacattgcatccccaacctggtatacagtgtgcattcaatagttgttgactattattactagtggcatttaacaaatatctgttaaatgagtgaagaaatacccatttactgcaagtgtgtctaatattgatggcataatgggggaaactcaaactctggagtcaaacaggttttaaaaccttattccctcatcctcagttattgacgttttttttttggcaggtgtgtgtgtgggacaacttattgaacttttctgaatttccagcttcgcatatataaaatagagatagtgattcattcttgcaatgtatggatttgagacaattgtgtaagtttatcaataaatagtagctatttttgtataagtattacatataatatccaggccactgctttgcataacccaaaaggggcaccattcatgcagaatacaacataaatggtgtccctggagcagtgcagtataggaaccctgaggggacctacagtatactttatagttcatagattacaaattatccctttatcagagtctctcaaggttggatgtatttgaggtccataagagcaatttaggattaacagtagctgcagaaaccatctgcagtgatattctcattttaaatccgcgggaaagaagacagctataaacttgggacctgggtttaagcattttaaatgccaagttcaccattttctaaaacacaacaaatacccagtgagagagggagaagggaagtaaatgcctctgaataagcaagttaatgtcagtagttgtactgtatgcatattgatgaacaatagaggaaccaatgtccaatcagatgagcaggatatttggcaataacaagttgcctttgaggaaaaatgattttcttggcaagttctttatcagcattacaaagctaaaagctacgcttatcatcacttatactagcataccctgttgtgcaaatgctgtctgtgtttgcatctgctattgttgatgcctggtgcatgaatcaggactccagcccacaagttttcccagaactttcttatggccatcatctttaagtgtctggtgaacagtcatagtttggtacacaaaagggtcaacctgggggatggctagggtttgactcagtcgttacatttcaatagagcaggaaggggaaatggtggcctgtaacctcagggaattttgccagttggtccaccccactctctctctcctgctctgaggaagtggcacagcctagaacagcaccacaggtgagagaaatgcaaaccctaaccagagaagcagactctttgccagtagtaatagttcaggaccaccaccagcttttattaaaatttttaataacactcaagtattggcagaaagaaataatcttgggttaactataactagaatattgactcttcctctgtggaagaatcagccaatcacatttgtttacatcagttcccctgaagaagaaaaatacactgatgttgcagcaagacaaatttaagctagatgtaaataacttcctttagcctgtaatgctaggctaattacatattggaactattttttcagggaagaattgtgtagggtttcagggaagaattctgaagaaaatatagagctgaaatgatcttgcagctcactgaaactgcagggtttagatccacactgatactcgttctattatcactgtaatgaaggctgatggaataagtaaaaatgttttgtattagtatgtttttacacttatttgcaaggcataaataggttaggttttgatcttaatttaattctaacatgtattgtgcacaagctgtgagcagttttcaggagttaggtatctggccatgactgatttttcaggagttaatcatctggtagaagggtcatacacaataggaagatgtgtgtgacaggttgtgatcattactataatcacacagagagctgtagaattttaggctggcagggtggctcacgcctgtaatcccagcactttgggaggccaaggcaggcggatcaagaggtcaggagatggagaccatcctggctaacacggtgaaaccccgtctgtactaaaaatacaaaaaaaaaaaaaagccaggcgtggtggtgggcgcctgtagtcccagctacttgggaggctgaggcaggagaatggcgtgaacccgggaggtggagcttgcagtgagccgagatcgcatcactgcaatccaacctgggcgacagagggagactcagtctcaaaaaaaaaaaaaaaaaaaagtcatgttagatccagaggggtagcaactggggctgggctgtcagtcaactcagtcaactcagtcaactctgctcccccacaggagatgccagtgatgcattttcatggccaacattgtcagtcagcatcattgaattactcctgattatagagacacagctgcaaacgattccccattaaatatgatgtttcttgcaatgtttggaaggtactcctttttagtaagggaaatcccctcttctggcttgctgaaagttttttctttccattttaaaaatcgtgaattcctttttgcaatattgaggtggttatatggtttctcttctctaatctgttaatatggtgatttaatggttagaaattttctaatgtaaattccactcatattgcagaaataaacctaaactgagcatgaggctatattttttatttgcttctatatttggttgctatacagtattatgtttaagatttgttcacatatatttgtgaatgggattggactatttttccttcttgccgatttttatctggtttttaaattaaggatattttagacttatgaaatatttggcaaacaatccttggcaagtaattttttggggaatttgttttggctattttgagtattacccaatatattttaattaagttattcttaatgttttcttaattaaaaaaattacctactctagagatattctttatgtactccagattttgtctatttataccacttttcttttttcctcgatgagtgtcatagatgttcatctatttttttatcttctttgatcttctcttattccttgtttctattaacttctgaagtttattattttcttttttccacttccttatggtttattctttcaatttttctctaacttcttaagttgggtgtttaatttttagcttgctttgcttttttaggataagcattaaaactacaaattttccttgttattcttttgctgcaccccaaattgttgatatttctattgtctaatttctattcaattagaatactttaaagtttctttttggtttttaaaaactaactttttaaattgacaaataaaaattgtgtatatttattgtgcacagcatatggctttgaaatatatgtacattgtggaatggctaaatttagcttattaatgtatgcattatctcacatacttatcattttttgtggtgagagctatgtgacttttgaacttatgagttatttaaatatttttaaattattaagcatattgggattttaagtaatttacctttttattattaacttataacaagtagaacagttaacctgtatgattctacatcattgaaatttattgacatttgcttcatagtctattatatggtctacttttgttcatgttacatctgtagtagaattggctaatagttgagtaaagtacacatatgtctatgaaatcaagtgtaatccagagaaaaagagaaatttactgaatatattgttctaggtgctattatatgttgtcatgtttaatcctcaccacaattgtatgaggcagccataattaattccactttacacatgaggagcctgagggttaaaaaaaaagctagctctactatttgtaaagaatgaagcaaagatacaaatgaaggcccacatatcctataactagatatttaagcattttaattcaagctttaaaactgctaaataaaatgtgctccaatttctatattgacagacataccttcctaatgagctggggttcgaatttagaaatctttgatgcttcagagtccacactgaaatgtggaggcacatagtgagttggtccccagccttcagtccacccaccttctctttactaaatcacctttcacatacatgtatgaacaccccagcctccaagtccaaaccctaaacaaaatgggacacccttgtgcatacacagagacacagcccatcctcaggaaaacctggaaaagtccatacaagttctggaagcaagcttgggacggtttcagtagtgtggtctataagggaggcctcagaagacaggttttcttaattctgtgaacttctcccacagtagaaagggtgctggaggagggtcagagtgaggacttctaaagcatgggtcctgagtaggggccactcttgcccaagtctaagaagggtactagaatagcacactactactagatactagaacccagatacaagcacaggtcttctgaaattaataataataataactattaccattattataccagtagctgtcatttatttagtgcttattatttgccagtcactgttctaaattctttacatgtattatacaactgccatataactgccatatgagggatgtaccctcattgtcaccattttaccgatgagaaaactggcataaaacgtttaagtaacttgtccaagttacagagcttagtgaagccacaatgttgctcaatttgctctcaaacttcaaagggatgggaaggacacctaagtcatagagtctttaagaatcagagctagaaggaatcttagatgttatctagtcagcctcctcccattacagtccaagagaagatggccctgagttacttgtagctatttttgcatgtgaattgcaagtgaatatacattctactgaagataaaagatatttaaagatatcgctggatataggaacagtggttttaaatctctaggctttaacttttctcagaacaagaaatcctttttggttttaatctatatgcacatctgtatttttctcaattatcgggtagtaaaatataacttttcttctgtaatattttttaactttaatgagtgttcctcataatagaaaagtttggaaaccattgctatgggtatatactttctaaagggatagtaatttctctagaatattcatttaatgctccagaagtaattagcacaattgtgcaagtctgtgcatcatcaactatacattctgcctgtttactccaaatccacatgaaactgattatacagtcaaaggcgagcccagtggagaggcatttttggagacttcctggtacattgagacagggtcggccagtctgcgttagggtcttggtcaaaactgcatttctgaaactaaactcagattgctttcttttaaggggtcagaactgattcaaatctacatttttaaaagccttagatgtggggcttttcctattcccagtctccgctattggtctttgtgaatccacaggcaatttggccacatccttgactctctcttatattaagaattaaacagctaagttcatgcagaggaaatataacaaaggagggactttcctacaagatctttgaaaaatggaacatttgcataagtcatatttagccagaactgttgttttatattttcctttctgaatactttgttacacctcctcccagccaaccccccccctccctgaccccaactagtcagagaccaaagccttcacaatggtttacacttgaaccttcctggccccaccctcatcatcacgcctgaataattacattcactgactggtctcccctgcttccgtttatctccactcctaaaccctctgacaccttaatcttcccagaataccattgtgatcctgttccactcttgctcaagttttcccagaaactagagtacaaactttataagctttagagttgaaagccactctatctctttttcatccccaggtctctgccaaggcagtataacctgtccaacatctctaacttcaatacctttgtcttagatactagactctcctcctggtttctaattaaacctgatctaggatctaattttgcctctgaattctgttgccctttgccaagtgatctcttcctcctctgagccgcagcatctctgagcttgcacacttagcatagccatagcacacacagccttagcttgcagttcagggtgtttaccttccctccccttccagatgctggatccccagggataggaactctgcccttatgtgtccatagcccctggtagtatgtcttgcagtcgtacattttcagcaaatgtttaattggttaattgaagacaactgtcccatgccttaagcctctctttttgctaaacatgcctgtgtcctttgtcattgaacaactattttgatctattttcttcctgacataggggtcagttccgaggatgctgaaatcaagagacatagcttattctctcaaaattgctttcaagagtgattttgttgtgaattgagaactggctgcctacttttggactacccacttcagcaagagtgtttgaaaccaaatctattctaagtaattttttattcccttttctctatggcattagacacacagctcttttaaactacctttcgttatctattaaacagacattcagtaactctatagacactgtctagctatatgaacttagacaaactaatatctctgagcttcagtttcttaaaatttaaaatgaggacaataccatctatggccggggattaaatgctatgaggaatgtaaaccagatgtcaggtaccatctctctaaaatccagataaaatgaattaaaaatactggccgcaaaccctctctaagagttctcaaaattctcagagagcttaattttcatgctcaccatagcaccgattttcttctaaatattttgtttctaccaaaatattttgtcccaattttgccttttatggctatttcttcatatccactttcccaaactaaagaagcagccccttcaccttaaactcctccttcaaagcaacctaaatacaggtctgggtttgtattcctagtgggatgttacagaggttagtgtgatgcagaggaggagtcatgctgtttaaatccatactagtccccagaggccaggctgcttctgccacccctacccctcccgccacagagctcttcagcttctcacatttctagttcttctctctctactttcattaccttctctctttttttttttcttctcatgtgctcacgggagcagagaaaattaactcctctaagttttcttaacacagagtgccttaattacatattactattgtttgagttcctgccaacactacgtctgtagggtcacacctgctatattagaggcttatcaaaaaaagatagctttctcctaaaaagggatttggatgcctactaagataactggatgccaagataagtttaacctaacaaactttattattattattattattattattagagataggtacttattctgtcacccagactgcagtgcagggatgcaataatagctcactgcagcctcaaagtcctgagttcatgcaatccttctgcttcagctccctgagtagctaggactacaggcatatgctactctgcccagctacttttaaaaaaataattagggatggggtcttgttgtattgcccaggctcgtctcaaacttctggtttcaagcaatcctcctgccttttacctccctaattgttggagttacaggcatgagccacagcactcaaccaagatttaaaaacttttaaaagaaatcacattacttactgttatcatcattatggttactaccagtgttaaaacaattggtattgaaaacaccactaccagatcaagcttcaaaccaagatgtcaagtaaatattattgtcagacctctgagcccaagcctgcaggtatacacccagatggcctgaagcaagtgaagaatcacaaaagaactgaaaatggccggttcctgccttaactgatgacattccaccattgtgatttgttcctgccccaccttgactgagggattaaccttgtgaaattccttcccctggctcagaagctccccgactgagtaccttgtgacccccacccctgcccacaagtgaaaaaccccctttgactgtaattttccactacccacccaaatcctataaaacagcctcacccctatctcccttcgctgactctcttttcagactcaacctgcctgcacctaggtgattcaaaagctttattgctcacacaaagcctgtttggtggtctcttcacacagaccatgtgacatttggtgccgtaactcagatcggggaacctcccttgggagatcagtcccctgtcatcctgctctttgctccatgagaaagatccacctatgacctctggtcctcagaccaaccagcccaaggaacatctcaccaattttaaattgggtaagtggcctctttttactctcttctccagcctctctcactatccctcaacatctttctcctttcaatcttggcaccacgcttcaatctctcccttcccttaatttcagttcctttctttttctggtagagacagaggaaacgtgttctatctgtgaacccaaaactccagcactggtcatggacttggaaagacagtcttcccttgatgtttaatcactgcagggatgcctgcctgattattcacccacatttcagagctgtctgatcactgcagggacgcctgcctggatccttcaccttagtggcaagtaccactttgcctgggtggcaagcaccacctctcctggggggcaagcaccacctctcctggggggcaagtaccccccaaccccttctctccatgtctccaccctctcttctctgggcttgcctccttcactatgggccaccttccaccctccattcctcccttttctcccttagcctgtgttctcaagaacttaaaacctcttcaactcacgtctgacctaaaacctaaatgccttactttcttctgcaataccgcttgaccccaatacaaactcaacaatggttccaaatagcctgaaaacggcactttcaatttctccatcccacaagatctaaataattcttgtcgtaaaatggacaaatggtctgaggtgcctgacatctgggcattcttttacacgtcggtccctccctagtctctgttcccaatgcaactcatcccaaatcctccttctttccctcctgcctgtcccctcagtcccaaccccaagtgtcgctgagtctttccaatcttccttttctactgacccatctgacctctcccctcttccccagactgctcctcctcaggtcgctccccgccaggctgaatcaggctccaattcttcctcagcgtccgctcctccaccctataatccttctatcacctcccctcctcacacctggtccagcttacagtttcattctgtgactagccctcccccacctgcccaacaatttcctcttaaagaggtggctggagctaaaggcatagtcaaggttaatgctcctttttctttatccaacctctcccatctcagttagtatttaggctttttttcatcaaatatgaatacctagcccactccatggctcatttggcagcaactcctagacattttacagccttggacccagaggggccagaaggtcatcttattctcaatatgcattttattacccaatccactcccaacattagaaaaagctccaaaagttagactccggccctcaaaccccacaacaggacttaattaaccttgccttcaaagcgtacaataatagagtagaggcagccaagtagcaacatatttctgagttgcaattccttgcctccactgtgagagaaaccccagccacatctccagtacacaagaacttcaaaatgcctaagccacagtggtcaagcattcctacaggacctcctccatcaggatcttgcttcaagtgccagaaatctggccactgggccaaggaatgccctcagcctgggattcctcctaagccatgttccatctgtgtgggaccccactggaaatcggactgtccaacttgcccagcacccactcccagagcccctggaactctggcccaaggctctctgactgactccttcccagatcttcttggcttagtggctgaagactgatgctgcctgatcgcctcagaagcctcctggaccatcacagatgcttttggtaactcttacagtggagggtaagtccgtccccttcttaatcaatgcagaggctacccactccacattaccttctcttcaaggtcctgtttcccttgtcttcataaatgttgtgggtattgatggccaggcttctaaaccccttaaaactccccaactctggtgccgatttaaacaacattcttttatacacttctttttagttatccccacctgcccagttcccttattaggctgagacattttaaccaaattatttgcttccctgactattcctggactacagccacatctcattgctgcccttcttcccaacccaaaagtggcaactcctttgccacttcctctcatatccccctaccttaacccacaggtatgggacacctctactccctccctggcaacaaatcacaccctcattactatcccattaaaacctaatcacccttacctgggtcaacgccagtatcccatcccacaacaggctttaaagggattaaagcctgttatcacttgcctgttacaacatgtccttttaaagcctgtaaactctccttacaattcccccattttacctgtccaaaaactggacatgccttacaggttagttcaggatctgtgccttatcaaccaaattgtcttgcctatccacgccatggtgccaaacccatatactctcctatcctcaatacctccctccaaaacccctccataacccttattctgttctggatctcaaaacatgctttctttactattcatttgcacccttcatcccagcctctcttcactttcacttggactgaccctgacacccatcagcctcagcaacttacctgggctgtactgccgcaaggcttcatggacagcccccattacctcagtcaacccaaatttcttcttcatccattacctatccaggcatagttcttcatgaaaacacacgtgctctccctgctgatcatgtccagctaatctccccaaccccaggactggcaaattgactttactcacatgccccaaatcaggacactaaagtacctcttggtctgggtagacactttcactggataggtagatgcctttcccacagggcctaagaaggccaccgtggtcatttcttcccttctgtcagacataattccttggtttggccttcccacctctatacagtctgataatggacaagcctttactagtcaaagcacgcaagcagtttctcaggctcttggtattcagtgaaaccttcataccccttaccgtcctcaatccttaggaaaggtagaactgattaatggtcttttaaaaacacacctcaccaagctcagcctccaacttaaaaaggactggacagtacttttaccacttgccattctcagaattcgggcctgtcctcgaaatgctacaaggtacagcccatttaagattctgtatggacgctcctttttattaggccccagtctcattccagacaccagcccaacttgaactgtgccccaaaaacttgtcatccctacaatcttctgtctagtcatactcctattcaccattctcaactacttgtaaatgccctgcccttttttacagtgctgatttatacttttcctccaaaccatcataactgatatctcctggttttacctcaaaccgccacccttaagtctctcttaaagtggatagaagatcttcagtgacaaggtacactccaatactttcaccctaataaagccctattctttacttttatattcactcttattcttgttcccattcttatgccactctctacctctccccagctatctccaccacactatcaatctcactcactctctcctagccatttctaatccttctttaacaaacaattgctggctttacaatttctctttcctccaaaatcaccgagtcctcaatttactcactgctaaaaaaggggactctgcatatttttaaatgaagagtgttgtttttacctaaatcaatctggcctggtatatgacaacataaaaaaaactcaaggatagagccaaaaaccttgccaaccaagcaagtaattatgctgaacccccttgggcactctaattagatgtcctgggttctcccgattcttaatcctttaatacctgtttttctccttctcttatgcagaccttgtgtcttccatttagtttctcaattcatacaaaaccgtatccaggccatcaccaatcattctatacgacaaatgttttaagggaggagaccacccctcatattgtcttatgcccaatttctgcctccaaagaaagaagtaaaaatgaaaaggcagaaatgaaatccacaggcagacagcctgatgccacaccctgggcctggtggttaagatcaacccctgacctaatcagttatgttatctatagattacagacattgtatggaaaagcactgtgaaaatccctgtcttgttctgttcctctaattaccagtacacgcagcccctagtcatgtaccccctgcttgctccccctgcttgctcaatcagtcatgaccctctcacgcagacccccttagagttgtaagcccttaagaggaaaaggaattgttcactcggagagctcggtttttgagacatgagtcttgccaatgctcccagctgaataaagcccttccttctttaactcagtgtctgaggggttttgtctgtgtcttgtcctgctacagtttcatctaacaaccccataatatcaccccttaccacaaaatcttccttcagcttaatctctcccactctaggttctcacgccacccctaatcctgctcgaagcagccctgagaaacatcgcccgttatctctccacaccacccccaaaaattttcactgccccaacactttaccactatttcgttttatttttcttattaatataagaagatagaaatgtcaggcctctgagcccaagcctgcacgtatacatccacatggcctgaagcaagtgaagaatcacaaaagaagtgaaaatggctggttcctgccttaactgatgatattccaccattgtgatttgttcctgcgccaccttgactgagggattaaccttgtgaaattccttcccctggctcagaagctcccccactgagcaccttgtgacccccacccctacccacaagtgaaaaaccccctttgactgtaattttccactacccacccaaatcctataaaacagccccaccccatctccctttgctgactctatttttggactcagcccacctgcacccaggtgattcaaaagcttcattgctcacacaaagcctgtttggtggtctcttcacaccgacacgcgtgataattattatattacttttaactaaaaccctttcagagtctcgcagggaaggctgtatatatctcataaaatgttggggcccactggatcagacaaggccacaaaggccaaagggaagtaaagatctcattatttctcctaataatttccctgtcctttgtcataaatggtgggtaggctgttatggtgatggcagattttctttccataaaatgtccataataggacatttgaacagaagggaaaaatcaaattgctgaagttgaaagagggcaatgcaaagaactttggagaaagaactgtacagagaagtcaactggcagatgggaggaagtttaaggggaaaaatatagatgtctaaagaatacatttattcattttccacagtgcaatttggacaagaagcctctttcttgcttctttctattctcattaaatcattagagctcaagcaatccttctgcctcagcttcccgactagctaggactacaggtatgtgctactatgcccagctaattttttaaaaattagattttaatttggtgaactatttctgtaggaaactacaataatacagcccaggcacattgatcttgggtgaacaaatcagaaggaatgaataattctgtgttcctgggactctgacaatttcatgaacttggtactctgagtaaagcataggaggagttatttcataaaatgtggagcacaatcatgtgacaaagataatgggatccccatttcataaataaatctgaagttcagagagagtaacaactggccagggtcacatcacggagacagaggcagggttcccactgatgcctctgactccctgtcccaggcccttcctcctcccgcaagcagaagtgcagggggcagagctgaccctgtgcagtgaaaatctgagggctgagttcctattggaacacaagtgaaagacttcctggcttctaatctcaggataaggactcagagctccatctgttccagccttaggataagaaccagaatcttacaccatgaaagcatgaaaggtaagatttgagtgaggaaaaaaaaaaaaaaagtctgtgtttcagattcagttcacaaagcagtttcatacttaaggtaccatcacaataaccctgtggggtaagcaaggcaaatttcattcttgttttatgggcataggaagtaagtctcagggaggttaagaccaaggtttctggagaattttatattatgaatcttgatttatgggattactattatgtaattcctaagatcatataggaatcctagagcttgaatatagaactttatttttaaatctatatacatcataattacaaggagtagtgtccatttgggttccttggccctgatgtgttagtggaataaacatttttgtcagggttgccatgtgtgtctgtgcacgtgtgcactgtacacctccaggggatgtaccctaaaccacatgaatgtgatttgcacatccaagatttacagtgtactatagggagaatcttttgcaacagcttttgctataatacagaatctgagatgtctttgagaaagaaaagtgtaatcattaccaaaaaattattctcataatgtgtgcaaatttgtatgaaatctatattggccatgggacaaggaggtatttccagctagcttctgaaagggctctattctctcataagaattcagctgttgacattaggtgatatctgcccaggtcatcagatgccatagagaaagagggtttgctgaaacttatatcagcagtgcactgtatgctctttctgatttatttgaacattcatttattgagtgtcaagtaatgcactagatactccagggatctgacacaaactctgccctgaaggagcatgtaatctcactggggagaaaacaaaacatatgataatttcaaaataacaaactaggcaaactagttaacacttaaaaagcaggctttattcaaatgcaaaattgcatgttacagggtaacctttcagtaagaagccaggaagaggagctcatcatgggttggattagtaaaggactagttataaaagaagtggtggggttgagggaggcctgagatgaaatttaaagaatatgtagaatctaggtaagtggataaaaggtctgggggcaggggaaaggagagcatttcattgtgaatcaaggaatttctccacctgttttaactcttccatatgacatcaaagagatgtcacttgcagctagcatttcagtgatgttttcttactaataatatcgtgataaaagaaacattgactataagaaataggaatgggtctcataaaaggaaacagcaaaacccccaaactaaaaaacagcgcaggctatttctctcttctctccttttgcttggcactcatgagatgctaggtgtggaagtcagccaactgaaaaagagaggtggctgaagaaggtggggaggctgaagccagttaaataggatggtccaattcacagacggcgaggctacagtgcaaataggactctttcaacttgagcaggaccccattacttcactggagttagaaagaaaggagagcgtagactttttgaactttctataagagtgtacctccacagtatacagaagacgacgtgaaatttgatctgcaagaaaactgagtccatattcacatatgtatcaaatttgcacttcatttagaagtgtctgtcatcaagtacagcactgaattgaaactgaaaacaagagtcaagaaagagcaaagtcagccatctttatattccacatgaatcctttccctttatggtcttatttgtttctcctcagaaaagacaaaaagctgagctgtataaacacctgtgggctgggggttgagggataaatgaggggcgaaatggaagctgaaggaactgttggtcaggtagaaatcttcccagatgcactgaaggaaacacacttcatgtttgacgtaggaggtgccaccacacaaaacgtttcatggaaggatttaaaggatctcatgatttttagtattccaagaattttctttcaccaagggcgatttaatatgggtcattcatactgaaagaaaaacaaaagataataagagtttaaaaattgcaaaacttggagtgttagtagtaaaggtaaatattcattagagatgagaagaggagcaaggaaatgctttcagctggaaatctcagacaagaggccaggctttaggaacctctgaagatgaacaaatgtaagcaaaccctagtagcagcacttctcagattttcatgtgcttaccactcagagatggtgttaaaatgcagactctgattcagtaggtctgagtggagcctgagattctgcacccctaacaagctctttagtgatgcttatgccactggcgcacagaccccacttggagaaatttttgtggtgcatacggtctttgtctccagatctaatgagtctgaaggacagtgtagattgattttttaaatttatgtttattttaatttaatttaatttaatttatttatttatttatttttgagatggagtctcactctgttgcccagtccggagtgcagtggcacggaggcagctcatgcaaccacggcctcctgggttcaagcgattcttccgcctcaacttcctgagtagctgggaatacaggcacgtgccagcacacccagctaatttttgtatttttagtagagatggggtttcaccacattggccaagctaatctcaaactcctgacctcatgatccacctgccacggcctccgaaagtgctgggattacaggcgtgagccaccgagcccagctgtagattgattttgagcagtggaaagtcaaggaattagaaggcatgcttaaatggaaagtgaaattggagaaaatttaaactcatgaaatagtggtggttataaactcgtgataaattatatcctgggatataatttaatgagatggtaacacatttagtttaaagaaataagtgacactttttttgtgtgacacaactgtcttattcttggaaaggacaaggagagaatgaaatatggtatgtcttcacagcacctttcaaagggagaaccagattctgaggagctggtctcatgatgaactgtcagggtaaaccacagttcagcagctgcaaatgtgcttgccaaaatagagacaaaaaaatgtttctgaaaacaaaatttcacatatgccctcctctgaggttggcatcatatcttcctgtgtatcttgggtgtagcttctatcctgccagaatttagacagtagaaaccaaatgaggtgataaacagagtcattttgcagaagagtcaaaataacccagcaagaaatgaaaccacaaatgcccaaggagtcattcattcaccattcaaaagctaatagaaatgaacacaaactactatgaaaattcacccaagaacttaaaaaaaaaaaaaaaggctcatggtgtttagtgtgatagtattcattttacctttgacttgttctaaaaacacaccatacttctaccccacccttcctcagtgccgtcacacaatggtttcagtgtgaaaaaaaaaaccacgttactggaaaaggagggtgcctgggacttgccactctaagctggtagtcaagggtcttgagttctaaaagcatacgcgttaagagcatgattcctggatccaaatgagtatggatctcagcattgccatttattgtgacctcaggctattttatttctctgtgcctgtttctttatcagtaatgaagatgttcatagacccttctcccacagacttaaaggcatatttcatgatttaagacatgtaaaccattcataacagtatacaacatggaattaatatttgataaaggtttatgattattgtaactaactctgtcacttgctcaaggcctatagaaaacttacttaattagttcaactacaaaaagagtttgaatgtgatatccaccaagatcatattcagacctagaattctgtgattcttatgaattaatacagccttggtcaataaatgagagctgggcaaataattcttctttgctaggcctttctagaccatctggtgaagcattcaagacttatgttattggggccagccttcctttccaacttcaactccacaactcctcaataagccatgggctcaagaaagttctgctcagtggcccctgaaaaatgctttcatagtctcactaccataccactgcttacacaatttccttcctacagactgccttcctttcctgcttttctccatatacctaaatcctatctattcttcataagcaaccttctttataacattttctataaccaccaagccaaatgaccttttccttcttaaatatagcacccattggccattaccatgctctgccttgtatttttctgatttttttctttctatattcctgtcttaactccccagctaggtaataattttcctgaaatcagggaccaggctgactcctcttgctgtctcaagaaagcttagcagtttccaacacaaaaatgttcaataaacaactattaattgactgattataaaaaatcagtgaaccattaaacttaatatagcaatttgcttagcatggtaattagctttttgctaatattcttccagccagtctctcctcctgtgcctcaaggacatcttaaaaaaaaaaaatctagttgatctgcttccatctagtggcaattaaaacaggtggttccggtagccagaaaacagctctgggtagattgtgccagaaaatactttcactcagtaggtgcgagtttgaaagaaatcttcacatctgtgggtttcctgccacagacatagggagaccagcccagagaaagaagcctttcctcactagactccatttgcactagtaaagagaagacagagtaattaaaaagaataaaaagaacctccactgatcgtacatcctcatccagttacccctgccccacttctccttcacagccaaacattttaaaagagatgactgcttgttctgtctctactttctcatcctcagtaatgctcaatgcttggccgtctgacctctgtcttgatgtctgcactgcaaatagtctccccactgacacccttgttgcatccaggggatacttactggttctcttggcaatgtttgaaaccgttcccctttctttgtttccttggcattcattaccccacactctttctcctcttccttctccctgcctggcaacatcttttcatttctctttcccttaggtgacttattagataatgatgttcctctggctcccatactctctcccaggtcctcttccattcttaaagcactcacaccctccctggatgatagtacccactcctgagatggcagttacctcctgaaatgtgagggacccaaatccacttctcctgccatagcctctgtgctttggataggtccaatgagccacagtgaatgatgtgcatacacccaaagctcagtacaaaactgaacccatgatctttacctccaaaacctctcattcttttatgttcccttctcagaagtaaacaggactaccatccgccagtttccaggtgagaaagatgataatttgattcttctctctcacttttagccaattaacagacacattcagttaatatcacctcctcttatttcatgaacccattcttactactagttccctagacaggcgccatcggttttaatctaataactgcaaatgcctccaaaacaagtctctttgaatccaggctcacctgtctcccacacttgccatactgctctgcagggtgaccttataagatgccagaggtaaggctactcactgtttaaacccctttagtgatatcccaaaagacctcaagataaagcccatatcacatggcttatacattagtttatgatctggcttctggtgcctcatttttccccactttttcctttgcattctaagcaatggcccatactaagtttgtgattggtaggatggttgcccaaaccagcatccaatcccttcagaaatcatctcacttcatttctagcattttaaaggaagctcagttgtccagctgggtactgaatatgtcaccaaagtcctcctttcatagtttattttacttaaactctccttcctaaaattccagagcaagtcactaaaccctagatactgagaaatatttttccatcttcatttctgccaggtgggccatcaactttcacatgtctgcatctcctcccactgtgctatttctccagtagaagaaatttgagcttcaagaccaaactgaaaaatacttgcctccttggggaagctgtaggtagaattcatgctccctatctttcccacatttctgaaggacaatgcctgttagagcaattgaatgcaaatagtcaattgaataagcatttattcatttctcaataagtgcttgttcaattgaatatttcttaaataatatatttaagaacaagaagaacacaccacaatgtttttaaccctcagaaaaaattctgaggtaatcagaaaaatctccctttacataaactgcccttttctaatagggattacttgttcgttcattcattcattcagctccactagcaccaaaaagcacagctctgaaaggaagctagtagatttatcaccttatctggtcatttggatgaggaccccaggtaaataaactactatggggttaatgtgtctagctagagcaggaagtaacttaaggaagtagagaatgaatcagcagatgtggaaactcctcgccactaataaaacttaccttctcttggatttcttgcctgaaaatagaaaatagagaaaaggcattagcaaaaattagacaatttaaagtttttcaagtaagggagaaggaagactcccactctcaaaactgtcttttgaagtatattaggtatttgttaggtggaccctatctgtgtcaaaggagatttgaggaactggcttaataaacagtggtagacactaatacagaacagacatgttgatgcagatgcctcctgaggttccattccattctccgtgctactcaagaagacagaattgctaaattgcctggtggcaagacccaatatgtccattcaagtgtttatcccttcccaatctgccatctcatcctacctgcagattcttcccttgagggacagctgctaatactgtaaaactatgtgccattacagctcacagcatcatctctatgagaatccacaagagaatttcactttggtcttgttggtaggaattgtgcagcctcatctgagtaactaatgtgtttttatcttacaaacacaaggaatatcacatggttctcctttgactggctgtaaggaaactcagagctagatctgagaccctctcctaccaagtatataaaactttgtgacatacatttttgtgccataacttcaaccttggttccaaatgatttttgtaccctaagtttaaatttggctttcttttttttttttttgtactcaataaaacatcaagctcatttattattgcgaagagcgaaacaacaaagcttccacagcgtggaaggggacccgagtgggttgcccaaattggcttctttttcttactttttaattaattttaatttgctatactgaacacattttgtactgttctcacattctttttgaaaaaagcagaatataaataagtagataacttaaaaaaaactctttgagcagaaagaatcatttgggaggcaatatatttcagtggctgtaaagtggcattctagaatcatcctacccaggtgaaagccctattttgccacctgtagtgtagtgtgtatttgaacagctactttcttttctaaactacaatttcttcatctgttaaagaggcataataattgtatcatcctcattgggttgataaaataaaatatttccaagtatttagttcaggtcctagcacgtagacagtgttgcattactgttttaatcctttaaagtattaaagactactatttgaaatcttttcttctaaaattcagcctgctgatgaccaagtgcacttgagcagggggaatcaaatctgaattaatttcagattctggttagcttcacataaatattttttttagggatgatgaacctaacagcaatagatgagtaagaatctgttcctactgagagagtttcattttgaagaaaaaggaactaagggggcatgtgttcagtttcatgccctggtctaaccctgtgtgttggttctggtgggaaattcttccaaccgaggaaaaaaccagttcacaaatctgaagaccagtgattttagaagatgtatctggactggagtctaatctctgactctgggtcctgctgatatggtatttttgagatttggcctaaaacatcattgccctggtttccttatttaccaaacagggccaatggtagtgactaatcagaaaatgataatgcctggtgcacaaaatgtgtctagatgagcccatgcacaaggacacatgtttctggaactgttccttattcctttcctaaaagaaaggagggaaagtctccatactaagactactagggcaggggacaaagtgctagagtcagaagattcatctgaggacagaagaataggggtgaaggctctagtcacttcattggctaccatgctctaaatagttacctgtgccctttttctaactattagaacccaaaaagcctataaattctctctctctctctctctctctctgtgtatatatatacatatacacacacacatagacacacacacacacctaaacacacacatagagatttatgactttttacttttatccttgtaaatgccattaactatattttgtcttagatttagcctgggaatgtagccattatttctaccattgcctccataggaaaaatactcttcatgttttaaaggaccaacctacaactaaaatctttggaaagcagaatcatttgtaagttggtgaaaatggaagatgttgttttataaatgaagactttttttttttttttttttgagacagggcctcactctgttgtggagtgcagtggtgctgtcatggcttactgcagccttgacctcctgggttcaagtgatcctcccacctcagtctcctgggtagctgggactacatgtgcatgctaccatgcctgactaattttttgtatttttgtagagatgtggtttcgccatgttgcccaggctggtcttgaactcgtgggctcaagtaatcctcctgcctcagcctccaaaagtgctgggattagaggtgacagccaaggtgcctggcccacagatgaagactatttaatgttatcttaaagataccctaagcttcctaccaagccagtgatcttttggggcttctgttttctttgttggcataactgtaactagcctaactgcccgttatctgtttcctgtttgccccacactgattcccacagcagttttcaagttatcggtttgagatcttgtacagaaatgactccaaggtaaaaaatttaaaaacaacccctctaatttttttacccttgcttataaaacagccttagccagctaacccctcactacatgcaaatgagtttgattctattcttttgattctacaaacacttattaaaagattttagaattcggaaataaatagcttccttattaaggtgacttacagccccaaagtccttaaaattatttagacaatagccaccttatcccagggggcagtgtgtaataacccaccctgttctctatccgtcagttctgccatcatcgcccaaggtaggaagaaagacaggacaaccggggtcaagatttgaagtctcaatggaaagaataatcagtggttggagaaaactgtcattcttcttttgccttaatgcagtacttgatacttatacttagtactgtatagtacttagtactgtataatactataagatagtgagattcaatcagcacagaatttctaatagcaagggcagagacattttaactgctcagtgctctcaggttatacatagctaatgaagttcttgcatatcaacaatccccacccccctcacacactttgtctttctggattggttagaaaacttacctagcgcccactattctcaaatttaaatgaaagataagatcagagtggcacgcaattagggactgataaataatatttttgtaattgccagtgtaaatggacagggggcaacctttacataccatattcagtgaacagaatacgtactaactaatttgatggaaggaaaattaaaatgacaatcaactgagcccacagaaaggcaacacagagcagttggttagcaattgtttcgagatcatccctgaacttgaaacaggtatatcttttttttttttttttttgagacagagtctcactctgtcaccaggctggagtgcaatggtgcggtctcagctcactgcaacctccgcctcccgggttcaagtgattcttctgtctcagcctcccgagtagctgggattacaggtgcccgccaccacgcctggctaatttttgtatttttagtagagacagggtttcaccatgttggccaggctggtcttgaactgctgagctcatgatccgcccgcctcggcctcccaaagtgctgggattacaggcatgagccaccacacctggccaaaacaggtatatcttaaaagctgcccaatgtccatgaatgttacagccttgaatggttcttccaggtgagtttggccaaatgtggcaccatacacccaaggcctgctgcaggctagtgggttgctcacactttaaagctgagacacactcatgccttaaggtaaagggagtgataatctgggcagcagatgttaacttctcaaggcagtcctccttctcttttcctctccagtgacggatggttggaaagcatatatggtgcatttggttagagctgtggccttggtgaatagatacttgggagaatacatgggaatttctcccagggttaatgcaatgcccatgtgttgggaaccaggtgactcttgaagaggtcaggtatttgggagcagtgccttgaaaccttagtggacattagacccacttcctagtggaattgtagcattgaaatccaaggcatgtaggctcttagaggacagagatagtgtgtcattttttcagaattaattaagagcaggccaggcgtggtggctcacacctgtaatccaagccctttgggaggccaaggcaggcagatcacgaggtcaggagatcgagaccactctggctaacacagtgaaaccccgtgtctactaaaaatacaaaaaattagctgggcatggtggcacgctcctgtagtcccagctacttgggaggctgaggtgggagaatagcttgaacccagaaggcggaggttgcagtgagctgaaattgcaccactgcactctagcctggtgacagagtgaggctctgtctcaaaaaaaaaaaagtattaaagaattacataagagcaaagaaccattagaatatctcacttagttgttatcagcctagcaagctgccttgaaggtaatagacatttttaaaagtttatcagatgaaaagcgaaaatcagccaacctgttttaatgaaggtgtgtcctgggctgatttacatgtctccagggactgatggctctagaatgtaaagcttggcatcctgcttgtgttgaatctatcacatttaatttcctgtgggtttcttttttttttctttttcactttaaagttgtgttcttttcatgtgaagttaaactcacatacctttttttaatctccttgccagccaaatgataaatgccaacccagagaatgcagtaaccatgactgccactggaatgaagagggggttataatcaccctccttaatcattgagaaacttttgtccaattctgaaagagaaatcagtaaggcacatagcatgagaccaccagcattatttccttagtctatctcatgatatttgacttttttcctccttacatctcccagtagtagcccatttgatgccatttgacagatgaggaaactggcatgggaaggcccctgatgagtctacagcataggcaaagactggaccagccttgctagtctaatgcctacagaatctcaatgcccagatttgtggttcatagagttcctgaaaatgcacctaaaaatgttggcaagaatggtcatcgttgtatttagctccatggacttgttcaatgactggaactctgaaacacagagaagagctaaaagcctaatacaacttcaggaaaaataaaagccaatgatctgaactggataattcaccagtcaaaggaaatcattaatgcttttactttaaagcagttgtgcaaaaataagcacttgatttttacatgccaaggacctgcactaatttctttccaatgcagtagttaccacttccctctacttccttcacgaataagtaaaagggcatgtttagagatactcttgtaagtgtaaactaagttcatttgggagcctctatttgaaaatactggtataaaaaaaaatctgtctcctgatactaacatttgaaggaatctacttttttacatattggcagagggtctgattctatccttagttcttcccattactttgatgaaccttttcaaggtgatttgatccccacacccaaatatatgattgagagaaggctcaagttcccaggagctccagacagaaggtacctgttggcttgatgaagatgaggaggaaatgaacactagctaggccttaaagggaaatgtctctgataggcctaatacacagtcctctgctaaaggcctccctgcctctctctgctcatccactctactccctggccctgggcacgcagcacacagagatcagcatttctgacagcttctgtagatcctaccatttaaagacttttgtcatccatgcagatagtctcaggagcagacacaggtagctattctttcacatgctagcttaacatgcatttgctttagcacctattgccaggcactgtgtcaggtggagggtatacaaagatgaacaagacatgattcttctcatatacagatagattttggaggcattagcttagtgatgattcaggagtatccattatttggggaagtaggtggtcattagtgaccttttacaggcatttcaatgggctaacagagatgttagattgtagtggaatagaagaatgggtaaaaagtaaatcagtgagttcagattttaggagttaagatggcaagaggtgagaacaaaaaaaggaaatgattgtcattaaaggaggaggaaagaccagccaaagattttacagtgagttaagcatacaaatttatttctaggccacatattcttagcaaaacaacatgtaaatgtttatgtatgtctttcctcatatctgctcatccatcagctccatcgttaagatttcagttttccaggacaaacttactcactttgacatattggactaggatttgaccagattccagatgattcacaaatggttttcttcttcccaattaactcagttccttctgagcagatgaaggtacatgcagaggtaaagctgaagctggccaggggatggctacagttcatgatccccaaatctggtgctgatagaggctcacactgaatcacttcaatgaaaaagaaaaaaaaaaaaaagacaaaacagtatttctgagtagagaccctcccttgagcaaaggatttttagccaaagctgcctgactacattacttgtgatattgcttccaggctttattttcttgagaatgatggtgggtggtgaatgagagatgaaggcaaggaagcattgaaagctgtggggagaggagtagctactccaggctgctgccctagctaaggtgaccctccccttctgctggaagtaccatgccatatggcctctgcatcaagggctcttatgggatattctcagagaatctctgccgtttcatctgttctgatatctacccaagcattttgaaaaacatcccaattcactgaagcaagtccaacttccgtaaattccagtaggtgggttgacagttttataatttcaataagggattttgatagcacttctaagaattaaactacttaaactaatgcatcaggagcatacttgtagaaaagttaaccaaaacttcgtaagttcagatgacattggttttctcccatatggagataaggttggcagttaaaaatgaaaaaaaaaaaaaaacctaccttatttcaaacttgaaaagatcaagagattgtgtttttgtttttcagttgttattctcctaaaagtttatgcatgaggaaaagtaaaagtgattttaagaataagccaaataaaacaaccaagaaagacctccactaccctgggaaggaaactggttggtattaagtaggacaccacataaaacaggtgttattgagaggagaagaaccaaaatgtaactgaggttcaacaagacattatttatgcaatggcaatgagaaaaataaaaaacacagtataaccatgctgtattgctataagtcatgttacacactgggagatggcttcaggggtatttggtttttactttttgtttgggaggtttttcaaaaaaatttagttagaataagtcctttgagaaacatcacagtaggttaaacaaagttaggttaaattaggctcctaagtttgacttctcagcaaacttctactgaatgttctgactgtaagcccaggattgcatgacaaaacctctagtctgaagttactcaccttgacaggttggttctggagatgaccagtttccaaatggtccacaggtggtttcttcaatcccagttaagtttgttccttcagagcagctgaaggcacactgtgagctgaagctgaagtttcccaaagggtgagtacagtccatggtacccagctctggggcctccaaaggctcacactgaatcacttcaatagggaaagaaacagtatggggaagagttaagaggaactgacgcctggatttgaatcctagccctgccacttgataaccatgtgcctttaaacaaggttacttgaaccctccaacttcagtttcttcatctatataagaggaataatgaaattgtgttatctttatcaaattgatatggaaactaaatgtaattcaattagcataagtcaaggaccttagaacaaagcctgactcatcagaaattctaagtaaacattagctagtcttcatattattatcttcagcattatctgtagtgagaatccttaaagccaaataggtgtaactgggaatgaccagcttagtcgggaaataactatcacatcagagcccctgagtctactagagtattgggagcaagatgttcagagaaagagtgggtctccataataagccttctttgcaaggagagaatataaaagtctaggaagcattttgacctcaattctgtcttctattctagctcagttccagaattttaactcttttgattttgacaaccctctccagaaactgtatctatttccctgttctgattggtggtacaataggtaaatttaagacttggaaatcaaagttttcacattttagaccctgccatgccatttagtaaacagtacaactttcatgtcttattcctcatctgtcaaatttaagccattattgctaccttgctctagagacttcaaggaagaatggactcaaggaatcagaagaatttttgtatttggaaactatatgagatgagattagggagaaacatgggaactaagagaaaatgttatcttttttcattgatttaaagagtatctattatatatcaagcattactctggggcttgaagagcttagatttcaccctgtaggacaaaatggtaggtagaaattaatgggtggattgtcatgtatgtgtgatgtgttttaattgcttttaattgatcagtctccctgtagtatgaataatgtatttgaggggagctaatttaaaattgtggaactcatctaataaactattgcaagaatctagaagaaagataatgacggcaatggtagtagagttgacaagtggaagacaaattagaaaaacactaagttgtaaaaattggtagaatgttaccctgcataaatgttgggggagttaagagagtctcataccagggtgcccatgtaaatggtgattccacatactgagataagaaatacgaagagaaaagctgactgggaacaattggttttatagtcttttaaacatcccaaaggacatccttagcatatttgagttcagagctggagataggcttatcagtccaaagatcacatagatttgtgagtccgcaaaagtcagtaagtttgaccaaaggatacatgtagattagagtcagaagagcaatatacaaaagacaaaagctgagaaattatagtagtttatggtcctggataagtgctcatgaaggatctcaggagaaatgatcacaggtagaaagaatgagaaaagagtgatatgagagaaaccaagacaaagaaaagtaaaatgttaaaaatgagtgaaataggcataccaataattaaaaatgagtaaaataggcataccaataacataagggttaaaaaatagagttcaaaaatggggtgagggtaaagtattaggaaggagtcatggcccagggatcaagtgaaatgagttagatctatagatctatttcagttggttgacatttaaatgtattttggttttaattctttattgtttacaaacattgcttttttaaaaaattaaattgtccaattcaattcaggctcacaagcaagtgcctcatatatacaggcattttgtggatcccaaagatgcaatgataaataggacacttactgatctcaagaagttttcagtaccagaggagacggacaagtgaacagatgacttcaacataagtgggagaaatgaggaagaaatatgtggagctatcagaactaagaaagcttcctagaagaaactgtctttgaacaatgtcttaaagatgacatgttttttggccatgtgcaaaatgagagagaaggccaccagcaaagtcagtgtgctacagagcacatgtgttaagtgtggagaactgcaagaaggaaaggaactactagaaggaaaaagcaagatactttctgggtaactcagcctcctaatgataaatggcatagtttcttccagaccttagagttctaattaatctaacaagctcattagatcgtgagcttcttgagagcgggaatctaccatgctaattccttatggtaaccctgacagcttttatcccaacactgtgcttcttgtggtactcaaaaagacttgttgagaagtgagtcgaaacttcatgctgacttatgaaatctttacggaaaggtaacaatattgtgaaagcagagctttctgatcaaaacttcccatttctcagagtggctagtatcattttgttccaaccagcttcatgataagctataatgattcctgtgactttacctaagaagaagcaaagaaaggaaagagacttaccaaactgacactggggcccatagtaccccacatcacagttgcaggtgtaattattgatgatttctacacattctccatggccactgcatgaccagggctggcaagaagctttaaggaggtcagaaaaaaaatattttaatgtgattacattttagtactcaaagtcatttctttagacatagataaccttttgtctgagatgatttaaataatcaggaaaggtttatttgtaaattcatagcataaaaatcatatgctaaaatttttacgtataaaatacactaagcatatagtcataggcatttatttgcttttggaatgaaattaccaatactaatattctgtaacacttataggaaacttagtggcataccttgaaactcttgaaattacttgtttttaatgagtgagaaggttaaatgatgacctgacctcaatcatttctgcatgcaattatttcttggcaatccctttctttatagaaatcaaagattaaaaagtccaaatttgctaaaacggtagagtccaatttataagagaccaaattaactatggttcattattaaaacatcacttggaaaatgctggctgttttggaattgtagaagattttacagaaatattcatacaccaaagatagtgcaatttttatataaaattatataaggttagaccaagaaggaagcacgcagcaccacactctctacttcacaatgtgaaaactgaggtgatgtgagcctaagtttccaactggccccagctgtcagcttctcctcccctgccttattatcaaaggcactgattgtctagctcttcctctgtacttcctacgtagatctatcattttgatgtaacttgatttaggggtatagcttttgtgcacagggacaaatcttacacaccaaaaattcttaggagtgacacgatgcaagattatatagagggctagatgtattttagaatgaaccagaagctgttctcatccccccacctttccatggggtaaatctgagtattctcttaaccgtggcccttcctgagtctgaggcagcatagccgtcttgtcactccctacctgtgtaacagagggctgcctttagtttgtggcaggcgtcatcgttccatttgcctgcatctttgtttctcttgatatagatctccacgcagtcctccttgttcttcttgttgttgggctcaccatctccccagttctctgcttcttcagtaagagatttgttggttcccacccacgtccatattcctcctatcttccggattcctatccagtagtaagaacgactgaaaggcagagtcttctccagatactcaatttccgccttgttttgtatggcaactaaatctgtgtaattgtctcggcagaatcttctagccctttgccagttcatgggtttttcagaataatggtaagtccagcagtcggttccatgatgtgccaggaaatctgcaagacatcagtgtgacctatgcagacttacataatgttacagctaaaaagaacctagcactactccaggctgagctagacacttagagatgaggaaacagagcctaagagtgtatgtgaccatctcaggatcacagaatagttgtttgcagatttgaagtagaacctagaccttctggcttgaatataagatgcttttatctaaggttctatttgaaacaaatttagtggttttctaggtttattttcttattaatttttttctcaaaattatttcaggtgaaatttaaccaacatattttagacattcatatttctttttctttgtagctgttaatgatttacaactaattaccgtgtaatatcatataactatacaatttacgtatactttttaatcctggaatcatttcttgaaggccaacacatatgtacctatgggagaagcataataaggacaggaagaacagtgacatacttttaagtaacctcttttacataaaaaacattttattttaccataggaagaactgcttctggaaaagcccaatataccactcaactcttatatatctaactgtataatttttaaaaagaacaatttacaaagccaaatggtataggattatgaaattcattagatcatgttctatacacaaagagactcaactgatgatgtttaataaacatatggacccatcaaatatgagggctttgaagatatctaattaaacacataattacacaatgacttcataataatatatggcattctaagcatggtatgatctacatgaatcactatttaatacagtaaagaaacagatataattgatggtaaagagcatcataaaataaacattttgaacagagttttgaatgagcattccactagaatgcaagttctaagagggaaaaaactgttgtgtccactgctgtatccttagtgcctagcataaatttcacacattgtagggactcagaaaatacctgttgtatgaaaagagcactaagtttctatgtgacacagtgcagacatggcataaggaatgtgtgaacgggagagttagcatgtttgcttggctagagctgaaaatccaggctagggagaaagaagacattagtttacttaggaaatgaaaaaccaagttcaaagctattgctggagagtcttcaagaatcagatataaaatttgtcacaacaatgggagaaggaccaaaaaatgataaacccccgtcccttaataagctcgtattgtaattgtagaaatgacattaatgtacactgaactatgaataaaaaatagaaaatgaggtgctaaatatttggtacagattgtaagtaccttaacagagatttcttaattaacattattcctttataattgagggattttgtggggttattgggatttgaactctacagcatgggctattataggttaaaaatagtgttcaggagtttctggggaagaactaaaggtaagaagaaaagagatgtttacagaagggatagaattaacagctctgtgaaataattttcccttagactatgtataactagtggatatttaagaaaaatgaatataagtaaaatagacttagcgatatataaatatcataacataccacaacagagcattgtccacccccacaacttgaagatgttccataagtccctctgggtgctctgacatttccatggaaatatctgcaaatgaaatacaaaattatatttagatgtatactcttaaaccacacatttatagcctttgaggtggtgcttacaactttcttaataatcagaataaaacacatatgtctactaaccctgtctgaggtaacaggtttctcagacatagatgaaaaattacttcaaatttacatcagaactgatgcacagttttgttttgttctattttatttttacgctttagtctcaagttgctaatcggtactgccctgaattttttctatggtttggtaatttttatacctgcttttctgctgagctattagataaaactatttaatatttactatgtatattttttaaagtattgttgctgcttaattaactattgatgcttatatttaatgttatagcctcactcttgatcataatgggtcaatgcctcaaatacctaaaaaaaaaaaaaattagatagccagacaccaggaaagaaaagtatttctttttttaataaaaagaaatacctttttgagcaactgaaatgacaaagtcacaaatttcctgcacaccttaaaatatacttaatgtaaatgacgagttaatgggtgcagcacaccaacatggcacatgtatacatgtgtgacaaacctgtatgttgtgcacatgtaccctagaacttaaagtataattttaaaaaaattctatcttccaaagcatatcacttctcaggtagacacagtgtttattgcaaaagatctgatttcaatagtatttcttcaagagtctccccagagacaaagtcaagaagaggaaatcagcatatctgagaagaaagatttcaggatcactttttttgagggtctgagaaaatgtttagtttctatattatttaaaaccagaattgaaatggggtgattcctatccttgccacctgcctctacaaccccaagagtttctatctgagcatctaaacgtcttttaggctgaaaggctcaccatggctttgcttggtccttctctagttcttctgcagcccattgagcctcttgacttagcacaagggtctcaggtccttgcccaaagggagtgtgctgtgctgcaggtagactgcactgaatgtcaacagaaagccttgctttctttcatttctctaacccagtctcacatcctcctcctcctccccttttccctccccttcctcctgcacttctctttcctctttccccacccctttcctagactggcctctattgcctcccactgagacaaaaatgaactgctgatcagaaagtaatgtgactagattctctcttccttccctcctttctatccttccttccattctcctatgcatctttccttaccctcctcctccttcactcattgttgttgctgttcttcttcctcttctttttcctcctgctcctcttcttctacttgttcttgttcttgtttttgtttggttcttgttctcctcttcctccttctctctctcctcctcctccttcttttccaccaccctcccctatctttttcataaatgctaaactaactcttggctacctgtggtaaatggcccttggaaattgcaaatactacaaatcaaaactgcatttcagacatatttatgatgtttgcaaaacttcagtagagctaagcagtggacttgactcgtttcggttccttcacctccgtctttccttgctcaccacctagtggacgtccttgttagtggcacttcctgaagttaacccctgaagagagcccatgctctctagcttttcaccgtgtaggtttgggagcctacaagtacctttaatattcttggactataaaatgagatggttttataagactgcatgtgaaattaggacccatatgatgaaggacaataaaaaggaagacccactgatgtgagtcaatgagtcaaatgcaaatcagatttgcatttttaggaaaataataataacaacaacaaaaactctgaagctcagcgccccatatttattatattgtttaatctttataacagctctctgctatagatatgattattatccccattctaaagagtctcaaagaggttaagaaacaaattcaaaaactagcgaaagacaagaaataactaagatcagagcagaaccataggaggtagagacacgaaaaagccttcaaaaaatcaataaatccaggagctgcattttgaaaagattaacaaaatagatggaccactagctagactaataagaaagaagaatcaatagacacaataaaaaatggtaaaggggatattaccactgatcccgtagaaatacaaactaccatcagagattactataaacatctttacacaaataaactagaaaatctagaagaaatggataaattcctggacacatacaccctcccaagactaaaccaggaagaagtcaaatccctgaatagactaataacaagttctgaaattaaggcagcaattaatagcctaccaactaaaaaaagcccaggaccagatggattcacagccaaattctaccagaggtacaaagaggtgctggtaccattccttctgaaactattccagagaatagaaaaagaggaactcctccctcactcattttatgaggccagcatcatcctgatactaaaacctggcagagacacaacaaaaaaagaaaatttcaggccaatatccctgatgaacatcattgcgaaaatactcaataaaatacggcaaactgaatccagcagcacatcaaaaagcttatcaaccacaatcaagttggcttcatccctggaatgcaaggctggttcaacatacacaaatcaataaacagaatccattacgtaaacagaaccaatcacaaaaaccacgtgattatctcaatagatgcagaaaaggccttggataaaattcaacaccccttcatgctaaaaactctcaataaactaggtattgatggaacgtatctcaaaataataagagctatttatgacaaacccacagccaatagcatactgaatgggcaaaaactgaaagcgttccctttaaaaactggcacaagacaagtatgcctctctcaccactcctgttcaacatagtattggaagttctggccagggcaatcaggcaagagaaagaaataaagtgtattcaaatagaagagaggaagtcaaattgtgtctgtttgcagatgacatgattgtatatttagaaaatcccattgtctcagcccaaaatctccttaaactgatcagcaacttcagcaaagtctcaggttacaaaatcaatgtgaaaaaatcacaagaattcctatacagcaataatagacaaacagagagccaaatcatgagtgaactcccattcacgattgctacaaagagaataaaatacctaggaatccaacttacaaggaatgtgaaggacctattcaaggagaactacaaaccactgctcaaggaaataagagaggacacaaatgaatggaaaaacattccatgctcatgggtaggaagaatcaatatcatgaaaatgaccatactgcccaaggtaatttatagattcagtgctatccccatcaagctactactgacttttttcacagaattagaaaaaaactactttaaatttcatatggaaccaaaaaagagcttgtatagccaagacaatcctaagcaaaaagaacaaagctggaggcatcatgctacctgacttcaaactatactacaaggctatagtaaccaaaacagcatggtgctggtacaaaaacagatatatggaccaacggaacagaacagaggcatcagaaataacaccacacatctacaaccatctgatctttgacaaagctgacaaaaagaagcaattgggaaaggattccccatttaataaatgatgttgggaaaactggctagccatatgcagaaaactgaaactggatcccttccttacaccttatataaaaattaactcaagatggattaaagacttaaatggaagacctaaaaccataaaaattctaggagaaaacctaggcaataccattcaggacgtaggtatgggcaaagacttcatgactaaaacaccaaaagcaacagcaacaaaagccaaaattgacaaatgggatctaattaaactaaagagcttctgcacagtagaaaaaaaaaaactatcatcaaagtgaacaggaaacctacagaatgggagaaaatttttgcaatctattcacctgacaaagggctaatatccaaaatctacaagaaacttaaacaaatttacaagaaaaaacaaacaacaccatcaaaaagtgagtgaaggatatgaacagatgcttctcaaaagaagaagtttatgcagtcaacaaacatatgaaaaaaagctcatcatcactggtcattagagaaatgcaaatcaaaaccacaatgagatgccatctcatgccagttagaatggcgattattaaaaagtcaggaaacaacagatgctggagaggatgtggagaaataagaatgctttttacagtgttggtggaagtgtaaattagttcaatcattgtggaagacaatgtggcgatttctcaaggatctataactagaaaaaccatttgacccagcaatcccattactgggtatatacccaaaggattataaatcattctacgataaagacacatgcacacttatgtttattgaggcactattcacaacagcaaagagttggaaccaacccaaatgcccaccaatgataaactggataaagatgatgtggcacatatacatcatggaatactatacagccataaaaaaggatgagttcatgtcctttgcagggacatggatgaagctggaaaccgtcattctcagcaaactaacactggaacagaaaaccaaacattacccattctcactcataagtgggagttgaacaatgagaacacatggacacagggaggggaacatcacacactggggcatgtcaggggatgtggggctaggggaggaacagcattaggagaaatacctaatgtagatgacaggttgatgaatgcagcaaaccaccatggcacatgtatacctatgtaacaaacctgcacgttctgctcatgtatcccagaaattaaagtataatttaaaaaaagtttaaaaaaagaaagttgccttagtcacataactagtaagagacatggttgggaatttgaacagaggccaatcagttccaaatccatgctcttgatcattaagctgaacttatggcaggaacttggaagacatggtaaaatggggaaaaacgtggagccagggagacttgtgaaagtgccagtgctcccactataccctgaaagaagtatctagacttacttttttctaagtcctctcctctaattctctcaatctctctctctctttctctaagagatgggaatgctgctctgtcactcaggctagagtgcagtggtgcgatcatagctcattgcactcaaggaatcctagggtctagtgccccttctccctcagcctcccatgtagctaagactacaggcacatgccccaaccctcgactaatttttttattttttatttttgtagagacaggatctcactatgttgctcaggctgtaattctgtcttgaagcttgtccaatcaggctttcagccacaccaattccctgagactgctctcaccaaggtcctacacttcactaacacaaacagcctattctccatcctcatcttacttcaccagggagctcctggttttcctcctacttcactggctatttcttctgtatcatgtgttgattctccctcatctccccaacctccaaacccttggagtactccagagatcaccgctttgctcttctgtgtctaacctcactaacttggtggtccaattcacactcttgactttgaataccatttaaatgcgaacgaattctaaattctgtacaaccagaaccattctcctgtagccaaatgcctactcaacatctccatccccaaacaaatttagttgttcaataagcctctcatattttacatatcccaaactgaacttctgaatttctcctccaatctgtagggctcttcccacagcctttccatctcagtggattataactccatccttccagttactcagaccaaaacttttggagttaactgagacacctctcttttttttcacaagtcatatccaatgtgtcaacaaattttggtagtggaaatattgcgggattttttaagaaatcagagagaccgatggggttcaggaggatatttattatttaggtgcactggccaagtcagattaacatccaaaggactgagccctgaacaaagagttaagttaccttttaagcattttgtggggtgggagagaggggtatctgtgcagggggaagcatactacagaagtgagaaataaagacagttattcaattaattgagacatgcattacatcatttcttacttttcaagaagaaacatgttttgcgacttgagtttatctgtctagtgaccttgcagctgcacagctagagaaacagggtcttcacaatgcctgggaaaggaggagaggtaagtctcactagccacagaaaaacaggcagttaatttttaaagggctccagctctttctctttctcagggggagttgggttttgttacatacaactgagtttccgcttacacattatttaatttcttttaattcctgttccaaaagaagccagatacaaaaggttacatgttgtctgattccatttatatgaaacatatagaagaggtaaatccatagagacagaaagtagattagaggttcccaggggctgaggaagaaatggggactaactgcttatagggtacagagttttcttctgataaaaatattttggaactagatagacattttgttaggccattcttgcattgttataaagaattacctgagacttggtaatttataaagaaaagatgtttaattggcttacacttctgcaagctttacaggaagcatggtgccgatatctgctcagcttctggtaaggcctcaggaagcttacaatcatggcagaaggtgaaaggggagcaggcatatcacatagcaaaagcaggagcaagagagggatgtggggaggtgacagtcacttttaaacagccagatcttgtgagaactcattcactatcatgaagacagtaccaagaggatggtactaaatcattcatgagaaaccccaccctcatgatcaaatcacctcccaccaggccccacctccaacactggggattacaatttgacatgagatttgagtgagaacacggatccaaaccatatcagagatggtggttatacaatgcgataaacgtcactggattgtacactttaagatggttgttttatgttgtgtgaacttcacctcaataaaaaaaaatatttaatgtacattcagccaaaagaagatttggaataggaaaggtcatggagatatattaacagccatttgatgggtggtaaggaaaagagtggttattagactgttttgtggccctcaaaaggtagaactagatcgagttggtgagcattataaaaccatcacaaaaccctggagagaggacccagtgctgaagaaccgtttgcctgccatgagacatgagggaagtaccagtgaatgccattgaaagcagcatccctgggtccaagggatggtcaaaggaccactacccaacccttccctagcctacgcctccattacagatgaccgcaagatttatttgctcattgctgccaaccaaggctgcactcactgcagttgctatcagtttatcatgggtaaaaggaatgtgcagtagagaactaactaactgcccacctacctccacaatcctatcaggacaaatcaccatggctcacatttccttacatttggcatgtaagcccctcttactgtctgtcatctatctcctacacagttcacctaaactgttctctcctgacccaaccttgattttcatcccaaatgcttccttgccatctctgggattcctgtcttcaccatcaccaaactcccctcaatcttccagtttcctgttcaaacttttctcctacctccttgctttgtcattagcccgactgcctccctaggacatcacttcccctgcagatctctcaagatgacaatatttattctccacacagcacatacttcagggttggaaggcaggggcaatcttctcctttataatgagtgcctcttatatatgtttattcatctgccctcttgtaaaacacacacacacacacacacaaagaagaaataaaataactctgcttctttgaagcttgtgacactgagataaaccatctcactgtcctcattgtagtgacctctcaactcctcatgcaagattggctttggcacctagttcctgatcttcctttccctgtaagcacttctcatagtcttacgggacttcaccatccatggcacaaccaataccacagcccagatcctcagctctccaatgacattttcctccactagacttgagctacctccttccctaggcacagcctcaacctcgacaacacctaagactgtaccgtctctaaagtcacatgttcaaacacttcactctttaaccactgtctcctattcttgcaagtgtattgctcaagtatctcattgcaatgctttttacttctacctcattgaacctccaggccattaaacatttccttatttctaaccatcaggtttctccttacttgtttgtttgtttatttgtttcttttttttttttttttttgagacagggtctcactctgttgcccaggctggagtgcagtggtatgatctcggctcactgcagcctccatctccctggttcaagtgattctcatgtctcagcctcccgagtagctgggactacaggtgcatgccactacgcctggctaagattttgtatttttattagagaaggggttttgccatgttggccaagctggtctcgaactcctaacctcaggtgatccacctgcctcagcctcccaaagtgctgagattataggcatgagccactatgccccacctggtttctccttatttatttcaagtctatgctgcactattaaaactgccttgacaaaaattataatagtgagaaaattatgacagtgaaagagatctgaaataatcaacccccatcttgcctttaccttccagactgcccttaataattcctgagcttgggccaagctatctttggcagaaatttagtttatagtttaaatgataatagcccttctccaaaactaaactgcctttgtaaaactaataaaagaccaccaatgaaaggttaggaggatgagaggagcctgaattctgctaaggtgtagatgtaaacaattaccaactgttattccggaggtcacaagatttgcaacatcgccaattactcctgcagataacagcactatcatagaatctgattggccttttgagatgtcttttcagattcttacatttcaactggtggctctacctggacccatcaacaagtcctgtggctccacccagaagcagacttaacatgcacaaggaccattttccacaccgctatgattgcatcccaaccaatcagcagcaaccattcctctgcctgccaaattatccttgaaaaatcttagccttagaattttgggggaggctgatttcagtaataacaaaaccccggtctcccatttggctggctctgcatgaattaaattctttctctattgcagttcccatcttgataaatcacctttatctgggcagcaaacaaaaggaacccattggacagttacactgttggcagatatatcttgcttccaaaattggatttttgtttaatgaatttattctgttttcttgatatttacaactgtgaatgttgtgtctgaattctctttatttcttgttgaaaagaactatattgctacagccagtacatacagatggatagctaattactcaacacggggggatgtgaccatcaccgcactgtgcaaatgaatgttacccattgtccacttttcccaaactacatagtgttatatggtatatgacccaatcaacggtggcaaagctccagaaataccacatagacatcagggacactttaaactaatcagcctatagtcctttttcagtaatttccaaacctggttgtgcatccaaatcacttggtaacattaaaaaaacaaaaaaatatacacgcaacattcgctcccaatcctactgaatcagaatattttgggttggttcaggaacattcaggagtttttcagggtccaaggtttatataatttgaggtctctctttgagaaaaggaacgtaaaagcgtcttgcttttatagatcttacaaagatgtattaccatgtaaacacattcctaggacccaggcccttgtaatttaaaggtttatctaagtaatgggccctgaagcttaattttcattatcttcagggcaaattacctgtgggttagggtttaggaatatatctctctgtgtatgtgtgtgcacattagcatgtacgcttgtgtggattttttttttttttttttttttttctgagacagagtctcgctctgtcgccaggctggagtgcagtggcgtgatctctgctcactgcaaactccgcctcccaggctcaagcgattcttctgcctcagcctcttgagtagctgggactataggcacgcaccactatgcccagctaatttttgtatttttagtagagttggggtttcgccatgttggccaggatggtcttgatctcttgacctcgtgatccacccgcctccacctcccaaagtgctgggattacaggcgtgagtcaccatgcccagcacttgtgtggatgttttaagctcccaggtgagtgaatacaaaactagatctttcccttctgtagcatctgtactgtttactctatgcatctcaatattttttcttttagtatctttcctttttctctcttattacttcctcttgtgctatttttacacctccttttttaaaaaattttttcccttttatttctattgacctttagccctcacaatgattcctacaagccccatttctgtaaatggggattgaaataattgctggacttttgagagatagatatattaaattgcaaactggcagtagtgggggcagttgatacataactaggttttaaagtctagccttctgagaccactcattccatttgtgaaaagtgattctacttcttattatgagccaaaatatgcattcattcacccatgcattgatttattcattcaataaatatttgttggatgtccactctgtatcaggaatgtgctaggttctgggaatacagcaatgaacaaggtaatttttccctacccctaaggaacttagagtttagtggggaagacagacattaaacaaacaattgtgcaagtaataatctataattatttattacaattaaaggaaggaagagacatatggattatgagggcattaaagaggagacctagtgtaagtagccagttctcgtgaagggacatgtattagttggagttctccagagaaacagaaccaatggtgtgtgtgtgtgtgtgtgcgtgtgtgcgtgtgtgtgttggggtgtgggggtgtggtattttttatagaaattgtctcacacaattatggaagctgagaagtcccatggcctgctgtctacgagctgagaaccaggaaagccagtggaatacttcaaagtccaaaggccctggaaccaagagtgccagtgttggaaggcaggagaagatgggtgtcccagcttaaaaagacagtgaattcactctttttgctctacatagggcctcaatgggttggatcatggccacccacattggtgaaggcaatcctcttagtctaccaattaaatactaatctctttggaaatactctcacagacacactgagaaataatgttttatcagggtgatagaaatcttctggagttaaacaatggtgatagctgtacaatcacatacatttttaaagggtgcgttttatggaaagtgagttttatctaaataaaatttctaagaaagagacttaacacagagataaacataagcacatttattgtcaacctttatagtgttatgtcaaataggtctgacataagcttaaataaatatatactttaaaaattataaaatattttaagttataatttaaaattctcaataaaactcaaacacaaaccacactggtatttcacacagctaatttctaatgcagtttacataaatatttacaacacttaaacaatttcaaagaaaataacactgtattccatacatagcctgatcacagtagttgttctctcttatttcccagagtttttctgcccctttaaaagaacctctgctgttctgatccttatcacatctctgttttgactgttggctttgttgttgccagtgttcagccagaacttctctgaaacttttttttcaacacatgctaagttaatggaagtgtaggagagttttgattctcacactcctcaaggctagagcagctttggcaattactgactgagaatttttcattgccagtgatcaactgaaaactggagattcctttggaattgttaaatctgcttataaataaacataaatgcttgctcacacaggcattcctctcttccagagcaccctaacatacagaagaaaacaaatagggaataactattagacatcttcattcgttaaaaatctaccagatgactcttttacatggtgagtttctattgtgaatttaaaatcttccataatatacaagaattatgtttacatatcatatctgacaaacatctttgtaggaatgcaaagcacatccatctttctgtattcttttccaacaaagacattcataaaattatacctttgtgtgtttgcatttatgcttttattagttcaaaacgtttggcctcatggaagtttttcatcgtggaaaccacatatttctgaaaaaatatctgacaatatacaaaccttccattcagtttttactctccaattctaccatgttttcaaaaaacaactgtagtaaaaacactcagaactttattctggttaacatcatgccttgctaggggacaatagtttccctttttgaaataaatttaaaacagatgtaacataatttgttaataaacaatgagggggtaatctagaataagtaacttttaccatatcatagttgacagcatttacaagttttttaagtccctaccacacttgtattgaatgaagaagtatggaagattataatatattcaatgcaagtaaaaatatcacaatccttaagaactctttaagaagcactgaatcccatagggatgaaagtgattaaattgtgcatagtaaccctcgcacagagcattcagtaggatttgcaccattaacaaccctccatgcatttgcctgtgggcattcaacatctgtcatttttttaagttataatatttttagtcatttttttcctctaaactctggataattattattcattcttatgacagcaactgtgtaatcagctgtcgaaacactgtgaagggcaaaagaaagaaagccacaaaatattgtgtttctgtgccaagattttacagcgagcaagggagagttagaaaaggaattctgagatttcagagtcttggtctcttcacctttgcttggaagaaaatatcctttcccttcattagccaacactttcttgatcctgagagtaggaaagggaacactgagtcttttcagttgaaggccgtccttgcctgctggactttgatctattgaagtggtgatgggtgttgcggtttcagccataaaggcatctggcatagtaggcaagaagggccagagacccgaggagagttatctgtctctgttaacttcagtgtatccctctagttccccagatgcacctgtttctgtaaatataaacatgcatgtcatcagaacacttaatattctgcatactgatcatgacaacaaaatgtaccttctaacacagacactctcactaggatagaccatgtaggaacatcgaattctattcagttaggacagtgatgatgtctacatattatacctctgtcaaaacctacagaatatacaacacagcacagagtgaattctaatgtagcctgtggacattaatgaataataatgtatcaatattggcccatcagttgtaacactaatataagatgttaataacagggggaattgaaggggtggtggggagatatgttggaactctttgtgctttctgctcaatttttctgtaaacttaaaaccgcacacacaaaaaaagttattttaattttttaaaaagtattcagagggacttgacctttccaaattctctcaaagcaggtcggagtagttaagaacacaaattttagaaccagactgccagagtttgaatcctggctacaccacttactagctttgagatttcagacaatttacttaacttctctgtctcattttcttcatctgtgtgataagaaataaagtaacaggccaggcccagtggctcacgcctgtaatcccagcactttgagaggccaaggcgggtggatcaggagttcaagatcagcctggccaacatgacgaaaaaatacaaaatctctactaaaaatacaaaaattagctgggtgtggtggcaggcacctgtaatcccagctactcaggaggctgaggcaggagaattgcttgaacgcaggaggtggaggttgcagtgagccaagatcatgccactgcactccagtctaggcaacagaatgagactccatctcaaaattaaaaaaaaaaaaagtaaaaagaaaagataagaaatatagtaccagcccctatctcagagttcctagcttagaaaaattcccagaatataataagtgcaatgtaagggtcagctatcttcattattattatctatcataaatgaaattacacaataaagctagatccgtttctttcctctccttctacaaaaaataaagcaactttccagaacaatacccaggtgatgatttctcccctgctccctccctaagatattggcaagtttggagggttcaaggagaaacagagcatgtagagaagatacctctctcataaccatttgtgatttacaagtcttacctgattcttttgaacttaaaggatgtaagaaggcttttggtagcttccatctgattcaaggctttggcagctgctgtggaatacatgagaacactaggtaaagcactgtcttccaacatgaagagagaaaaatatgtggaatgttcaatggcatgctttgtataagaatgcaacttacctggcaggaacaaatttctttgctgcaaaagaaaagacaaacaaccattaattcagactaaatgacttttaaggatatattaaatccagatacaatatgacttaattcatcaagtgttgcaaactcgatgcttcagggcctctgtaataatcagagcacaagcatggctctgtggcatctagggtaaaatgcaaagtgcacagccatccaaagggcatagcagcttcctaatgccagcaaatagctacggggtcatcttgcccaattcagctcccaatttttcatgagaagtccaaagtcttaatttaaatgtgagatttcctattttgtaaacgtcagaacttaactcaaaaatgttttaagtactcttaaacatgtaagccaaacaaaccatgagtgtagtcagatgtgcttccatattccttatgagagactctcaaatttaagcctgtactccaaataaatctccttaggaagaattttatccattttccttagagtgctcatcatggcagttccattgcacaattccgggaggcatcatataattcaacatgaatagcaccccctggagttgtacaatattaggcacgactaacatttttatttcctgaaacacttcccacactgagttgtactactaactcttttcttaatacttctgcttaattatactgcattttatccagattctaattattgtttaaatcagtaagcaagaccatgacttatcaatgagaaagaaatgtattttcaaaaacatttttgaagtacattcataaacttcctcacctttccgtaagcatttccgaagccagaggagaaatggtgctaatgtcaggagggagagtccagcagcagaaagtccagctaccaagggaatgttggactcagtgggagctaaggaagtaagagacgaagaaaggtcatgaggaagaattgatgttaaagtctctccgtcctgtccctttggccttttttctgtacattcattactaggagcagaagagctatctagtttaatacaagaagcagagatgtggcattacaggcctttgagatctgctccaagccacctttgaagctatttccaccattggcaggcagaactctaacttgccaagctcgttcacaataccacaccacaccttggttaataaacactgcacttgcttgctctcttgctctcactccctcttgttttccatttcccctttctcctctcctctctctgtctcctttttccagttgtcagaattctaccctttccatcaacatgcaacttctgttttttctctatccccatacaacttaatattcacaacttgtcaacctgggcgaactttctggtttggatataatgaatagttgattactgtaacaagatagctccccctttttctttttaatcaccagacaaccaccatcaatcaatgcatcaccttcacaggtaggtagcaggccagaccagtgtcctgtggctccacatgtccgagctgcagagccattgagcgtccatccttcaggacaggcgaacttgcacacagtgccaaacacgggctccccactgcagctcatgttgatctttcccggaactgccaggcttgaacattttaccactgcaaatgttaggtacacaggcagagtttcagaaaaatctactggaaaacttccaaaacttgcttaaaagtcaacaatgaatgtaaagtgtaagcgctacttagttttcagcatgtaggaaattaggaccaaacccctttggggcaatctaggttcagaaactttatgaagtatttgacctgtaccctaaaaaagtctgcactcaattctaccttggcaggaaggaacctcttctgtccattgtccctgagatgtgcactcaagttgagttgatccatgtaattcaaatccctcctcacagctgaaggcacaagaggacttgtaggtgaattctccaataggggaatgagcacacctcaccaaacccttcgggggctggtggacagcatcgcatctcacagctggaacacacgagagagcactttagaagtttgtttgcatctccagcaatacgtttcccaaggtaaccaagttcccaagctcttcaatagttctttttatcttaaaataaaataaaaacaaagactgtaccttcacatgtgggcttctcgttgtcccactcccctgtggggccacattggagccttttggatcccttcaacacaaaaccctgctcacaggagaactcacagctggacccataacggaaactgccagaagcactaggaagacaattcatgtagcctcgctcggggttggacaaggctgtgcactggaaagctgagacatcaaaatgatggtcagaaaatattgcagtggaactagagagtacttggcgtttgttgagtgaacccagttcattcaagcaacacttggagaactgaagattctttataattccctggacaaatgggaagatggctgtgttttctttgaatttcagccccctcactgatcatggcactaattaaaagactaattaatcagaacattagttcctgagcactgttcttctaacacacaaaataaattatggtccaaggaaagatttcacgcagtctgaggacaacatatgggtcatggatgtttatagatggtgccaaaaagaaagaaaagaaagcacccctataaaatttgtctgttttgcagtttggtttttgtgttatgttttgctactggaaatcattctgtgctggctttggctaggacaaggccagtgcctgatagtaaaaactgcttgttttcaatatccttgctctcactttaaagtgaattaaaatttactgcttatatatgcatcaatactatctctgtagctgacaccatgcttgaaacagtctcatcactgctaattatgagccatttcagaagacaggtgtgatgagagttttacattcaaatcatgttctcattattctgctttccgaattttctaatatgattcctttagattaagaattctgtctattccatgctaatgtctacaaagttttatcagcacatcacagttaaaaaaaaacagcaaagaattcattcttaacacatatgatcctttccctggccaaacattagttcttttaaatgaatctcaaagatacgagggttgctcatcaaatctgatttctatagttaaagtgggtattggttttttttttcactgtccaagtttgaagatggttgttctttaagaaagtataaatcgaaggatctcaagcttaccttcacaaactgggatttgctgtgtccactgcccttgagtggtgcattcaacctgggctggtccctgcaacatgaagccttcctcacaggtgaagttgcaggatgatttgaaggtgaactctccagcaggggaatggctgcacctcacagagccattctgaggctggcggacggccctgcatgtcacagctgtaacaaatatacgcattgatattagcacggcctagaattagcttgcccatttccagtatgggttgagagaaagaatgttcacagtaagtctccatgtggaacaactctacctttacacgttggcttctcgttgtcccaattcccagatgaggtacactgaaggctctgggctcccattagttcaaatccttcttcacagtcaaatgtacaggttgtgttccatgggaagcttccagggttttggaaacattccacgaacccattggctggatttgtcacagcatcacactcaaccactgaggattttaaagagcaccatgaattttacagaagaatgatcttttcacttcctattgagctgggtgcctaacagagtgaggaagctgccttcaaagggtagatcccaaagtcctatgtcaattcttagggacatgcacagccagaataaaagcttttattctttttcatggatattctatcttttctgatttccactttgcctatgctgagtggtctctaatctatgttatcatttacgtgaggtaaaaatttaaaaaaaatagattccagattaggagttatgactagtactgacatacgtaggctattcatttattttagcccatcagagcctgaagaactgatttttctttttttggcctctggttcagaaagataaaattaagagagaaaaagagatactaagactgcttgactatcatggtcttaagttagtcccatggcttggaaaagttaaacagggaaacaagatgagaaatccattgagatttctagagctttattgttttatggtctcccttacaaatcaccagagcctcagaaacacccatttcaagcatagaataaaaaaacctctctcaacccaagcaggtactgggttggcaatatacattggctgagagaacaaattgtattaaaaacaaaaacaaaaaaaaaactttccctgaagttttgaaaatgtaagttgaatcaaaaaacagaagcaatgagggatgagttacagaacgttctgtgcattctcagagggatttaccattgcaggctggaataggagcactccattctccagaggacatacactgcatggtctccatgctgcttggcaggtaacccctatcacagctgatagagcaggaagaattgtagctgaagtttcccagtgggtgactgcaaaccaggcttccatgctcaggggattccagggctgtacagttcacaactgaaaaagaaacccaaatcagttctgctcatctctcacctttaacagataagaacactggaaactagaactacagtttggttttttttttttttagtttaaaaatttataaaatttctaatggaatttgtaaaattgactgtaattctaccccttttcttttattcaagaaaatgctgatccataacaacaacaacaaaaaagcagtgatgacaaccataaaaaagaaatattgagtgatatggggagagtagtgtaattgtgtttacctcaaaactgttcaaattatatgaacaaacacagcaaacttaggtaccacaacaaatttcttgttacttttctcacaactgctaaaaatactacagtaagcttccaaccaggatgagaaccattcacaaagctatatttcaaatttaagtactagaatacattacaaattttaaaaccctaatgctgcactgtctactatagtagccactatctgtgtggctactcaaatttaaacttgaattcgttgaaatcaaataacatttaaaattcagttcctcagtgtcaccagccacatttcaagtactcaataaccacatgtggctcataggtacacactggaaaacacagctatggaacatttccattatcacaaaagctctactgcacaacgctgtgctaaggaatcttggagagaagctcatctaactctcttaatgtacaaatttaggaactgagacctcatttcattcaagtgacttgctccatgctacacggctagtcattacagagccagaggccagagcatgaaccaagataccctggactctgtaactcactcatttctactgcaacgtcttgttaccacctagatgaggtgagtacatgttcctcgcagggacacagaattacagtttattgaatgtgtcctgtgtgccaggcaccatgtaaccatgagcctatgaagttcacactattattatcctcattttacaatgagaaaactgacatagagagttaaactatcttgtcaaggtgccaaaataaataactggtgaatctaggactcaaacccagcagggtctgacttcatagtctcagctcacgatcaccatatgacaccatctgcaccagggaagggaaggcatgcagacctgactctaatgccagctaggacgtgagatggtgctaccatctcaagtgaagaaagaggcaagaaccagacttactttgctcacacttgagtccactgaagccagggtcacacttgcaagtgtaattattgatggtctctacacattcaccgtggccactgcaggatgtattggtacaggcagctacggaaaatacaaagcatgatgaggaggactattactgtgcttatactgagtgcctttgattttagaatcaacagtgtgcaacagagacatcagcagtcctacagagtgccatagactttaactgaagtgttttacaaagttccaaatctgagtttcaggcccacctatcctaaaccttgatgctaatgtatagctgtggctggcacctaccgtagaaaatttacttcttcacaaactctgaagacagttcccctaccacaaataaacaagtaattaaaatatgtattgtgtgtgtgcatttttatatgtaaagaactacatatttgcctacagtatttatatatattttatatatatacatacacacatatatgtgtgtatatgtgtgtatgtatatatataaaatgtatataaatgctgtaggctatatatatatacacacacacatatatgtgtgtgtgtatatatgtgtgtgtgtgtatatatatacatatccacatattcttgcccacattcacacaaaacagcaaaagagagaaactttagcagttaaacagaatcttttggaacataaaatgaccacaatagagagcagtttttgcatgctgtaaatttgccaagatgcccacacactgaaactacctcccactgctgccgcaaactccctacctgtgtagcatagggcaagcttcttcttgctgcacctctcatcattccacatgcccacatctttttctctcttgatgtagatctccacgcagtcctcatctttttgcctattgttgggttcacctggagcccagttcttggcttcttctgtcagaggtttctgggttcctacccagacccacacattgttgacttttctgattccaatccagtaataacttggtgaatagctcaatatggagtttaggtactcaatctcttctttgttttgaattgcaaccaggtgtgtgtacctttgctgacaataagcactggcctcatcataagtcatagcttccgtggaggtgttgtaagaccaggctccactctctttaatgagaagcactagtgggagaaaaagaaaagaaatggtagagtttggtactgttgtggtttaactctgacaactgtgctttttattgtcttatttttggcaatgtttgtgacatggcccagacttttctcatcttttcaaaagtaagaagtacgtatgaagaaacagcgacttattgtttatctcttttgtgactgccacccactaggtaccttatccacactcactcacaacattatagtatacccattttgtagtagaataataatcagaataactaagctttattgagcacttagtatgcaccaagaagcactgtatgaggtactttccatgaaccatgctattgaatcctcacaatgcatctgggaaataggtcattatgatccacactttacacttaaggaaagggagacaccaagaggtaaagtaaatgaccccaagcccagggaagaacacattgcaggtagaggtcaaggatgctgccagatatcctgtgcaggacagccccagacaagcaaggatatttcagtctgaaatatctatagtgcgagaatgagaaatcttggtctaatggcactgacttacccaaagtgagagctgagagaaactgtgaagcaatcatgacttcaagagttcttttcacccaaaggtttaggcttgaaatactttcctggggagataaaacacaaaatgaattaaagaaggaaatcgtgggtagctagttacattattctaccatgatgtttaaggcagcatcctaagattttgggcaaaggacactagtgcaataatctttatttcagagtttaatcaaataaataaacaaattttaagactttcattatttaggtcaaagagaaaagacaggttttagctacaatacaataagagcttgtacagatgtggtttttattagaaggccttttgcatatctgtgtttcatggcccgaggctgcccttataaagcgttctgcacttaccgttttgggaagcagttgttcaaacacaggatctctcaggtgggtatcactgctgcctctgtctcaggtcagtataggagttttgatgtgaagtcagccaagaacagctgaacactacttcggctgaggcccttttataggagggattgcttcctgtgaataataggaggatattgtccacatccagtaaagaggaaatccccaatggcatccaaaaactttcccgggaatatccacgatgcttaaaattacaatgatgtcagaaactctgtctcttgaagctacttcacctttgtccatgcctttatatcgtatatgcaattttattaatatgacaaaaatgcatgatttttaattataataacataaagtctatgtctttaaaaagttgtaaaactttgcttgttagtagtgtctctcatgtagttgtggtagtaattagaatttcagaaacagaaggaaaccaagaataggtttgtcatccatagtctactaccttcaatttctcattcatagctgtggataaccaatcactactcattttttcttcctttttcacctgccaattcaacatatttaacatgcactgtctcacagaggaatgactcacaaggtagatattaatcttcagattttgcacggcagttatgcctaaattaaaatattatctaaaaataatatctaacactcaaatggttaaaataatgccttattttaaaaaaagaaaaatgggaaatagatatttacatctgggaaagtttcatggtttgttcagtgaaaaaaataaaaaggaggccaggcacagtggctcacgcctgtaatcccaccactttgggaggccgaggcaggcggatcacctgaggccgggagttcaagaccagcctgaccaacatggagaaacgccatctctactaaaaatacaaaattagctgggcatggtggcgcatgcctgtaatcccagctactcgggaggctgaggcaggagaatcgcttgaacccgggaagtggaggttgcagtgagccaagatcacgccagtgcactccagcctgggaaacgagtgaaactctgtcttaaaaaaaaaaaaaaaaaaagaaaagaaaagaaaaaaaataaaacggaaaactatatatatatatttaattggtcaaaattttgtttaaaatttttgaaatgttaatgtgcaaagaataaaaattcttccacaatgttaacagtgactaactctggatggcaggatttgggataatttttatatccttcattattattttcaggattttaaagtttttttcaatttccctttttttcacctttatagtaacaagaatacagtttaaagaaacttgtctctaggccaggcatgatggctcatgcctgtaatcccagcactttgggaggctgaggtgggtggatcacctgaggtcaggagttccagaccagcgtggccaatatggtgaaaccctgtctctactaaaaatacaaaaattagccggggtgtagtggcgcatgcctgtaatcccagctactggggagcctgatgcaagagaatcgcttgaacccaggaggcagaggttgcagtgagctgaaatcacaccattgcactccagcctgggcgacagagcaagactccatctcaaaaaaaaagaaaaaaagaaaaagaaaagaaaagaaatttgtttccaaatgcaacagaaggagatgtatgtggtatcctatattcctgctcttcattttgacatttcttctgggtgattgtatacattccccatctctgcatcttaccctatctaaatgatggtaacagtaaatggggatcattttaatttccatattctgtaggttttcagagctcaagtcaagctaatattctatatctacagcctttcaaaataggaggtctatctaaaaatgtactgtcagcagacctgaacgagtagtggtaaaagcctcgtttttctctttacttgttagcactggtctttctgtgttcataaagatgtcaagacccaaaaaaaaaacaagaaaagagaagaaaaattccaaaaaagacaactgattagaaaaaaataacttaattaacgaatttaattcaacccctatcaaaaagcatagaatttattccctccaccttaccactctcttacatgatccagatactgacattattccaattctttatcccactttacttagctcaatgtggttgttgcttcaataaattcagaagagtaatcactcatatagtgtttatttagattttagggcagaatgtcaagttgggttaatacattatctgtatgtattttatttttaataaagtatgaatacataatctgctatttttaaaaagcatggtcaaatgtatagagtagccaaatcttaaaaaacaatttatcttcgatatcaataaagtacctaataattatattgctaatagaaattagtcgttaacatccctagataactaactttattattgcgaatttttcataactaagtttatagtttatctcttcccctttttaaaattagttcaaagatatctaaaaatagccccagtggtgatgaagtttctattttacttacatatatatgtcctggacccccaattataatctctaacatttattgagtgcttactatgtgccaggccatattctgagcattttgtatgttcacctattgattattcaatccgtacaacagcctatgaaataggtactcctattatccccattttacagatgaggaaattgagaatctggggattttatctcattcaaaagcacagagctaagggttgaaaccaggcagttgatatccagagcccactcccttacctgctactccaaaccatgatttcttttgttgttatgccccgagattccttgttctacccaagtttcctgtactcttcttgccctcttcttcctgagacatccttgaccatcacagctctccactgagataactgtgtcctgggttctgagacatgggggctggaagggaccccagggacagtgagcagtagggagaggatgcagtgagaacagaccctggatccccggtgcataggcagggagaaagtggacaaaggaaaaaacaagcaaggcaggtggagccatgcctaggtaaagttgatccctaagccacagttcccagaagttcctgattcaaaagcaaattttctctaaggtcaaagggcaaactgattattctaaattctaaactgattatttctaaattgagaaagcttcagggagagatcccaatattcgaaggataagagaaatgaggagtggaagagataggtgagtaacagtaacttaaatgtagactatatataatatataatatatgtagagtatatatatataattacaatatattatatatgtggaatatatatattatttatatatatttatatattttatatatatagatatttttatattttatatataaatatagatatttttatattttatatataaatatagatatttttatatatattatatataaatatatgtaaaatactgtgaaagaagaatagaatcttgagacctcaaattcactatgccaaagggaaagttaagcttgggaaatgagtcatgcaaaaactgccttccttttgttcccaaatacctgtaatttcacatgcttactttatcttatataaaatgtagatgtactgagcatgagatccatgcataatttccctctagtcccttctttttacatgtaaagtgtagactcactgagtgttacagagccttgccacaatgtaaacacttgtctcattgccaacccatctttcgtttattttcttcccctcctgcttgctctttcccctctaaagatggaagttcccaaaactctctttggaaaaagcgcaggtcacagatcctacagtgatttgtgtttcttttacctgggacaaaataaacctctaatctgttgagatatgcttcagttactttttggtttacaatatgtacatgtatgtatataatttatatgtatataatatatgtacttgttttaaccagaggtatgttattcaaaatccattcatccttacaattacctgcattctcccacagtattttctgtgtccctgcccccgaggttgtcactgcaaatcaggtacatggatactgggagctgatgggctcccctctggctacctgggctgctgaaggggccatagacagacccagctttcctctcgtggagaggccctgggccagcgctgcgtgggagtgggattacaaccagactatagcttcttcacctgctttttcctatcaggatttcataagaggcaattgcttgttttttgagggtgggggcaaatcagggggagttgaagaggaaattgggtaagatttgaatagttgggcatgttgaatattatgaatatcatctccctcttcaaataatccaaaatatacccccaagaaacaggctgattagaggtgcttcaaggctccactgaatctcccaagctctgaagatgtagctagctgttaccggattgccggttttcaagcctcgcctcacatggaccctcttggcagtttctcgcatgggggaagcatccgctacatagatgggaatgaaaagaggaaagaagacggtgcaaactcaggcacaccccggtgtctgccaccagtgctatttaatctctgaggtgtcacccttcctggctttattgtctcttcctggaagtctcttgtcctctcctccacaccctttaatcaggcatcaaagactttaaccagttttgctgtgtgcccaggcccactcattctcacttttatggcaaagggagtgggagacagagagatagccagaaagaagagattggggaccccaagacaaatgttagaattttaaccaaggccaccctgtggacaggagattattgggtttagtggaaagcagcactggccacaaccacacgtggcaaaagcatctatcgaggagtgaagttatatttggtgaatgtgaccgggaagcaggggcagtggtgtcctcctgccttcctgaggcactctgttcccttacctctgcgaaggcttattttacccctgagtgcttagttttgaaagccttagttccctctctcccataaaaaagctctactctgctaacatctaagttacctttgcagagtcttaggtagagggaggaaatcccaataaagattccaccctatctgcaaaatacaaacatggtatttcttgcattcccaaaattgtgaaagaaaatgtgtatcaccacagtagagaatggcattttttgtttgatcaaaacctaaatatatttgatgaaaatgtgtctggttctaagtttatttcccagaaagccatgtttactcacttggaatttatagacatcttataatatctgagtcgagtaggagctccgggctctacctcactcttttctcccacacccagggggaagtgtagggttctcagactttagaataaagaggaatcacctggacaactcacctaaaatgcacatcttcaggtctcatactcagaggctctgactcaacaggtctgggtggcgcccaagaatttgggctttaaatgagtatctcagatgattctaatacagaatgtgtaagatgaccagatcctatcacacttagatgtattggcctagggccacctaacttggagaaaatgttagtaagaccccgtggttggtgctcagctataggtaccagaattttgatcaaaatttactatcattgtgacacttctcttcggaactggaaggccagaaccccacttgtaaagtgctgggaaaatacaaggaaaatttagggtgagtagcattttgaattcttacacatggaaagtaaatgtataagaattcttaccaataaaaaaaaagcaagagagaatagctgctaaagaattaacacaaatatgtatatattagttattctcttttctcctctgattccagaggactttgtaattccactaattcttcttgagcttccaggatgatctgagacttgaatttttcatgtgctttttgcttcctatttggcagcatcttatcttgaagtttccgctttctgcttggggacctaaaaactaactaatgggaatttcttcaaaatgagcaaactctggtgaattcccaaagcggaagaaacaagtgaggatcgggctggttaattaagagaacttttcctgaatgtagccagactgtttgccgactgttgttaacatgagggaagaaatacccctggattttagaagagccccttgtttgttttccttggccatttgtgctgcttgttttgtaagtcagaaatttcctgaaggactattattagctttgttctcacgtcagaaaacttctgctctggccacttttaaacatataacttggattttactgtattagaaaatgtaacaattacagacagcactaaaaggacaccaaagggcaaagaaaatgggtaacttttttttcttccccaaatctaaaataggtgattttggagaagtaggagaaaaacctggattttctagatctctttagagctcaacaactgatatagttaattatgtaagtctttgatatttggaaatgattggattaaccggataacaatgaatatttaaatacagtgatttggccaggagcagtggctcatgcctgtaatcccagcatttggggaggctgaggcgggtggatcacctaaggccgggagttccagaccagcctggccaacatggtgaaaccccatctctactaaaaatacaaaattagccaggcgtggtggtgcaagactgtaatcccagcaactcgggaggctgaggcaggagaattgcttgaacccgggaggcagaggttgcagtgagccaagatcacgccattgcactccagcctgggcaacaagagcgaaattccatctcaataaataaataaataaatacagtgatttaacacaagagatttctatttcacactaatgagctctgtcactggggcaagcttctttgcctcattaagtctcagatttcccgagagcttatttatttataccaagagtgctttactaccgtctctgctagctgtgacataatatgacaaaaggtataaatatgggaaaaggcactaatttatatcaaagcgttcttcgtttttccttgctgtgaagtttttagctaataattcataagaatataccatatttagagtgtttactatgcatgggcctggcacttcacatacattgcttcttacaaattttacaaagtgaaaggtagatattaatctcattttatggaggacaagatagagatctggagaggttacataacttgccagtgttttttcagttaataaatggtagggtggagattcaatctgtgttactctaaagtccgtgtcctttttattggctccatgcctactcagatttaaatctcagcagggaagtaaaccttagtttttacatgagaaaatgttacagcagccttctcggcttcctttacccccatcccagtttcacgagcttagtgccttagatcgggttcctttagaagcagacctcgaaataaggatgtgggtgccagtcatttattgaaaagatgatcccaagaaagcctagtaggagagtgaggaagtgagatggggaaaggaagaaactccacaagaagtgtgttaataagcaggttaccgctgtgggcagccatggggctcagctgcactaacaaactctgtctagtacagaaaacctcagggtctccccaaggaggggcaagaagtctgcctagggtatatatccgccaactcagtcactggctgagagctgatcctgggagggcatggttaattcctctgcactttcaagtggattcctgtggtcagaaaaagccctctacaatgaattccagatgcttgtatttaaatctgacatgatctgaatgctgtgttgggacagggtgggcgttattagttttctgtcattactgtaacagattactacaaacctgatggctgcaaacaacacatatttattatgtcatagtttgtgtgggtcagaagtacaggttagctcaactagtttctctgctctaggtttcacattgccaatatcaaggtgtcatccagttgggctcttcttgggaggcttggggatgaatccactttcaagctcattcagattgttggcagaatccagttccttgtggttgcaggaccaaggtccctgttgccttgctggctgttggccaggagtcattcttagcttctagagactacctgtactctctgactcgtgtctccacttcacctttcaaaccagcagcggctagtcgagtccctctcttcaaatgtctccaactgtgccttcacctcatttctcctctgtgtaccatgtctgcctctactgcttgtaagggctcatgggattacattggatttattcaatccaggataatctccatattttaaggctagctgactagtgatcttaattccatctacaaagtcccttccaatagtactgtattagtccattttcatgctactgataaagacatacccaagactgggcaattcacaaaagaaagaggtttaattagatttacagttccacatggctggggaagcctcacaatcatggcagaagtcaaggaagagcaagtcatgtcttacatagatggcagcaggcaaagagagagagcttgtgcagggaactcctctttttaaaaccatcagatctcataatacttattcactatcacaagaacagcatgggaaagtcttgcccccatgattcaattactcccaccaggtccctcccacaacatgcaggaattcaagatgagatttgtgtggggacacagccaaaccatatcaagtacctagattcatgtttgattaaacaaccagggagcagaaatcttcaggagtggggggcatctttagaattctgcccaccaaggctgggcgcggtggctcacacctgtaatcccagcactttgggaggccaaggtgggtggatcatgaggtcaagagatcgagaccaccctggccatggtgaaaccccatttctactaaaaatacaaaaattagccaggtatggtggtgggcacctgtagtcccagctactcaggaggctgaggtaggagaatcacttgaacccaggaagcggaggttgcagtgagccaagattgcgccgctgcactccagcctgggagacagagcaagactgtctcaaaaaaaaagaattctgcccatcatagtaggctgtcctacagagacataacccaggaattaggtgaatggctaacctaaattagcactgtgatgtgttttctgacttggtccttatagctcctctgcttagatgtggaactaatccatgaatgcaagggtttgtctagagttttaagtgggagttaaatatccaaagtacaggagatattatgggtgcctcatccatgtccccttggcatttatctttcttggataacccaactctattagtttttatatctcacttgttcctatactctgtgaactgatgtcccataaatagacatttcattttgccagtcttcttgaacaataattacgattattaatctagcagttatcattaattggccacttcacattagacacagcacttaggacttaagaataccatgtcatttgatcatcataatatggtcaggaattaagtattgctatccaaattttacaaagaaggcactgagggttagagtttaaataacttgcttaagatgtcatagcctgtaagtgacaaaactaggactcaaatacaggtccatctgactccaaagtctatgttcttggctaccacactgcctctcctacaagtgacctgtggttttactactatattcacactctactaactttaccatctcccatgagtctgtctagaggagggcacacacagcacagaaaacacatgaatgcaaaataaggaagggcctacttactacacagagccattctaatacctgatgtttgctctaatccagttttactattaattagttgctggtgcccaagtttttactgagaaatggggataattttggaagtcataatgatgccttcttctcatagggtattttatttgttgttgtatctccaggccccaacacagcctggcttttagtaaatgatcaaaaatacctgttgaatgaataaatggagtcacctgaaacatgttaaacatttgttcatgtgtcctaatcgtggatttcaggatagtaagcatcctaaaaggaaagcatgcacactgttcttgctacattaatttctcacaatataaaaaaagaaaagcatctgaaaaaagctgccagccgctgtgtctcctaatatcaaactgagcacagatatggagaagctaagggagagggatgatgggccatgcctctaacctcatcatggcaaaagtcctgggggtcagacccgaggagagcaggaagtgtcttttgagggatacatttccacagtggaaataatgagacttaaataaatattatatacacagttcaactgtttttatgtgtaaaggtagtaggttttcacagtaaggaagcacttctttttttttttgtttgagacagagtctcgctctgtctcccagcctggagtacagtggtgctatctcggctcactgcaatctctgcctcctggattcaagtgattctcctgcctcagcctcccgagtagctgggacaacaggtgtgtgccattacacctggctaatttttgtatttttagcagagatgcggtttcaccatgttggccaggctgatctcgaactcctgacctcaggtgttctgcccgcctctgcctcccaatgtgctgggattacaggcatgagccactgcactcaccaagcacttctactgatagcatttacaaacccttcttagaatatttaaaaattctaagagaagagtaaattgagccttcccaactaatactaggaggttataaccttcataccaaaactggacaatgcttgcacaaaagaaggaagccaatgaggccacctagaaggaagactgggcattgggcccagtgagtcctggaaacctcatctgtgccagccaccccggcatggcctgtatgagtggatgagggtgacttgtccacagacaatagccatctagctgtgataaaggagtcaaggtagtcagctgcatctctttcacctgtttgccaatgttacacaggttgaaaagctaaggtttatgtaaagcaagcatcaaagatgatgaaatgatcaacctgacaatgagtactatgctgcattgtccagaaaggaactgtggaagattttgggctgaatttcaaaacagaatttcctcactctctggatgttggcttacttggcctttgatgttcagaggtggtgcctttgtgttgttgaacaatgttgattttggagagaaaacagagttgaaaaacccacaagtcattccctggggagtattaccggaatacagaggataatttcagcaagccagcaaggcctcatctctgcttctaatagataggaagaaaggaagagaggaacaatacttttttaagaagctcagctttatcgccttatctcatagaaagatgcctccagtctgtctggctaaaggtaattggcatgggaaagtctttatctgtgattctaacaagtggaatgtttcccttcattaagagagccttgtctggcttggggaaatgaaacactttctccgatatgagtgggctgtaacccctgctactaaatactcagaagaaataaggcggttgtggagcagtcaggaatgagtcacttgcctccctggaatattcagaaaactgaatcaaaagtacattcttctgggttttcttagtctaatagactaagggtctctactttgttaaatttctgggaaacagcatagaatgggagaaaaaactggtcactgtagtcatgcaaatctgcaaaacaaacaaaaaagtctgggtattgctgctaactagctatgtgaccttaagcaaggtattaactctctctgaatttcaggttcttcatctgttaaatagcatatctgtaaaatgggaattattttcatatcataatgctgtagctttaaaaaataaaataaaatggatgagataatcagaattaaagagcctgggatatatagttaatatatagcagcatgtaaagatcctgttagaaatgctaattttacagttaaccatttggagatgatccgccaaagctgctagtgtagaggcaactgagaatttgcctgtccttcagaatatgaataaataactgtcaatgatgtctcaagcctagaaaaacctatccatctggatgggtgggaaatttctaggctagtattgagaagcccatttcttgggaaataggtcctggactgagtgaaggaaaagaaacagtaaaacccatggtaaagcagcaaggctctctagaggctctggagaggatgaattgaattctagaagatgaagtagggaagacgctttaccttcttgtgaaatggattcaaagattcaaagaccttcgggaatctccaattgtataaatggcaccatagctgtatgttccatggaacactacttcccagagatgcccagtgaaaaaagaatgccacagtcaaataagtttggaaacactccattatgtggccacctccttgaagactctaatgcacattagcatgttaaacagtcttgagaagtcctgcagagcagaaattgcttcacatctgctaagccggcagtttcccaatatacttgattatggatagttttttccttacaacaccattctctgatatgcttccaatgacatgaaataaatatatatgcatgaggttcttcattagggcatactttttaatagaaaatattgagaataatctaaatataaatgcacagcatttaccttttctgcataaactatatacaggcataccttggagatactatgggtttggttcccacaatatctccaaaaccacattcggttttatgaccactgccataaaaccagccacatgaattttttggtttcccaatgtatatcaaagttacatttttactataccatagtctattatatatacaatagcattatatctaaaaaacaacgtaaacaccttaatttaaggctgtggctggtttgattttctacccagaccactaaaactttcttcatatcagcaataaggctgtttcactttcttactattttttgtgatagcacttttcctttccttcaagaatttttcctttctattcacaatttgtttgatacaagaggactagattttagcttatctcagtttaaggtgtttacattgttagctaaaaatgctaatgatcatctgagacttcagcaagtcataatcttttgctggtggaaggtcttgcctcagtgttgatgtctgctgactgggtggctttggcaatttcttaaagtaagacaacaatcaagtttgacatatcaattgacccttcctgtcataaatgattttttttttctctgtagcctgcaatgctctttgatagcattttacccacagtagaattttcaaaattggagtcaatcctttcaaactctggtgctgttttatcaactaagtttatggagtattagaaatcccttgttgtcatttcaacaatgttcacaccatcttccccaggagtatattctacctcaagaaaccactttctttgctcatctataagaagcagctcctcatccactaaagttttatcctgagattgcaacaattcagttacatcttcaggctctacttctaattctagttctcttgctgtttctatctcatttgtgcttactttctccgctgaagtcttgaaccccttaaagtcactcatgagggttggaatcaacttcttacaaactcctgttgatgttgatattttgacctgctcccatgattcatgggtattcttaatggcatctagaatggtgaacgttttcagaaggttttcagttggctttgcccggatccatcagacgaatccctatctatggaagctatagatttataaaatgtatttctttttttgtgggggcatagcgtctcaccctgtcacccaacctggaatgcagtggcacagtcataactcactgaagactcaaactcctgggctcaagtgattcttccaccttggcctcccaaaacactggattacaagcttgagccactgtgtctagcccaaaatgtatatcataactaatgaggcttgaaagtcaaagtgactccttgatccatgggctacagaatggacgctgggttaccagacatgaaaacaatactcatctcctcatacatctccttcagagctcctgggtgagcaggcccattgtcaaatgagcagtagtatcttgaaagaaattttttttctgagcagtagatctccacagtggacttaaaatagtcagtaaactatgctgtaaacagaagtgctgtcatccaagctctgtttttccactgatagggcaaaagcagagtagatttggcataattctctagggccttaggatttttggaatggcaaattgagcattggcttcaacttttttttttttttttttttttgagacagagtcttggtctgtcacccaggctggagtgcagtggtgcaatctcggcccactgcaagctctgcctcctaggttcacaccattctcctgcctctgcctcctgagtagctgggactacaggcacccgccaccatgcccggctaattttttgtattttagtacagacggggtttcgccatgttagccaggatggtctcgatctcctgacctcgtgatccacccgcctcggcctcccaaagtgctgggattacaggcgtgagccacagcgcccagcctgtcttcaacttaaagtcgccagctgtgttagcctctaataagagagtctgcctgtcctttcaagctttgaagccaggcatcattctcttctctagctatgaaaatcttagatagcatcttctcccaataggaagccattttttatgccctaaaaatctgtcgtttggtgtagccaccttcatcattgatcttacctagatccgctggataacttaccacagtgtctacatcattacttctgcttcaccttgcacttttatgttatggggatggctcctttcctctaacctcataaactaacctccactagcctcacattcttcttttacagcttcctcgcctctctcagagttcacagaattgaagaatgttgggccttggattacactttggtttaagggaatgctgtggctggtttgattttctatccagaacactaaaactttcttcatatcagcaataagactgtttcactttcttactattttttgtgatagcacttttcctttccttcaagaatttttcctttctattcacaatttgaccgtttgatatgagaggcctagattttagccaatctcagtttacaccatgcctttttcactaagcttcatcattttagctttttatttaaagtaagatgtgtgacccttcctttcatttgaacacttacatgatgatgcctggcttcaaagcttgaaaggacaggcagactctcttattaggggctaacacagctggcgacttttaagttgaagccaatgctcaatttgccattagaagccattgtagggttaattaatttgcctaattttaatattatggtgtctcagggaataaggaggcctgagtagagggagggagatggggaaacagccagtcatcagagcacacacaacatttatcaattaagtttatcaccttgagggcacaggtcatgatacttcaaaacaattacaataataaaataaaaaatcattgatcgcagatcaccataacagatataatgataatgaaaaatttgaagtattgtgagaattaccaaaacgtgacacacagacacaaagtgagcacatgtcattggaaaagtggtgctgatagacttacttcatgcagggttgccacaaatactcaatctgtaaaaaattcaattatctacatagtaccataaaaacaaggtatacctgtttatataatcaagaccaacagaaccctagagaaaatagctcactccctagctcggagacattctaaccaacatacacttacctttctttttgctgtgtacagaattcaaatccctgtctcagcaaaattgcaaagtatcaaatgtcatgtccatctaatactcaaaactgcaaatgttaagtcttgtaagcccagagaccactgtatatacaagtgttgctataagcattagttcttctccaaagaaaatagtccacttggtagaaacaaacaaaaagaaaaaaaaagaaagaaaaaacattttttacaagaagattcagtctcttacctacataagcaaaaatatgagatgttctcttatcatttttccatctatcttataatctttggtgctgacttagacactcattttcctttttgtacgtgaccatgtaaaagttcaagtcaagaaaaacttgttttgacatttgttttgctgagtgatgggtccctaaaagaaatttggctttgcttttgaaaagttcagcatgatattgtgtgaatttttcatggctaatgatttttagaacagttgtgatgtgtttaggtgttttaagaatatgaagcattcagtggtttaagttggttgttataaaatgaaagaatatgaaggaaagccttcttgtcttagaacacactgattcacaaataagcagcttctctcaaaatgttgtaattacaaaaattccaaggcaaatataataaactccttgtcggtgctatgtctagaaacttaacagccccaaagaaagtcctgacaaggcaaaaaatatatatatatatacaaattgtggaagcagggtgttgaaagaagaataaagactatataaggacaaactgtttaaaagggagggtatccttgaaagcttgacacttgactcttttgacgaggctgagggaaaacactcagtttcatagattgctggtacggatgtaaaatagtgacatccctatagagaggaatttggcaatatctagcaaaagtgcttatgcatttattctttgacctagtaatcccgcttctaggattagtggtgaagatacacctcaacaataaaaatatatatacattaggttattagttatggtttaatttttaatagcaaaatatttaaaacaacctacatgaacaaataggagacttactgaataaactatggtatatctgtacaataaagtgcaattcacttatgttgttaatttgttccaaaaatccagagccaaagagtatttgttatgctctctttagtataagaaaggggaaataagatatgtgtgcatctgtttatttttgtgaaaataagtacagaaaggataagtaagaaactagtaaaactagttatctcctagtgttagtagaaatagaatgaaagtgaattaggcttctttgagtatatgtttatatatagttttgacttttgaattatgtttatgtttacatagtcaaaaatataaattaatcaacagaaataacaaaaaaagaagaaatcacaagctttaaaatttaatacaaacagaaataattgaatctaacagtatatcaaagtgataacgtaaactcagaagaaaaaaacataatccaacataccagtggaacacaatattctaactgtatacattcagtggttatagtctaaggacaagaaaaattgcaaaaatatcttgaactttagcttgtaggatttttattggtagcaatactaatgtactaattctgaaattaatgttcgtgtattatagaattgagtaaatgaataaatatgttgatgttattgggaactaaaattatcattctgggagtagagaaatataaatatggacttggcaaatgaaacaaagacctgcagagagataaccatataaactcattattttaaaaattataagtgtcctagctctgttactgaaaaggcctagattcaatcttatcttgatagacaggagggcacccctttctcagaacatggtttccaaatgccattctccattaaaaggaacaaggtcttcttggagaaaagactgattctaggtctggattaggtaaagtacaacgttagtctggaatttcttgctgaatcagaagtaagaaagtgctcaaaaacatgggaacatgtcacaaacacacgtgaggcaacttgaatcctcactggccatatttaggacaatcgagcatcaaaaaaaaaaaaaatgttgagaataatggattctaacacttaaaacaaaaaataatccatagcccacagaaggggaagagagggggagctcttatttacagatgaatatcaaatagcaaagacagaagaaatgacagaattagagaaacatcattttgcaaaacaccactgtaataatcaattcaggcaagtattattaatggatgtattactattgcgtaaaaccagttggggaacaggatattcatacagtctgaaggtgtcaccctaaacataacttattacaagtggaaaatggtgcctttacaatgaagaaatctagcagaaaccatcttaatctagtgatcaaacttagtatcaccaataatggatcatactgagtcatgtgtctcctaatatgatgcaccaggaaggatgcaacgtcatgaacgttgtattcttttgtattcaacagaccacccagggtaaaggcagctttctcacttactaatcagaattgttggttttaattcattttggattttaagatttcttactttcttgtcagctcagaaatttatttaagatgatttttatcttttattcaatactttagcttggagaaccattcagagtttctaactcattgtattgccaaaaatagaaaacagcatggtttcttttgaaaatgtctaactttaaagttacttgtgtgtgtcactcagattcacatagcttttttgcctagtaatgtagtatcatgtggcaaggctataaaaatgtttacaatcttttatttaatatgactcttgagagtttattctaaggaaataattgaatagtaacaaaacactattaacacaaagcatagcaatttgatttgggcaaccaaacactggaaacaacctaaatgtccattacaggaatcatttatgaagcaaacactaaaatatttattgtgaagattatgagaacatagaagacagttatgagagtaaatttgaaaacctgaacacaaaacttacatatactccaattgtaacttataaaaaatacgtgcatataaggataaaacagtacaaacaaaaaaatagttgcgttagattggtagaattatggctccttttgctgtcttaattttttccttttacattttgatacattattttaattttaattttaaaattcaaaagaatttgccactcatctttgccacttcaaggaaaaaagaaatgtgttcgattattctgttcttagtatagttttggcaatttcctcacgtgtaaaaagagaatactattaataatttcagtatctataagacaatataaaattaaagaatctagcccagtaactggtacatggaacgtaattaataaatcattatggactttttttctcacacccaagtagggaggaatcagtggtcccctagaggcccagtgtagaggtggcagcaccaatccctaggggagaagatcttggtgatgataattcctgagcagacagttagctgagaattcaagagcagaaaagtaagaaagaaacaacttcttgctaacacctttccacccacgtttccctgttctgttgtactctgcttaccctttcatggatggaggcagaggaaagagaaccaagtttgctcttagtcattcactatgttgtttaatctgccttccatctttcttatcagttcaaattagaatgtagacctgaatttaaatccccgttctgtcagttataatgtgaccctagacaaaacacattctctgaacctcagagaacattcttcatttgtagaatgggaagattaatctatattccacttggatggcaagtcttttataaactttataacctaaacatgtgtgagttgctagtatcattatgttggtaaagttattctgagatatgataacagaactgttttgtctaactccactagcatggttcaggtttagagagtgtggaattaaaaggctttatcctcaaatatgacttaaatccgatttttctcatccactttcctccacaaacaaatcctcaggaaatgacaaactttacatggttaaacatcagttttgtttagtctttgacatccacatggttaaatcatacatttgaaaactgcttatatttgtgttgtctatgtctaaattgaaaagacttattgaggaatagaagactacacatttttcagcaaacactgcacgttttgcagaatttccccaggcaccagtctccaggaatttattggctactaacaatactaagatatggatgaatgaggaaatcaaaatggagatcttgcaagttttgtgagaatgggtgaatggtccaaatgaagagataagttgtgaaatattagtacaagtaaaaattatttacaatgaaagacattttgtcaatagctatgagaattttaccattgacccagaaattccatttctttcttcagaaatacccacgtaggtatacatataaaaagttattcattacagtatcgtttttcataggaaaaagttttaaaaatcagaagctatctaaactatggtatatctaggtcatagaaatcaaatgactaaaaatgttaatataagcatatgtttttaaattaacttggcttgggtcttcagcaaaattggcttcttaacattgcactccagagttagacttacccactcagtcacttatcatgcaggagcagactcctaataccacatatcatagagcagagtaggacacaggttctctgcaggcaggcaaatcccaaagagaagggaggaaagggctgagacactgcatggtcaatttcttctgaactctgcaatgtacggaggtggacagtgtccacaaagattgctcccctggacccaccatcataataacacaacggctttgttttgtttttgtttttgttttttgacacggagttttgctcttgttgtccaggctggagtgcaatggtgtgatctcgactcaccacaacctccacttcctgggttcaagtgattctcctgcctcagcctcctgagtggatgggattacaggcatgcaccaccatgcccagctaattttgtatttttagtagagacgaggtttctccacgttggccaggctggtctcaaactcttaacctcaggtgatccacccgtcttggcctcccaaagtgctgcgattacaggtgtgagccaccgcgcccagcccacaatggccttttgtttacatctctagtgcagcactcatttcatgttctttcaagaagaatacatatttcatctttttattttatacagcaattagcacagtgcctggcataaggaaaatgatcattaaaagctgggtgaaaaacctaataaagctactgaggataggaactgcagaccagcatggaaagaaaactatgagccagatattgacatcatcctgaaaggcagaagatttagtataggcaagaagtatgcttttggaatatagaaaatctggattatgataagaaaagaatcatatttgtcttatcttacctactcacttctcagttccacatgtttctgaggctgtttgtccttactttcttttctgttttatccactctttctgttctttagattggatcattcctattgagctgacatcaagttaactgaccttttattttgtccaaactgctgttaaatgcatccagtgaatttttaactttatatagtatatcttttagtcctagaatttccacatgagttttttaagtttccatttctctgctgagatctcctatttgttcattcattatgaccatatttttctctacattattgagcataattataacagctcttctaaaattcttgtctgcacattctaacacctgaattattctggggtcagtctctgttacattgccttattacaaaaacagtataagtcacattgccttgtttcttaatatgcaaaatgatttttgattgcagactagacattttgaattaaacattatagagattctggattctcgagagagtattgacttgttttttccatcaggcaggtaacttgactggactcaaactccaaactctaggtcctctgtaatgggcaactgcagtaatctttgtttagttctttaagacttattggccaggcacgggggctcatgcctgcaatcccagcactgtgggaggccaaggtgggaggatcacctgaggtcaggagttcgagaccagcctggcccacatggtgaaaccctgcctctactaaaaatacaaaaattagccgggtgtggtggtgggcgcctgtagtcccagctactcagaaggctaaggcagaagaatcacttgaacctggaaggcagaggttgcagtgagccgagattgtgccactatactccagcctgggtgacaaaagcgagactccctctcaaaaaaaaatttattggcactgcttggcatctgctatgaatacatgaagttcatgggtcagctatagatctgggcacgttatacacagaatttgggtctccctttctctggatttctccttttctggatttcttttctcattttccagcagctgtggttgccctaaactcggtcctctgtttctttacggcagtaagatttgggaacttttaggttttacctgcctctcagacaaaataaaaaataattttcatcttgatgctactcctttcttccagatgtagacacctctctaatttccagttgctttttattgctctccagagtctaaagattatcattgttttctgtgggagagttggtctgataaaaactactcccccaaaactggaagctggaagcttgtaattatgaatagactttgagtagtattcttctttggaaaaggattttaactactccctatgtacttctttatttcctgtttttctcatccgtaatctttttattttcatacttcctaagtcagacaattttcctacttgaagattcagtgactgctatcaaatgacccccatattactaaatacaatatccccaactgcatttataaaaagaaaatttactgtttattagtaaacaatgttgtagaatagtaaaatattgctgggctttggagccagataatcaaggttagaatcccagattctaacttactagctggtgtattagtcctttctcatgctgctaataaagacataccccagactgggagactgggtaatttatgaagaaaagaggtttaattgactcacagttcagcatggctggggaggccttaggaaacttacagtcatggtggcagcaaggagaagttccaagcaaagagggaaaagccccttataaaaccatctgatcttatgagaactcactcactatcacgagaacagcatgagggtaactgccctcacgtttaattaccttccaccagttcccccccatgacacatggggattatgaaagctataattcaagatgagatttgggtggagaaatagccaaaccatataattccacccctggcccctctcaaatctcatgtcctcacatttcaaaactcaatcatgccctcccaactgtcccccaaggtcttaactcattccagcattaagtcaaaaatccaagttcaaagtctcatctgagacaaggcaagtcccttctgcctatgagcctataaaatcaaaagcatgttagttacttcctagatacagtgggggtacaggcgttgggtaaatacactgattccaaatgggagaaattgccaaaacaaaagagttacagaccccatgcaagtccaaaacccaatagggcagtcattaacattaaagttccaaaatgatctcctttgacttcatgtctcacatccaggtcacactgatgcaagaggtgggcttccaatggccttgggcagctctgcccctgtggctttgcagggtatagcctgcttcctgtttgctttttcacaggctgacattgagtgtctgtggcttttccatgagtatggtgcaagctgttggtggatttaccattctggggtctgggccaggtgcagtggctcatgcctgtaatcccagcactttgggaggctgaggtgggggatcacaaggtcaggagatcgagaccatcctggctaacacggtaaaacccagtctctgcttaaaaaatacaaaaaattagccaggcgtggtggtgggtgcctgtagtcccagatacttgggaggctgaggcaggagaatggcgtgaacccaggaggtggagcttgcagcgagctgagattgtgccactgcactccagcctgggcgacagagcaagactccatcaaaaaaaaaaacaaaaaaaccattctggggtctggagaatggtagcccttacagcaccaccaggcagtgccccagtggggactctgtgtgggggctctgaccccacatttcccttctgcacggccctagtagaggttctccatgagggttctacccctgcagcaaacttctgcctggacatccaggcatttccatacatcctcggaaatctaagccgcggaggttcccaaacttcaattcttgactcctgtgcacccacaggctcaataccacatgtaagccaccaatgcttggtcagggcttgaaccctctgaagcaatggcctgagctgtacgttgacaccttttagcctagacatctaggacacagggcaccatgacccgaagcttcataaagtgggagggccttgggactagctgaggaaaccatttttccatcctaggcctccaggcctgtgatgggaagggcagccatgaaggtgcctgacatgccctggagacgttttccccattgtcttggtaactaacattcagctccgtgtgcagcaccaacttacttatgcaaatttctgtcactggtttgaatttctccccagaaaacaggatttttcttttctattgcatcatcatgctgcaaattttcaaacttttatgctatgcttcctgttgaagactttgcggcttagaaatttcttcccccagatacccaaaattatctctctcaagttcaaagttccacagatatctaggggacaaaatgttgccagtctctttgcatagcaagagtgacctttactccagttcccaacaagtttctcatctccatatgagaccatctcagcttggacttagttgtccatgttactatcaacattttggtcaaagccattcaacaagtctctatgaagtttcaaacttccccatgttttcctgtcttctaatagccctccaaatttttccaacctctgtctgttacccagttctaaagtcacttctacatttttgggtatctttacagcagtggcactccccatggtactaatttactgtattagtctgttctcatgctgctaataaagacttactcgagactgggtaatttataaagaacagaggttcaactggctcacagttcagcatggctgggaggcctcaggaaacttacaaacatggtggcagcaaagagaagttccaagcaaagagggaaaagccccttataaaaccatcagatcttgtgagaattcactatcatgaaaatagcatgagggtaactgcccccatgattaatttacctcccacagggtccctcccatgacaggtggggattatgggaactacaattcaagatgagatttgggtggggacacagccataccatgccagctagagagccttaagaaagtcacctaatctccacaaataaaaggtttcctatttgttcaacaaaaataatgacaccccttttatgggatttctgtgaggacaaatgataactaacatagccttgcatagtgtctggcacaaaatagctactcaaaaaataatagaaacaacatttaaaaaatgtagactttattttttagagttttatgtacaaagcaaaattgagcagaatgtacagagagtttccgtatagcactccctacccccaagcacagatagcctcccccagtatcagcatcccgcaccagagtggtacatttattataactgatgaatctatattgacgtgtcattttcatccaaaatccatagtttatattagggatgcctcttggtgttgtaccttctatgggttttgacaaatgtataatgacatgtattcaccattacagtatcataaagaatagtttcactgtcctaaaaatctttgatcttcttcctattcatcactccctccccattaatccctgacaactactgctaattttcctgtctccattgttttgtcttttcctgaatgtcatatagtttaaatatacagtatgtaggattttcaaactggtttatttcacttagtaatatgcatttgatgttcttccatatcttttcaaagcttcatagttcaatatttatagaattgaataatattccattgtctggatgtactacagtttatgtattcattcacctatcaaagaacaccttggttgcttccaagtttcaacaatcatgagtaaagctgctataaacatctatgtacatgtttttttgtgaattgaacattttcagcttttttagctccattcctaggagtgcaattgctggattgtatgataagggtatgtttagtgttgtaagaaactgccacgctcttcctaactggatgtactgttttgcattctcaccagcaatgaaagagttcctgttgctccacatactcaccagcatttggtgtcgtcaatgttttgagcaatagcattttgatctaacttttcctaggtattctttttgaaggaaataatatgacagataatagagaaaggatatacgaggacagttctgtcctttatttatagtccatcatttaatgaaggactctgtccacacttggtatttttaactctgatcctcctctcccatgaactctgacaatctcctaaatccctgttgctggcacacatggttgtgtatcaggccccctgtggtctgtctgaagcatggctttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcctggctaattttttgtatttttagtagaggcggggtttcactgtgttagccaggatggtctcgatctcctgaccttgtgatccgcccgcctctgcctcccaaagtgctgggattacaggcgtgagccaccgcgcccggcctttttttttttttttttttttttttgagatggagtctgtcactctgtcacccaggctggtgcagtgatgcaatcttggctcactacaacctccatctttcaggttcaagtgattctgccacctcagcctcccaagtacctgggattacaggtgcccgccaccacacccagctatttttttgtatttttagtagagacgtagtttcaccatgttggccaggctggtctcattcctgaccttgagtgatccacctgccttggcctcccaaagtgctgggattacaggcatgggtcatcacatgtggcctgaagcatgactgttgctttaatcatatgaaatactgctctgtattgttatctatttgaaatgccacacctcctgagctaaattgcaagcttttatggagcacaaaccatatttatatatattagcatgataccatgacacatatcaaaagctgttatatattgttacgtgaattgattctttctcagttaagaggacctctgtagtagcactttcataccgttaatttttcattttgtgcccagcccctactctgtgaaaaatgaaatgaatcctgttatcatttccctcccaggccttttctccttgtggacaatgtgtggctcaagagaaaattcagtcagtaaatttgttcagtgcacaaactctttatcacctctcactgttctcaagtgagatagaacagaacatccatccagtgtcttacaaattgtctggtatatagtaggcactcaataaatgttttttgaataaatgcatacatgaatcctattcctatatatagtatggtagacagatcattgatacccaaagatgcccaaatgctgatccccagaacttgtgaatatgttacatttcatgtcaaaagggactttgctaatgtgattaaggattcagacccttggattgtaagattatcccggattaaccagggccaatctaatcacatgagaccttaaaaaagcagaaaacatttcccagctgggttagagagagatgagacagagtaaaaaggaaagagattcagggcatgaaaatgactctacccactgttgctggctttgaagatagaggaactaggccacaaaacaaggagtatgagtggccttaagaaataggaaaaagccctcatctgacagccagctagaaagcagtcctctgaccacaagaaattggattctgccaaccactcaaatgagcaaggaaatggattctcccctagaacctccagaaaggaacacagctctgtaatgccttgattttagccaggtgagacctgtttcagacttttgacctatggaaatataagataataaagttttattgtatgctgctaaatttgcggtagtttattactgaagcaatggaaagccaatacagacagaatatacagagagaaagagaatgagttctttcctgataatttgtaaatatttgggtcttcactggacaagcttcacagaggattcactggttccctagcaaaccagcatgtccagtcctgcagcctccctttcttaggcccagcatatgtcagctgtgtgcatagaaaaatcaaagcaggaccctgagtagttggaaagaaaagatggttggaaatgggttgcacttcaagtgaggaaacaagaggtaggagaccggcatctctttctcatatgtcccaggctgactcttgtgagttgttttcccttggaggctatcgatgacagtcacagtaacctgatggaacctggatcatgatgaaagaagtaagtgtcaatggctccgacttccaaggactctgatgtcccacagcactagctaaacaaagccagttggaaatgagcttaaatggggaatttcctgaatatattccctattgttaggaagccaggttggcttccttgcctacaattatgccaagcagtcacactatagagtccctagggacatgatattaagtgattcttttaacacaaacaacttaataatcatttatactaatagcaaaacggccaacggctgatattccacttgaagtagaattggctatccaactggaagagaagacaggaagacgtgatctccagggagccactaaaaggattggcacctgcctctggattccccttttccttatattacctctcagcactggcaggcctttatttcaggatacagtttcacaagtattatgtcacgtctctgagaattatgttggtagatatttgctcctctggccagaaagacctagtttggagtctggagtcatgaaggtgacatacatgtagctagtgacataagtgtagctagtaaaaatagtgagtaatggccctgaaattctattgaatgcccaaagtgctgaccaggaacaagcatgctctagcttatctcacaaggaacttgacaattttcttcaaaaatcctagtagctaagatttcttagtaacaaagccactaaggcacaattatgattaacttgacccttaggtgacttttaaggactattctataaaatattacaactaatagtggatccaagccagcacactctgctatataagattaattgacagtgtccacactggtaaaataagttgtttcataaatacattagaattcatttgcactttctacacagccccaagtccagaactttccccagaataggtctatgttttgcaatctgctactccatacagagatttgagttcacttggcaatttagtgctgcttatatgtgaccagttagtctgttttacttatctatgccttaaacattactatacttactaactccaagatgcctggtctcaacttgacaaaaataccccaagttgggaaatccttatgtgaatatgtagatagtcacaattgctggttgatgatgatctgtcttttcctgtatttgagaaaatggagataaaatggaccaatccaaataatggattaaacatgggaataggtgagagagagagaggaatacatggtggctctcagtgtctggcttaggcagtaaacactttcgttaataaagacggaaaataaaaaaggaataattggtgtctaggggaaaataatgagctcaagttttaacactctgagttcccggatgtgagacatccaggcgcatttatccaagaggcagttggaagcaacgttccggagcttaggagagaggcatgaccaaaagctggtgggactgtgaaaaggtatggccattctggaaaactgtttggcagtttcttagaaaattaaacatgtactaacaacccagcaattgtactcttgagcatttgtcccagataaatgaaaaaaaaaaaaagcattttttttacacaaaaacatatacatgaaagttcatagaagtgttattcataaaaaactggaaaaaactgagatgtctttattgagtgaatgcttaggcaaacggtggtctatccatacaatggaattatgcttagcaataaagagaaaagaactattgatacatgcaataacacagatgaatctcaaaggaattaatgctgagtgggaaaaaaagcacatctcaaaatggtatatactgtactattttatttacttaacattttaaaaatagcaaaatcatagagatggagaacagattaatgggtactgtgttttgggatggggagtgagaaaagggtaaggtgtaaatataaaggggtagcacaaaagagccttgtggttgaaggattctatgtcttggttgtagtcgtgattgcaggaatctacatgtgataaaattgtatgggtctacatacgcatacacacaagagcatataaaactggtgacatgtgaagaagctccgcacattgtgccaacatcagtatcctagtttcaatatcagactacagttatacaaaacattgtcattgagggaaactgggtaaagggaacacaggacatttggcatatatttttgcaatttcctgtgaatccgtaattatttaaaaataacagatatactacatatcaaaaatttaatgtcataaagttgatgagtttacctagtggatagctttgttaatatctgctataagactactgaaaatgacagttatgcaagtataagctcagagaactttcctcccccttcgtaaatgaaatgagcaaaagaaatgaaacaggaaaggcaagcagtactgaaaacagggaagggctcttccccatataactatatctgcgacttcaacagctattcatccagaaacacagcctcttgcgctaagaggaaactttggataacaatatgttttcactctccaagagagaaaatggatagattaatttttaagaaaaaaaaaaaaacctcaccaatttcatgctgtggcttgcacctttaatcccagctacctacaaggctgaggtgagaggcttacttgagcccaggagttcaaggctgcaatgagctatgattgattgtgctatcgcactccaacctggagtactaagctaagagctaagaacacagctgagagcggagaagaaacaaacaaatctgaccaataacccccactcccctcattttactggagtgagctgagactgctggcaaacatggcctttgacctagcctgaactgtagcaaaagtcatcagatatttttccaccaatcaacagacagaagtggggagaaaacaatcgtagttcataactacaacaagcagataaacgaaggccatggtgagggatggaagacattgtgatatatcaaaggcaggctcatttaaaactcaacccaaattccaaacaaaatatataattgaatatgtattaatgccaaaggagcttgagtgagctttagcacaaaccccgccctccagcccccacccaaaaaaatcactctgttctctccccattctttgataggcatacttgctgttttctcacagccaaggtacagaggggacttagaggaactagaactctaatacactgctagcaggaatgtaaaatgaagcatctacttcagaaaaccattttatcagtttctagaaagttaaacatagacccaccatgcagcccagccactctactcctaagtatttacacaagagaaatgaaaacgtgtccccacacagttgtatttaaaggtgatggttagccttgtgtgtcaacttggctaggctataatacccagttactgaatcaaatagtaatctaggtgcatctgtgaaggtattttgtagatgtggttaacagctacaatctgttgacttcaagtaaaggagattgctcttgatagtatgggtgggcttcatccaatcaattgaaggccttaagagcaaaaagtaaggtttcccggagagaaagaaattctgcctcaagactgcagcctcaactcctgcctgagtttccagtcagccagccagcctaaagatttgctaggcattataatcacatcagctaatttcttaaaataaacctctttatatatattgatacaatgaatggttatagcagccttatttgtaatagccacaaactggaaacaacctaaatgtccttcaataagtgaatacataaacaaattgtggtatatccacaatttttacgcagcagtaaaaaggaataaatggttgaataaggaataaacacataacaaggatgaaccttaaaaccgtaaggctgaatggaaaaagtcagacaaaactaatacatactgaataattccatttatattgaagttctagaaaatgaggactaacctatagtaacaaaaagcagaaaaattttgcccactggtgatggagggggcgcaggtattgtagagtatctgagaaaggacaactggataaaagggggcacaagaaaacttttgagggtgattgatatgttcattatcttgtggcatggtttcataggtgcatacatatgtcaaaacatcaagttatacacttttaaaatgttcagtttactgtatatctattatacttcagtagagaggaaggaagaaagtgggcagggtgggggagaggaaaggaaacgagggaggaaaggccctaataggaaggattttggagtttagattttaaaatgataaaggatgtttgacactctaggcatatgacgaatataggattatgagtccacaaaaaccaccaggaagtcatgtatgtttatacttttaagtgaaggatcagtggattatcaactccctaatgctttgcctctctatgactggctgctgtccttctcatcccaatactccttccaaagccccttgcttaaatgtaagccttctttcctcctttcaacacatcctgcattccgtgacaaaataagttttccttaaacagaatgtacagcatattatttgtacaattaaaaatttttggccaggtgtgatgactcatgcctgtaatcccagcaatttgggaggccgagatgtgtggattacctgaggtcaggagttcgagaccagcctggccaacatggtgaaaccctgtctctactaaaaatacaaaaattagctgagtgtagtgtggcaggtacctgtaatcccagctactcaggaagctgaggcaggagaatcgcttgaacctgggaggtggaggttgctgtgagcagagatcagactattgcattctaggctaggagacagagtgagactcggtccccaaaaaaaaacacatttttttttaatgtttcctccttgcctgtaggaaaaaggctctgactccttagcctgggcatcagagctctatctaaatggactttaacctgattttgtggcactaattccattgcagtacttgtccgctcactggcctgtgcctctctgccactatttttggaataatgtcctctctccatcttgtttactcaactatatccaacctctaaggctgtgctcctacaaagcctcccctggctacttcagcccacagagatatttaactgctctgcagttcaggacattcttctgactctttaaatcacatttacttatatatgatcttgtgatattttttgttgacgtgtttactttaattttcttccataacctattcattcaacaaactcaacaattatttattaaatgccaagttagaaaaatattattgattttatatagattatagatatgtttgaaattttatttggcaatctgcaagtagaaaaataattataatgtggtatatctgtgatagaagtattagtgcagagaccatggggaacataatccagcctggaagttcaggagagatacgtggaagaaaggacgtcagagcctttttcctacaggcatggaagaaacattaaaaaaaatttttttttttgagatggagtctcactctgtctcccagcctagactgtggtggtgcgatctctgctcactgcaacctctgtctcccgggttcaagtgattctcctgcctcagcttcccaagtagctgggattacaggtacctgccacacatggatgataaatatgatcatattttcttgttcttttcctcctcagttgtcttccctgaagaaaggaatgccttttatagatgacaaactcccattctcaagaacaaggatttttgaccaatttaatttaatcagatgtctggctttgacctagaaacacagtcacgaaacttggtgattagagaccaattcccaaacatgagcatttcttaggaaacacagtaaagatctgagagacccaagagcagaagggcgagaaaccaaaagccatcagtttgcataggaaacaccttgtttagcctaatctttttatttttattactctattagtcactacaactattttctgattgctatggtgatagatggtttaaaacaagccttcattaagaattgtcacaccatggtctcagtcaaaaacaccaacatttttattggtattgacaattatgggaatatccaattccaagaagacaaggagacctctgaactttctaaatgaagactccaatcttcctgatctgatgggaagcagcttggcaagattaccaaccaccaccacagagagtggactctaagctaagacttaaaagataagtagaaattatccaggtaaagatgtgtacagagaaggaagtacatccaggggaaaagaacaatacgtgcaaaagtacggaaatggtaaaaagtaatactacatagtcaaagccaagcagagttcagaagggatctggtggtgaaaaatacggctagagaaagcagcaaggattggcttctaaaacctatgtagtatcttggaccttaccctaaatgtaatgagaagcttctaaagaatctttcatttattcattcattgaacaaatattttgaggctttctgtgaagaacatcattctaagtagtaaagatacagcagtgaataggacacataaaatcctagatctcacagaattgacattccagagagggaaaggtagacaataaatacataaacaaatcatttaacaagatgatttcagacaatggtacgtactgtgaaaaaaatgaaacaaggtaatggacagcgaaaaggcactggaaggaagcctgcttacctttgcatggttagaaaagatctctctaagaaagagaccacatgtgagctgcgacctgaaggataccgagaagctaggtgtgcaaagatgtggggacagaacttttggactgaatagcaaatacaaatgcccttgggtgcaagctttgcctgttcaaggaccaaaaagaaggccagtgtgcctgcagcatactaagcacagaggaaaacactgttatatgctgagattggaattataagtagagccagataatatagtctcttataggtcataataaggcaaccagattttattccaagaggatttaaaaatcactggaggttttgcactagggtgagaggtgtgatttgtatttttaaaagataattctggagaattaactataatgaggtaggagtaaactaagttaggggctatttcagtggctcagacaagagataatggtagcttagactaggatagtagtcgtagaaataaataaaagtggcactctactttgggggtagagtctataataggtttggtttatggatcatatatgagagtaaaaaaaagaaaataaattaataatggttcctaggtttgtacctgagcaactgaataaatgggtgctgtgaattgagataaaggagattgagaatcacaggctttgttttgcaaattaattttgagaggcttattagacatcccagtggagatttcaggtgagtggagcccattgaaaggtaagggacagggtcaggtgtggtaggtcaggcctgtgatcccaggactttggaaggccaaggcagacagatcagttgagctcaggagtttgagaccagcctgggcaacatgggaaaaccctgtctctacaaaatatgcaaaatattacctgggcatggtggcatatgactgtggtccaagccacttggggggctgagatgggaggatcacttgagtacaggaggcggaggttgcagtgagccaagatctcgccactgcaaaccagcttaggtgacagagtgagaacctgtctcaataaataaataagaaacgtaagggaaaaggaaattaatctgatcattggcaaatgcatagtatttaaagccaggggagtagatgagatactcaaagtaggtgaagataaggaggcaatgaaggcctaggactctggtgtacatttagatggttataagaggaatagaaactggcaaaataagtaacactgagcacccaatgaggtggagaggaaagccaggagatgaagcatcatagaaggcaagagaagaagggtgtcaaagaggcgaggcagtcatcaacttctgggcagtcaaataatataaggacagaaaagtgaccattggatttggaaatatgatgagcactttgagtggagtgttgagacagaagaccaattagagtagattgaggagataacgagaaatgagaaaatgtaacctgcaagcacagacaattcttgagagacttttctgtgaaaggaaacagacacagagtcttagcatgtcttgtctttctatgggaaatgtaaatagtttgagatcagggatagtattttattctgctttttgtacctctacattacctagcatagagctagctaatgtgcacttaagtatgttctcaattcttatcgcctgaatgactggatgggtgaaagaatggatggatggatggatggatggatggaaggatggatggatggatggaagacttctgatttgccaagaagaggatactggtagcagaaataaaaacagcactggagaaagaagagtttagatttttattctttggtgtcagttagacaggaaagtaagacattagaagagtccttagataatttatgtaattgttcacttaggatttttaaatgtgatcactgatattggacatgttcctagtgaagcatttttggtgtttcactggttgaagttaataactgtaaaattatttcccgttcaggacagaaaaacagaaaacttgaagctcctattagaaagttcaagattctctggggttcttaggatttactgttcccaaaactctgtcaagaacaagaaaatgacctgtatacttaactggtctaggcaacagtggaaagacaattctcagagaagatttgttttaagaagacactttccataggaatcaaacaatagctttcagtgactaacatggtaagacacagggtgttagctctttccttccaacctcatggctgttgtaccttacctttcgaccccgtgttcctgaaattgttaaattcataaacttaccaaggactaaccagcctctggggaattgctgtatacttagcaaacttacaatggacatatttataagccataatgataactgactaataggaaataccctcaactgaaaatgagagatcatcatttgcaaatgagttcccttgcccaggcaactactggggaaaatgtcatgcaagcaaaattaatctttgaaatcctccttttccattttttgtgtcttccttttccataggcaccagaaatatcatggtgcctggatctcatctctacagaaaaaaaaagtgatttgataaactgatttatattgtgtccaaatgtgattgtattttcaaagataacctaaggggagaatgctgtctggcccaacagcaggctctcgacttcatttcagacactgtggccaatggctgggaaacaggtatgaacagtaggtttctgagtcccctggaattattccatttatgtagccacctccatgacaggaagcctccctactcttacttcccagtttgttcattcatggcaccaggttgcagattaaaatttgctcagtgaccttttatctaataatgtgttaccttcttctcttaaaaagtacaagggacaaatgctcatggtatacttttaggagattgtggctctctattaacagtatttattcaacaaacatttattgagcatttatatgtgcatcatgctagggactggaacctagtaagtgtagcacatattatttcatttaatcctcacaacaaacccatgaggttggttttatgatcccaatttttcagaagaagaaactgatattcagaaccagttaactaactggttcaaggtcatgcaatttctaagatacagaaccaagagtcaaagacatgattttaaaccaaagctttttctgctactccacattgcttccctaggtgagatctgaggcattccgcgaaaagagaagggtcataaagccaagggaagacaagcttaggaaaaaaaagggaaatgtcctaaataaacagctttcctatttaccagaaaccactagtttaaaaatataatgggaaaaatcctattcactttaacaatgttaaaaaaaaaaaagatagaagaaacatagggataaacttaacacatttgtaggatatgtaaagaaactaaaagatgttaataatggcctaaagaaaaaaaaacttacatgtatggggagatagaccatcttactggattctaatatttaatagtctaggtgttccatttctcaccaaattaatgtatacatttaatacaatgtcaaacgaaatatcttaggaattgcttacaaattgtcagataattacaaagtttacctgggaaatataagcatatatgaagagtgaatgggaccccaccactccccccaaaacaaaaaaggtctgaaaaggacagaaatcaaggagagtcttgcctgccagatacaaaattctattataaaggtgtattgatgaaaacaatttaatactagtgtagcaataggcagcaaagcaatgaaacagcataaaaagaccagaactatacctaattatgatgaagatttaaggtatgataaacatgacataattcaaatcagcagaaattggcatagatagggttaagacaaatagctaatcattagaggggaggaaggaaaggagggaggataaaattaggttcctgccttcatcttacattaaaataaattccagatgtattacatttaaatttttttaaaaaaagaaaccacaaaatacttgaagaaaatataagttgttatatagtcttttgatgggaatttttttttttttcagagacagggtcttgctctgtcacctagcctagagtgcaatggcatgatcatggctcactgcagccttgaactcctgggctcaagtgatcctcccagctcagccccccaggtagcaggaactacaggcatgcgacaccccatccaacttattttttattttttgtagagacaggggtcttgctttgtttcccaggcttatctcgaacttctgccttcaagcacctcagcctcccaaagagctgggctgatgggacattttttaacatagtgccacattaccataaatgaaaagcttgtaaaatactaatttttaaaactaatatatatcagaaatttttataaacaaagttaaaaagcaaacacaaaaaatttgtagcacttatgacaaatatatgtatatatatgaatacaaaaagagcctttacaaaacagtaagaaaacaatgaatactcccaatggagtattcaaaactaaactgctaaaagcaattcaaaacaaaaaacataaactatgcatatatgtatgtgaaaaagtttaaccttatcaaagaagtaaactctcaaagaaataaacatcaaataaggaaatagccttttcccacaaataaccaaaatctgtaagaatactgagctgcgaatgtttcagaaaaaaaaaaaaatcatacacctagttcggcatgtaattaatatagatcagaacactttaaaaatatttataggccaggcacggtggctcatgcctataatcccagcactttgggaggccaaggcgggtggatcacctgaagtcaggagtttgagaccatcctgaccaacatggtgaaaccctgtctctactaaaaatacaaaaactagccaggcatgttggcgtatgctggtaatcctggctactcgggaggctgaggcaggagaattgcttgaacccaggaggtggaggttgcagtgagctgacattgtgccactgtactccagcctgggcaacaagagcaaaactctgtctcaaaaaataataataaataaaaataaaatatttatatactctgacccatcaatttgtccagcataattaggcatgtgtacaagggtttacacacaagaatgcctattgcaatattgcttttaatgctaaaaaaaattggggaaaatgctttaaaaatatagattaagactgtacattgtggtacagtcatataatcaatagtatacagctattatttattttcagccactgtccaaaatatagcctggcctaacaacattctgttaggatacgcaagcaccgtgaggagatcagctataaagtatcagtgtttcacaccactgctcctttgctaataaccttcaatggcttttaaagaagtaaaaaacaaaggcaaaattccttagtcagcccttaagactctctgttacttagctcaaactacccttttcaacaacactgccctaaccaggatgagttttttgcccccctggagtacattcagcctttccttatcaaaccttcctttaaataagtatcttctccaggaccacttcactttcttccccaatttagcattttctatatctccaggcctacctctataaagcctgtcctaaccactcaaaccctagctttttctctgaactgctagaaatatttttctctcattggccatttaggtaaaaaggtttttactgtttattacctactcaataaaaattttctttttttgagacaaggtcttactctgtcgcctagaatggggggaagtggtgtgatcacaactcactgcagcttctacctcccagctcaacagtcctcccacctcagcctagtgagtagctgtgactacaggcatgtgccaccataccccactacttttcattttttattttttgtgagatggaatctcactatgttacccaggctggtctgctgatctcaattgatcctcccactgtggcctcccaaaatgctgggattacaggcatgagccacaatatctggccccagtaagcttttaaggccattaacatgaggaacagtgttctttacactattttatcagctagggctttgcatggagtaggagtttagtaaatgcggttgatgggttaatcaatgtgtgaaaatattcagagccaccaaaaacagatattatgtctattctcatcaacaatcaaaattgagtaaacagccattttctaatacaggaaaccacaaaacattgaatggtgacattaaaaaattcccccagcaggagccaaccaattttttcatcctgatccaagttagcaaactgcaaaagataggaagcactaatgagtggaaatttgagtagaagcatttcttatgaaggctgtcttgactggatcacatttttattgctgttggaggtgccaaatgtgtgtgtttatgctaatcctccacctcaggcaacacacagtcaaggatcctaccaagtgttaccgtcaagtgtctgttggcagctcaaggccccagcgttgttcccttgcactagggaaaagacatattccaggtacaagtactcccactttgatgctacagaggagttgctgaactttgtgtcattaatctctcttcgttagatcccaaccctgtttaaatcccactatctgcctactctgggtcttcaccaatttactagatcatagttggagaaaatctacaaagccttgctccctttagatttaaacaggtctccgtttaaatttagaattgctaacttcaagcgggcccttatgcgacagtatgcctgtcagtcatactacatttcctcaattccattcatgtgactgctccatacccttccctctctcttcatactactattatctcttcccccctccctcatttttaactgatgatcttgtttcctatttctctgagaaaatagaagccatcaaaagagagtttccacaaactcctactgccttatctagccctgtaccatatactttgcatttcctctcattaccatggatgtactgcctatctgtgcttctatctaaggctaacccttccacttcagttttgaatattatcagctcttaccaactcaaggccattgctctagcaattctctcattctctctcattttcttccatcaagttttccttttcttcaattaacagagtagctcctaaagggaaaaaaaagtcttctttttcaatgctcatcatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagacagtgtggcgattcctcagggatctagaattagaaataccatttgacccagccatcccattactgggtatatacccaaaggattataaacaatgctgctataaagacacatgcacacgtatgtttattgtggcactactcacaatagcaaagacttggaaccaacccaaacgtccaacaatgatagactggattaagaaaatgtggcacatatacaccatggaatactatgcagccataaaaaatgatgagttcatgtcctttgtagggacatggaggaagctggaaaccatcactctcagcaaactatcacaaggacaaaaaaccaaacactgcatgttctcactcataggtgggaattgaacaatgagaacacttggacacaggaaggggaacatcacccactggggcctgttgtgggatgaggggagtggggagggatagcattaggagatatacctaatgttaaatgatgagttaatgggtgcagcacaccaacatagcacatgtatacatatgtaacaaacctgcacgttgtgcacatgtaccctaaaacttaaagtataataaaaaaatatatatatatatataaaacaactaaaaataaatcttctttttctgcaggatcagtccatcaccacacacacaggctgtgttttatgttgttccccagcttaagagatcgttctccagatcccactgctccttccagttgtcacctcagttctccacttctttttgctgataaactactctaactagttacatatgatttctgtccccaggtcccctccctcagttgttttgaacataatcatttatatcatttatcattttcactctaattgcacaaccaaaaactccctttttttttagatggagtctcactctgtcacctaggctggagtgcagtggcatgatctcggctcactccaacctccgcctcacgggttcaagtgatccccctgccttagcctcctgaatagctgggattatacacatgcaccaccacacctggctaattgctttgtttttgtttgtgtgtgtgtgtgtttttttttttttttggacagagtctcactctgttgcccaggctagactgcagtggcatgatctcagctcactgcaacctccacctcctgggttcaagcgattctcctgcctcagcctcccgagtagctgggactacaggcatgcaccaccatgccaggctaatttttttgtattttcagtagagaccaggtttcaccatgttggtcaggctggtcttgaactcctgacctcaaatgatctgcgcacctggacctcccaaagtgctgggattacagacttgagctactgcgccgggctattttgtgtttttagtaaagacggggtttcaccatgttgtccaggctggtctcaaactcctgacctcaagtgatccgctcgcctcaggccctcaaagtgctgggattacaggagtgagccaccatgcctggccataaaactgccctttgttaatatgactgttggcctgcacattgtcaaatccagtggcattcatcttactcggccaacctacggcatttgacactgtctgtctttccttctgttcctctatctgtttccagtatactggcctggctttctttttacctcttttatatgctcttccagtctcaggctcctttggggatttgaaggtatgttgcattttgctattcaatgaataatgacaagtaatgatcacttaagacattaagtggtcagttcctttactaggataaaaataattttcttcccaacatggggcatattccatttccagtctgactgttctgtgtaatctttgtattccttggcagccccttttatatcagttcatctactgtgcaggaaattggacaaacatttgcactggtataaccaaatacagttgaacttttggcttgactcttagctgaactcaccaaaaataatttctgtaagagactgagacgtctacgagtaggtttttcagaattagtaaacataaatcaaggatacacaggtagatttgaatttcagataaacaacaaatacttttttagtatgtctactgaaatatttgtatcttatctggcaattctacctggtacagaactaatccattctcttgaaagatcttgactctgtaataagttctttggtgatggaagggaggtatttctgtaattagagtcactgtcttcctcccagttttttatcctggcccagatctgcaatgaacacacgacagaatccaggggggatgaagatgggtgctttgcaggaaaaaaaaattaaaaacatctgaaaaagcttttgtactaaaagaatgtgatctaaaaaagaaagcaggagaactttctgtctgcactttacatcagaacaaccttggcgtctagaagctgtgccctgtgggaagtggtggtgcttggtaagagatgccaggaccagtggtacccactgggagcactgccaatacccagcaaggagcatgggtgcacagtaaggcattgcactgtgattcagcataaaataacaataagggaacgtcacggagaaaaggccagacttcctttgtttagaatgtgggaaatgtcttctgaaaaatggtagtaaaaaagcatgcttggatggtccactccaggcaaaactgactaatcgggggtcagggatacaacccctgcatcatatgtttgtttctgttgggctgacatgaggttcactgtgaccactgtggtttaaccccatagtctcctggaaatacagccaggtcaagagagctccacataaaacataatcaaaaaaataaactcaagtttccactgatcagcttttcacaactcttatcctttcactaactttggagcaagatttgagaattggatggctatttgagggctatttctgcgctttagttcaatgttttgttctttctttattagagaactatggttttttattatatttacactttaagttctagggtacatgtgcacaacgtgcagatttgttacacaggtataaatgtgccatgttggtttgctgcacccatcaactcgtcatttacattaggtatttctcctaatgctatccctcccccagtcccccaccccccgacaggccctggtgtgtgatgttccccttcctgtgtccaagtgttctgtttatgtgatagattacgtttattgatttgtgtatgttgaaccagccttgcatcacagtcacttgcttacaagaaacaaacacttcacagatggatcattatgtgtgataagtgaaatccaaggatttatgctcagaggtgggcttaacaggtaggaagagcagtattttccttcaaccatgagtgtatgcaggtttttcttttcttttttgagatggagtctcactcttttacccaggctggcgcgcagtggtgcgatcttggctcactgtaacctctgccacctgggttcaagcaattctcctgcctcagcctcccaagtggctgggattacaggcacctgccactgtctccggctaatttttgtctttttagtagagatggggtttcaccatcttggccagccttgtcttgaactcctgacctcatgaatcatccttctcagcctcccaaagtgctgggattacaggcatgagccactgcgcccagcccacaggtttttcaaagactaaacttaaaaaaaaaaaaaaaatttcccaatgaaatataaaactaaagtgctaaactgtgatagactgttttacaagaatgccagttttcacaagtgtctatagaacatgtaatttagataggtaagatgaaattttgataatatttgatggcaaatttaaacaggtatacaacaaaaataaaattctaagcccctcaaccaactgaatggactccttctctcagccaaaggaataccaaagtaaacctgaaaaactagttttggccaggattgggggtaggtgggggaagcccaacatgactcattattctctcctccctttggaattcaggcacaactgaatgtcagcattgacactaaaacacagatcttaagactgacaagccagactctttgtagcagagagccaggccctggaagaaatcaagttattttatcccaaaaaatatttctttgatatattttcaaatggccctgcaaagctgtctcttgtggggaaaattgacatgctgtacagaatttccttctctttccaagtttttactgatccaggagagatttaactaagaggctagcatgtttttttttttttttttttgaggcggagtcttgctctgttgcccaggctggagtgcagtggcgtgatctcagctcactgcaaccttcgcctcccgggttcaagcgattctcctgcctcagcttcccgagtagctgggattacagatccatgccactatgcccagctaatttttgtattttttgtagagacagggtttcaccatgttggccaggctagtattgaactcctgacctcgtgatccgcccacctcggcctcccaaagtgctggcattacaggcgtgagccaccgtgcccagcacaagacatttaccgtctattctctctgaagctactatctagaggcttcatcaacataataagacccttggtctccacaactccttatcttatcctattagtttctactgattccaggtctttagataataacaactctttcaaccaattgccaatcagaaagtctttgaatccacctatgacttaaaagccccactccttcaagttatcccgcctttctggactgaaccaatgtacaccttatatgtgttgatggatatctgcctgtaacttccattcccctaaaatgtataacatcaagctgtaacccaaccaccttgggcacatgttttcaggaactcatgagactgtgttgcagaccttggtcactcatatttggctcacagtaaacttctttaaatattgtatagagtttggcttttttcattgacacaggaaaaataaagaattggaaggtctttcatcagtcactgagccagcttcatatctgactgaggtcatacagttcagtgatttgtagctttgctacttagattgctatccattatctagaagcatcaggatcacgtgggacctattggaaatgcagactttcctcctagaacccaggaccttggaatattcttggcacatagtaggtgctcaatacatattgaactcctaggtgcaattcattaattcatgaattaatgaattaacacgctctcaaagtttagtgctttttcacagactagtctttctgcctcttaagcactcagctcaccacgcttccagtctcactcccctattagtctgattaaaatctgcttacatgtgagtctgagatcaagtgttatctcttctgagaagtcttccctcactggcccaaaggaatttctcctctattttagcactgtcccagttgacttgtcattattctagtctttttcatattagttgtttttcatatatatgttattaaggaaactagtcatttcccctaatagaacaaaattgctggcctttggggttggcaatggaggggaggctcttcttgaaaagggggaagagtgttctcctaatatttttcttacgagatttatgttgctcatctttagcctttagtcccccattgcctgcctacagttggcagagaccatctgttctctcactgtcaggaactgtctcaattcttgaagttcagagtcaaaaaagaagcaagttttcctagctctttgatcaactttcaaagttttacttccatttgaaaatttactaagtcaccaggagatggtttatactgagaaatatccactcatactcttcctcttcaactttcttccatatacaccctattacagggatatagtcttactctatagctcaaaaggatgaccctatcagaaacctgcacagtatgtaaaacattctcaccagaggttcacttgtgtatttccaccctagaatggaagctctacaaaagcacagaatgtatcattttaactttagattctattttcacacccagtgcttgacacatgatttgaagttaatatttatttatcaagtgattgttttaaaatcatgactcactcaacaaagttataagaataagaatagtgttacagaattggtatacacaagctgaccataatcaacacacctattatcatttttttgcgacaggttctcgctgtctcaccctggctggagtggagtggcatgaccacggttcactgcaggtttgaacttccaggctcaagcaatcctcccacctcagcctcccacatagctgagcccacaggtgtgtgccaccatgtccagctaactttttaattctttgtagagacagggtcaccctatgttgcccaagctggtcttgaactccttggctagagagatcctccctccaaggtcccccaaaatgctgggatctcaggcaagagccaccatgcctggccataatcaatacacttttaagaatgctagaatgttatatcagatgcatacttcagcactatctcaagcaaactggggtgtgggttattctacatataaagttcagcagtgttgttccacagtcccaaactccaactgaggtcaaatgtagggtgcagcaaggtcactggggctgtcatcaagggcctctccttgcactcttgccaaccctgtttcttgattgtctctaccaccatgagtcaccagcaatctcccacagtcacttgtttaaaagttcacaagtattgtgtgaattgcaggcaaccccttgactccctgattgcctggtcttcttccttgggctctaccattttttttccccagcactctttctgctgctctaaattttaattcatgcaattccatatgtgtttctctatcattcttcatctctttcctctcccttccatccaattttgtttgtctgtttgcttgcttgcttgctttaatacatttctctttttctgagaaggcttgagtccaaaactctcagttacctgttgttctgtttcccgttagttaatctccgaaccttcataaattaaatctgacaaagtcccctgactaacaaaggaaatgcacaagtcacagtaaaaggggcacacacagaacacaaatagacccagggtcttttctgttcatcactcagctttttataggagatccaggagaaatgaagtggaaagggaagtgtgttgagttactatacaacacaagagtaaactttcttataagtggtaatttttttttacaggaataattgaaaatggaaattaccttctctactcatagtaagtactcagtgcgttcttgatgggatgagaatgtgtttgagctttagtgtaaggcagaattctgtttagtctgccagtattggagaaaaataaaacacaaagggactgacatgtaggaagtggcacctgggagggtctcaattcttcctattacaaaaatgccccagagaaataaaaagcttgtgtacatgttgagatgggagagttctctggcccccctcgcaggatgtgtgacagtggggtggctctctgctgcgccaccatgagctcaaacccctcataggagggggagcacacaggcaggaaggtgcaggagctgggcgagctctttgggctctggccccgtggtactgtctagaggtgggtgcctgcaactcctgaaagcccaagtgggcatgtgttacagtgcactctttcagctttgctgtctgcagcttaagcgttaaccagctcagtttcttcttggtacccaggtccttgtctggcatccaggaagaatcaggttacacatggacttgaaggatgaatgtgggagttttatggagtggtggaggtggctctcagtgggatggatggggagctggaagggggatggagtgggaagatgatattctcctggagtttggctgtccagcagccgatctcctctccagtcgtccccagcctctcgacgttcagatgctcctcttctctccttctctgccatgctgttctgccgttcatctgcctgtctctctctggagcctggaatttggggtttatatggtacacaataaggggcatggcaggccaaaagggaactttttaggtgcaaaaaacaggaatgcctcttctcacttagggctatagattttcaggcttgaaggtggggcctttaccagcgaacctgtatttccctgtctcctgtgcatatcaatgtaatcaaatactgggctgatccaggatgtttctttagaccaattatgggtaaaataatttacattcaggtttttatatttgcttttgtcatttctttttaagcaatcatgtaaaatatctatacgacagtaatagatgatagcgaacctaattaaaattaccagaaacttaagaatctctaatgatttcaactgtaactaaggttatttctctttatgttgaacaatgttgggagataagacacaagagtttctgaagtatttcagaaacacaaagagggaggttatataaataatatttttttcctactttgggaaaatgaaagctagtcacaaagttaaacgagtggttattttaatatttaaaatacaggcttggatgtatttcctgttaaagaaaataaaatgcagaatattcaaaacgtctgaccacccttctaagaaaatgcatctctgaggtatttttccttagaagttattgtaaaaatcctggagaagcttgaacacagcaaagcaaacaggatgcagagtttaatctgtggaaagcttagggaagaaaagcaaatcattaaaaataggtcttcctctgaagatttttaaaacgcaaagagggtggaatagcaatgataataaaaaagctggcatagagagtggcacaatttgctgtgccactgagctgactggatgtgttctgaatttctaggcattagtgtacctttccacacgcattctccctttaaaaaaaatgcccacacactgaatacttttttcatgcaatttaaaataagcgcaccatctagtttacagaaattcactagaagttatttatcctaaaatagcagagatctagaagaattttgagctctaggacattttagacacacagaaagaagaatctggacaagtcttgaccagacatgacagaatagaaatttcttttcctatttatctctttgaataaaattttcaggatcttacagtggacaagtttgttatctacacattgtgaagcacattgatttctcctctgtagccttaggaagatctgagaggtgactgagctgattgaatgatccgtgaccgctctactgggaccagtagtagaactttactggtggagacctgctggaggtttgagagcagactttgaaaattactagagctacacagatactgtgtggctaactggattatgtttagaggctttcagaactatgctgctgctgctgcagtgtagccaggacgcacagagaacatctaaggctcttgaatggggcgatagggacagatttcagcagccatctgacttcagtgctcattttgatgctttccctgcagggtgcagtgtgcagtgtgcagtgtgcagtggtgggaggctcacacaggaatacttgcttctgtagccctaatttccggttcaaactctgcattcaccttgacagattctttccttggccaaaatttagttaggcttctgggctttctcttatgcccacctgcagactttttggtaaaatccagttttagtaaagagctctgctaagtcagtttagcaagaatccccacctcaaaagtcactatctccctccctggtagtgtctggcttgtcttcagcgagaattctattaggttctgttagattagaatcctccttacccttgatgcttcctcttagtattttttcatccactgactccttgacccaccttgctcctcggctataaattcccacttgcccatactctgcagttaagactattttctccccactactgcaaaatcccattgccatggtccctatactatctcaatggtaatgaataaagtctgccttaccatgctttaacaagtaacattgaaccatttttttctttaacaatctgctgcacaatgagattactaaaactttattccattttgccatgctggatgtcctcaatggaatggctcttgtgagcaccaaatcattgtgagaaggaaaacccatctcttacagccccctgtaacgtgatgtatgttacatgtgatgtatgttacatagttttttttcatgttgatcactttttgcccattttcctatatcttatcagttggaagactgtggaagtttgtagtactaagccacaagatgactaagaagagttgaaagggcaagtggggctaaaaacagattttgtttgacttaccccaccattccccctatcatggggctgaatctgcctggaggaaggagcatctttatctttgtactgtgaaccacacagtctagcagcagcacagccaaggcacttggggtttcatgagactaagtacatgcaattctattgtaaaggcttaaaatatatacaactgacccttgaacaacatgaatttgaattgcatggtcagttatacgcagattttcttccacctctgccacccctgagacagtaagatcaatcaatcctcttcctcctactcctcagtctactcaaagatacttgaagtctacttgaagatgacaagcacaaagacatttatgatgatccacttccacttagtgaatagtaaatatgttttctcttcctcctaattttttaacactttcttctctctagcttaatttattgttaagaatacaatctataatacatatgacatacaaaatatgtcttagttgactgtttatgttatctgtaaggcttcaggtcaagagtatgctattagtggttaagttttcgaggagtcaaaaggtgtatgtggactttcaactgcaggggggtgggcacccctgcccccatgttgttcaagggtcaactttactgccaaaggcaagcctttacatccactttttccatcccatcagtaaatggaaaaagatagctacagtatccctgcgtcaaatctttttttttgcagatcacaaattggccactcaccttgctctgtgaggggtaaaatgccccactttctttagtaatatttaagttagataatatttaagttataaagttgttctttgtaatcgttaattgtaatttttacatagtttctttcaaacagaaatagcatttttgttagataacctcccgtatagatgatgaaactccttttaagggctatctgaattttaattccttgaaaaggcagaaattggatagctagtagtcataaatgtactgtggcttcccccaaccatctgggctatatagaagctgcatccttggactgcagtagaggagtcttacaaagcacagagcaacttctctcctgggttgcgctagttatgatggcaattttaaatgtgtacttttacccaaagaaaatccttattatcaacaatcacaatgccatcataaccatggtataaaaaattcaaaatgtcccagctgaagtggaggcaaagactcaagttcatggagtcagagtttccttgctattcctctttttcaaatgaccatttagtaagcacctgaagaaaatactatggacggcattgaaaagtgaagataggtttaatcttctcgaaaatctaattctccagatgaaacgctgacacttatccaccccacagaccctatagcagatgtgtcactggccatcacatttgacacagagaagtcataactcagtcagcacagagacatttccatgagtttctgaaccatggacagaacgtcgtctgtgggacatgaaaactggaacttagaggacaggcacatctgagaaatgggcagtttaaaggcagaacatagcacatatgtgactgggttttagaagcaaatttacaagacgcactcttcttcatcctaaataatctgcaaccaaagcttccaaaaaagacaatttaggaatgcagaggtgaggagtagggaggggaatgggatgagagagagtggagattaatggtgggcagagcgaggtttagaacttagtggtttcttcaggttctgaactgaaatttgtatactgtaaaggcacaaacaccatttttaacaaaagtgagcaggacttcctatctggttcagaaaataggtgaataaatagtacgaattattaaaaataataatttccacttatacataggaaacttgataggaaccatgataaatgcttaactcttaatcttcaaggaactctgctagggatataatattataaatcttgttttgcagatggagaaattgaattttaacccaagttatcataacccttaaatgattaaatgatactgttacatgagaaagctgcgtatctgtttcctggatttgtagccataatttgtgtctcaagtcccttttgctgccagctatcttgggtaggtgtgttccctttgggctgtttgatacccccacatttatcttttttttttctctttttttgttgagagagtctttccctgttgcctaggctggagggcaatggcgcgatctcggctcactgcaacctccgcctcctgggttcaagtgcttctcacgattctcttgtcccagcctctctaatagctcggattactggcatgcaccaccacgcccacctaattttgtatttttagtagacaaggggtttctccatgttggtcagggtggtctcaaactcctgacctcaggtgatctgcctgccttggcctcccaaagtgctgggattacaggtgtgagccaccatgcctggccccaaatttatctttaatgccccaaattatctagttcccatgactgggcttctgctttgatcctttctgcacttgctggaccctctccctgggaaatgagattgtgtcctgagcccctagttagaggctatgtctctgctgttcctgaatgggcctcctggatgagacctcattaaaagtctaattctcttggagaattgagagatacctatttgtctcaaaatcattgaaaccaattaatgtattatgagcctctatccagtgatttgtacctcaattccccaatccagctgtcaaggccaatttgttctaccttacctagtaggtaagtctggaattgtagctgtggcattttcagtaatggtactctaggttagcagtccccaacctttttggcaccagggaccagttttgtggaagacaatttttccatgaagggctgggcaggggagtggtttcaggatgaaactgttccacctcagatcatcaggcattagattctcacaaggagtgcgcaagctagatccctcacacatgcagttcacaatagggtgtgcactcccatgagaatctaacaccgctgctgatctgacaggagacagagctcaggcagtaatactcatttgcctaccgctcacctcctgccgtgcagctcagttcctaacaggccacggaccagtactggtccacggcgcaggcatcagggacccctgttgctaggtataagcatctggctgctgcatgtcttctgtgtagctacatctgtatgtgtatctgatgagatataaattatttgattataaattactttcttcatattagagttgtgaatgagtatcacatataattatacataaactaggaatatgctttttaataatgtatataagtaagtttccttaactatgactttcatcttagcgtagtaagagggtgctaagaaatatttgtgatgaaaataggcattggtagagttgagaccactgggtgatgaaagagtgtaaagattttaaagccttcagatgctggttcaaggtgagaaatgtgattgggagcaaatcaattaacttcttgaagtcttatagggcagttatgaatacttaatgttaacatatgtaaagctcttctgccctgtatacagtaaatgctagttagctattatgatcactactaaaatggggatgacataaacctcataaggttttaagtattatgcaagatactatacaaagtccagtaaatatcacattcaattgaatccatgatgtccgattattttagctacttccaagagagaaaaaaatgctgtcagttttactgttcttatagagagcaaggcagatcccaattcccaatgtggtaacgtgaaaatttttgcatttgaatcaacaaaacactttctcctttctttcctactatttaacaactggtaagtctatactcccccaaatctggaattctcctttcttattctttttcctcctaccaagaccgcaggatcttttacttggctataaggggtaaacctcaagtagtacaagttctctgtattacttttatactctgtcacagattccctttgtttcctcatctccatgtgaatttagttaaattctcagcattctgatccttactatacaaggtaaatgaatataaaaacaaaacgaaacaaaaacctcttcctatttacataaggccccaacctaatatttagtgatatatattaatgtgaacaaggaactaacgaagactgggaagaaattcacagacttgagagaagaaatggcaggatttcctgggaacaatttcatgtaacgtcaaaggtggtaaaaggtcaaatagaatgaagatggagaataccggattttcttacaaaatgatttcccaggagatctcatcaaatgcacgaggataccttctcagtttcacctagtgagtaaaagactggtaacatagctcacttacaatttggataaacaaaactaaacaaacaacatcaaaatttcagaaaaaataatagcaaaacagaaatcaaacactcaaatttttggtccttctgtttatttcattttggatactcagtgaatgttaattaaccaggaaacttaaaagttatttcaattatgaacctcttcaatccttcatcaattattttgagtattctggtcttaaaaacatctctttcttctacaaacttctgaaagagatgaacacctccacctacaccaaaataatgtgctttgctggccaaaagtacacgtccatttttacttaacagtctaaggaaagtctggtgcaaattactataataatctgggttgtaaatggtttctgaggtgagaatgagatcatattttacaaaaagtttttcactacttagtacaagcttacaaaactcagaccactcaccagaaaaaaatcggcatttatatagttgtgttacttttggtttcctgcatcttttcacatctggctcatttacatcattttcttcatcttccaaagtggagttagctactacattaggtaaggttacttcatcaatcaccatactgttataatcttgaaagtgaatttctttggaccctcccttgaatgcagttatacctagtaaacctgatccacaaccaagatccaagacttttttcccagcaaatttcactttggcctttgtgaaataagccaggaggtcaaaggtacattcccagatttttaagcctccctcataaacacctgtaatcagatcagagtgagaagaaaagctttttgaaactatgttttctccagggaagttctctttcaacaagatggttttcactactgataacttaacatgctggaaacctggtaatgtttctatgactttattttctaacatcttctttaaatctttaggcatagcatgctctttggcagctctcaaggagggctgttttccatgtggctccaagttccttgaactgctggctgcactgagtggactgtctgtgtcttgagagggagctgcattttccattgacttatgttcccacaagtgatcctgaggcaagtcaaattgttctgcagaacattttctgtccctctcttctcctttttgactttctgagactgacagctcttttgaggaatccagggtcaaagctccatctctaatgggtgttaattcattttccagatggtcttctatagtgaaattaaactgaaaggtcatcctcttattaaatgcacacaatctttaaattcagattcttcaacttctggatagaatttgatgatacacacaaatctgcctcaattattcaattagttttgttgggcccaatttctctttagcagcttatacatggtaacaaatatttagagatatttccaaatgactttttagacgtctttggtcctctttccaagcagctctggaaagaaaaaaaaaaaaaaaagaaagaaaatgatgattaaagcaaaatggcacatttcactaaagtgtaatattaaacagccacccccacccctccctgtcccaccatacagctgctttttcttaaaaagttgtggggaagagagagagataagagatttggacactcatacacaccttaagggttccaaagtgggagaagaaaatcaactataaaaacaaacagaagaacaacagcaaccaccaccactaccacctggacaaacataaagtccaagatattcagacaggacagcctagctacttgctgtctttcagctgtcttgatttgtgtccaaccatattcaccccctaagcttccagaataacttcacttctgtcttttacagaagaggtgcagtattttattttggtaagtcagcgtccctttaaaaacatgcataggtatggcctggtgtgtgtaaattcatccaagacttcactccaaacatttagtcgagaacagcagccctaagtgtatagaagtgggggtaatttggcaataattagtaaagactaattcggtggcagagcaaacgcaaactagggcactgcagtagtttggagagacctgtagaaataagaagcaactttattgagaatcttctatctactgcgctagacactataccatctgcctcaattttcacagttctggcaagtgggatctttgttccctttatacaagatttacaatttgggggagaggcgggtcacccagtcccgcggctaggaacgcgcctctttcctctcccatcacgctgcaaggcttggagtcacttccggctgcaggtcccggaacaaatccgaccccagaagtggggacttctggccctcacctccccatttgaatgtaatgtttacagtgatccagacctggggatgcttgcttcccgacgtgtcctgggatcgcgcttctgaaaaagctcacctcacaacgcctcctccggacctaaatcgcgcaccagtgagtcgagtcctccaggggctagagaagcccgactttctttccggccttgagggacccgggctcaccaagaaaccagccgccctcctctctatggttttggagccggcggagagcgcgcaagggttggcgggactgcgagtttccggtctgggctttggcgggtctggtttgaagctctcctgtttgacgaaagtatgtctcaggaaggtgcggtcccagctagcgcggttcccctggaagaattaagtagctggccagaggagctatgccgccgggaactgccgtccgtcctgccccgactcctcatatccttccttggttgtcacttctacctagagaagggtgtgggcgggtcgcgaacctttctcttctgtcccttcagacccaccgccaggctgggttatattaccgcggcctgaaccccctcttttctttgtcagtgagtgggatgaaaagtgagggactggaggggaagcgacaaccgtggtagatttaagtaaggctttggccctggaaagcctcgcggacgtgttctgacccaaggttttagcagtggatgtggcgttttcttccattccttctttcagtttttctgtactcgttgcttgcaattaagtgtaaatacttttgctagtggataatgggggaggcaaggactgagacctgcggtatgacgatagctctggctcttaatagtttgaggtaaagcgagatactctgagcttttgtctcccgtaaaaagggtggtgaatatgaataagggctttcttagcgttataagaattaaagggcatagttctgtggtgtgaaatctttaaaagatgttcagtaaataaaaatgattttcctccttcccctctcagacctctttttcttctttctttctttttttttgacaagttctcactcctctcacccaggctggagtctttctgaaagagttcttccgcttgttgttggctttcaactgttggatttgaggcgcttagcgccttcttcgtccgggtgcagcacattcttgattggtctcatgcctttgtggttgtaaatgtgcctggaatcctagcctttcatggtaaaccatatgtatatgtatctttttcacaacatttgagcccagctttatacaattacactcaaaagaaaaaaagtaaccttcacttgagagaatctcaatactgcacaaatattgtgcagctaaagccctatgtaatcacatagaagtcattcacctaggcattagcaaaatctcagaaggtgccaaagcccccttttttagtttttgtgtaggtacagaactgccgtcttcaaggagtttcaacttgaaaacaaatagccaccctcaaaacattcaaaaacacttaaactgcgtgcataatgtgtgtgagacatggtgttaggctttgggagaacagagacacggaacgtgattcctcttcttccccacaagcttatagagagacttcattaagttgaaagtcaacattcccacctagctttgcacttcaaacgacatattcaaaaaagcccaaacttcctctagttttcttcatctgagtaaatggtttcacaaactgaaaccttgaatcctctctgtctcacacacccgatcagtaagttctattgtttctgattccaaactatgtcttgaatcaatccgtttatctccatcctcattgctaccactctgattccaaacccttatcacctctcacttggagtattaatagtttccttgtttctactcataattcattattccaaaaaagttaagaggggaaaaacatagatctcgtcatttccctttttaaaccactttaccttcaaggttccaggtgatctaagccttgcccttctctcatacctagttaattaactacactctgttcatgaatacattaggctcacctacctcaagatctttttgctcagcctgatttgttctctcagccttttgcatatttcatgtttatgtcttggcccaaatgtcacttccttagaggggctttttcagagccttcaatcttaggcagttcccccaaacgcagtcttacacttgtatcacattggcctgttcagttttctaaaaagcacattaccattaaaagaaatgctcttgtttgctttgtatattttccacttctacacattatgttgcaaagttcataaaggcaggatgttgattttcttcacagcgttaccctcagcacctagaacagtgcctgacacatagtaagcattcattaaagggctaaaaatatttcatgttttaaaaatacttgggagtctaattagacaatactttttttcagcttaatggtagtattttagcttcactattttaacaaatgaaaaatttgcaataaatctacaatgccattaccccccaaaatctttttcatgttttgcattttacgtattattttccaggccttacctgcatgtctgcataatcataactgactaattttggaacagctggtaattatttgagctttactgaaattttttcatgaggccaattctaccctactgaactcaaatttgagttaatgatgacctcattttgattgctgctgtaaaaaataagatttcggaagaggaatgaattcttgtattactgtggtaggactatgggtttttttttgtttgtttgtttgttttgagacggagtctcaccctgtcacccaggctggagtgcagtggtgcgatctcagctcacagcagccaggttcaagtgattctccttcctcagcctcccgagtagctgagattacaggcacgtgccaccatgcccggctaattttttgtatctttagtagagatggtttcaccatgttggccaggctggtctcgaactcctgacctcgtgatccgcctgcctcagcctcccaaagtgctgggactacaggcgtgagccaccgtgcccggccgggttattcatttttcttattaacattctttgatgattcttatggtgttgttacagtaaaacatttctaacaattattctaacaattattcttgatggtgtatatgaagaatttattgtcgtgtatttgtaagctgctatgtgcagaagaatttcagtcaaataaagttggtaagataggtatgtaagtaatatgaaaaaagatagaaggtgatgagtgacttaggtataaattaagtacaatagaaatgttgaggaaagaaaaatttcttgtaatagaaatcggaagtacaaactgggcatggtggtgtgcatctctaatcccagctccttgagaggctggtatgggaggatcactttagcccaggagcttgaggctgcagtgaggtgtgatcatgtcaccgcactccatcctgggtgacagcaagaccgtctctctttttttttttttttgagacggagtctcgcctatgctggagtgcaatggcgcgatcttggctcactgcaacctctgcctcccagtttcaagtgattctcctgcctcagcctcctgagcagctgggattacaggtgtgcgccaccatgcccagctaattattttgtattttaagtagagacgggttctcaccatactggccaggctggtcttcaactcctgacctcttgttcgcccatctaggtctcccaaagtgctgggattacaggtgtgagccaccccacttggccccgagcgagaccctctctctaaaaaaaaataaataaataaatcataaacctgtggattattgtagcattgtttctcatctgtcaaaaatatttcatgactatgcatagtttgaaaaggcaagtttgtccctgggcaattttcaaaatatttctttaatgtgttttcacaatactgtttacctaataaatcttaagtttttaaaagcaaaattaagccagtaatttgagtccaattccaatctcttatgagtcattgcttaaatttcaaaagggttttattttttttttaggtttgttctgagtaatgaataccctattactatgatactagtatcttccttaattatcctactcattgtctcaacattctgacagttggattgagcatattcgtaagtaaaattgttttaactgtatgatgtactttgatgttaaggtccgagtccccacatacctcggtagatgtgttcttacagttttgtattcccttgaaatgtaactgttctctatgttacagcctttataaccttcagttacttgaaatgaacaaattcattcaaattccagcacttaaaagttttaaattacattttggataaataccaaagtgttttgttgatgatgtatgtataaacaaattgtaaatattaaacgttagttgttacgattagacctatataaaacatgatatgcagtctactgaatagctatcagcctctaacatgtttagtgtcatttagaaaatgctttctaaattgccaaaagctgattgtctaggtgataacaaatttaccatttggaggaagttgactttctcattttcatgtcttcatcagtcttacttgatgagattcattcttctagtcagaagagagtttagactgctcagtttactcatattttgagttagcttttctatttagagttcacttggttgtggaatattcatttataatttgaatctacgttgtgtaatgggacctaatttttttttcctttgtttttgttggagtctcgttttgtcacccaggttggagtgcagtggcgtgatctttgctcactgcaacctccaccttccaggttcaggtgattctcctgcctcagtctcccaagtagctgggattacaggcatgcttcaccacgcctggctaatttttgtatttttagtagagatggggtttcaccatgttggccaggctggtctcaaaactcctgagctcaagtgatcctcctgccttggcctccataagtgctgggattacaggcgtgagccgctgagcctggccccagagtttgttttgttttgttttcaagacaagatctcactctattgcccaggctggagagcagtagtgcgatcatagctcactgcagcctgaactcctgggttcaagctattctcctgcctccatcttctaaagtgctgtgattacaggtctgagccatgatgcttggcctgtgtttttgtttgtttgttttgggggacagggtcttgctttgtcaccaaaactggagtgtagtggtgcgaacatagctagctcactgcagcctccatctcccacgctcaagcaatcctctcacctcagccttccaagtagctgagaccgcaggtgcgtgctaccatgcgtggctaattttctatttatatatttattttttggtagacatgaggtcttgtcatgtttcccaggtggtctttaactcctgggctcagacagtcctcccgcctcagccacccaaagtgttgggattacaggcgtgagccaccatgcgtggcataattttttttaagtaaattatttttttatcttgagtatagaagtgattcatgttcattgtggaaaatatgaaacatatagaaaaacagaaaagattacaaaacatctaatctgaaatggttaagattttgatgagaacagtctcatctcatttccgtatattcctgccagcctatccatcattcttcgtacatgtttatctacattaaaattggtgttatattttggaaactttttgtttaactacattgtgaacatttttcatgttttaaaatgtcattttaatgatggcagatcctattcaatagatgtacacacacctatttaactggtccacaattgttggatatgtaggtcgtttcctttctctctttttttttttttttggctactacttaatagtttctctgtatagaatgtggtattttgaaagtgtatcaagctttagattggtagtattcttgcatttaataaagggcagtggcctttgttgactgacatgacaatatttttataaaatttgttatttgctttacagaaattttgaaaattattgtagaaatgtttttacctcatatgaaccacctgacattggaacagactttcttttcacaagtgttaccaaaggtataatactattacctgaaaatacatgttataaggaatctagcctcagtcttagatgatttattattaattatggctctctttttctaatatatcaaatatattcaaaataaaaataaggagtaagtagatctcatgtgagactataatggtgttagtgtgatcattaggcagttaaaaactgttacaggctgggcacggtggctcatgcctgtaatcccagctctctgagaggctgaggtgggcagatcatctgaggtcaggagttcgagaccacccatggtcaacatgatgaaacctcgtctctactaaaagtacaaaaaattagctggacatggtggcaggtgcctgtaatcccagctacttgggagactgagacaggagaattgcttgagcctgggaggcggaggttgcattgagtcaagatcgtgccattgcactccagcctgggcaataagagcgatgctccgtctcaaaaaaaaaaaaaaaaaaaaaagaacttatattttcagattgtgtggttcctttactaactgaatttaaattatttgtagtcaattttaaatgctcttgtattttaaagccactgtactccagcctgggtgacagagtgaaacccttaattcaaaaaaaaaaaaaaaaaaaagaaaagctggaatattggcaaaatcaagtaactaagagaaaacattaaattcacagaatacattattacattttagatatatatggtatatgttttctctgaaaagcacaagcataccttttttgttttaaatggagggaactaaagatactttggtgccaaaatgaaacattatttgtaattaatctcttattgaaatgggtttctaactttagctttgaatcgtaatctttcaaatttcttgtactcatagtcacttgatgattctctatctgaaatatttcttagaatttgttcttgaccaccagaaaaagattcaactgttacatagatgaaaatggatgttgagtgttaacaggcctatgggaaacagtattttctttagctacattgtattgttgactgtgttgctattcttataatgtttaggtcatttaaattgttagaaagatccaagtattaagatctagggtggctaacttttcacagacaaaaagcttgtttgtaaggtcatttactatacccttaattcaggaaggttagcttgaattgggtcaaaaggaaactggttagaaaataagtgagtagtgaataggcgattcagtgcaaattccttccagaaaatacccttgtaaatgactgtatgaatgtggattcttcaagacagtcaaatttattgtgcgaaagtaatacttttattttttgcatctctaaaacatgaactttgagtgattttttaaaaaaattgatgctattaaatagattcaaaccatagaaatggaaaataaatttctgtttggggcttttggggggattatgttgtaaaaataccttttctctgtattttgtgcttaattaggtacaattgttaagctagatgatagcctgtggatgttactagtgcaaaatcaaattatcgtattgtgttttctctgtaaagttttgtcttgtcttttctagtgatttctcttattcctgtttattacttgatttgtttttacagactgtgaaattattcgatgacatgatgtatgaattaaccagtcaagccagaggactgtcaagccaaaatttggaaatccagaccactctaaggaatattttacaagtaagtcaaatgtattagaaagcaggagagagagggagcttaaagaatgtcaaaatttttatactgatactgattagctatgtattcttatgtaatggcctaatgttggaattaaatttatagaattaaagacgtgaatatagaaacatgaattctgaataataaactcttataagaagagaagtcatcaagctagctgaccctacctgtattttcaaggatatgtgtggaacacctgccatgtgttttgaagtttgtgttagtattctaaatggctagacagttgttccagtatttgtagttctgatagactaaagttctgtgaaaagaggaagagactgtgttttgttcattgctgtatttgtagcacccagcatgctgactaataccttttcagtgcacaaaaaatatattctaagtgaaatttccttccttattcacagacaatggtgcagctcttaggagctctcacaggatgtgttcagcatatctgtgccacacaggaatccatcattttggaaaatattcagagtctcccctcctcagtccttcatataattaaaagcacatttgtgcattgtaaggtgagtaaaggtctaattatactttgaatggtatataatcaatgtgcataggggctgagtaaaataatgtttgtataagattttacattttagtctatattattgaaataaacttttccatagaataaagaacatgtaagtaaataattgttgcaaaaaaagtggttttaaggaagtcattaaaagtggctttttggggttttttagttttatcttatttcccctctataaagaaagaagttttaagaatttgtgttgagacagacacagggatcctgaaatagttatgtcatgttgcattgaccaatattcaattaccattatgattagatgtcagaacttccttttataaaggaaagttaatccttatttagtccatctctacatgccagaggtagccttgaggcacaaaagcttgcctagaatttatgggtcacagacagttttaatattgctatttgttgggcgaatgaaaatcactagttaattaatacctctctttgctgataggatgctaaaaatgtcacgcacctggcctaatgttacccttttttagttctgtatttgcaagatcatggaagtcagaaataatattttatacatgcttgcatctcttgaagcacactatatttaatggatgttcactaaacaatgaatgaatatgtgattcagtaaatttatgatctctaatagtatgaattaaagtaaatttggctcttgagctttgatttgttttttctctcatttttatttatccgtaatcagaatagtgaatctgtgtattctgggtgtttacacctagtttcagaccttctccaggctcttttcaaggaggcctattctcttcaaaagcagttaatggaactgctggacatggtttgcatggaccctttagtagatgacaatgatgatattttgaatatggtaataggtgagtgaagaaaactttctgcttagtatatggtgactataaatcatgtatcaattaaaattgtctctaatgattcatgttattttcttactaattatgcattaaaattgatttaaatcttaccaaataaatttttaatcttgaaatttggaatttgtaaaatttattttgggtaccttaacctagatttgcgtatttagttactgtaatttctccacaatgattaacttatataactttataatctctgaggttgtccatattcagagacaataactttcacatttttttaaccataactgatattgagatgcagtttatatttccttccagaatacatataaatacgtgcatatgtgtatgtaaatatgtctattctcatatacatattataatgaaataactcattttacatgtgatgcactttatactagtttatttttattttattttatttttttgagacagagtctcactgtgtagcccaggctggagtgcagtggcacaatctcggctcactgcaacctcgcctcccggactcaagcgattctcctgcctcagcctcatgagtagctgggattataggcgtccgccaccacacctggctaatttttgtatttttagtagagacagggtttcaccgtgttggccaggctggtcttgaactcctgacctcaggtaatccacctgcctcagcctcccaaagtgctgggattacaggcatgagccaccgtgcccagccaatactagtttatttttaaagaattgctggtcgtaacacacttcattgattttatcactcattaatggattatgaacaagagtttgaaaaacaatataaaggcaaagtttgcattcaaaactttggtataaagagagtaagttggttttgtgcagtgtatcaggcacctgttgctctgcaacacaccacctcaaaatctatttattcactatttatttattcatgattctgtgagtctgcagtttagggtgggatgtcctgagacaactttctctgatccacctggggcactagctcacccatgtgacttcagtgacttcattcacatctggctgttggcagaggcagaagtacttgagaaagccatgtgcatcatccagcaggttcaccctatctcagatacctgatgccagtggtttcagggtttctaagagtagcaaaagtgtgagcaggtcgctgtgtgctagcacttttcaagtttctgcttgccttaattttattattgtcccccgggccacagcaggtcatagcgtttagcccagagtcattgtagaaaagtgtggattcacaaagggcagtcattgtggccatttttataaataatctaccacagactgagtaaaagccttgcatgaataccatggatattaatttgaattcttcctttttagattttctttccttagcaatttgttttgtcattttggattagaattatatctgtagaatatttcagttataatagggtacaacttttattccactgaacatctttagttttatttaggtcatctggtaggtataaacttcagaagttaatattcaatatttataaaaaccattaacaagtgtgacacttaaatagtttaaataattcttttgacacaactgtttccaagttgtgttacgtattttaattcaatcaaatgttgaaattgttcagtagatagttttaattataggagaaactcacccccatgacatttggatgtcttaaaagttctgttatctttctttgcagttattcattctttattggatatctgctctgttatttccagtatggaccatgcatttcatgccaatacttggaagtttataattaagtaagtttgtttgttattttttactttttagaaaatgttttccatattccccaatcttaattattcatgattctttagattgcatttaaaacattttgtgtgaatttaatgttcactgacactgctgtctgataatccagatattctacatgtagctctcaagccaaattggacttctttaccctgtggcctctaaaattaaaaaaaatgttcttcctagttagctagtacttcagaaataatgggccatgggccagactagaacttaaccacttttcttctgctactgttgtttaaccagctatcaagtatcctatttctaggattagataaattgataactataattaaaactgaatataatcttttcattaggtacttttaagttgttcacacttaattccatttgtacagtaattttaactttctgaaactgaagcattttaaagggtcaccagggatagtgcctgtagcattcatcagattcttaggggtgagaggagatgtggttgagatgtaaaaatggttaagaatatctactttatacacatacataaaacattaaaggtcagtgtattttcaggtcttaggtacttttcttgtactaccaggacattaagttgccattcagtggttaagagtgttgcctgggagctgtatcacatgtgcttaaatccattcttgaaatcatttactccttctgagcccttgggctatttggttaatttctctgaacgttagtttgctcatctgaaaatggaaataataatagcaacttcttgacagggttatagtgagaattgagttcatcactgtgaaatgcttagaaatgtgcatgacacatagttaatactcaaggaattagccacatcactatcatcatcactgattatcttccactcttaccctcttccagttcattttctgcccagcagaatgatcttttaaaaagtaaatcagatcatgttactctattgcttgaagtctatcccatttgattaagaataacaacctaatcctctgtggatgctgcctccttcaccagcctgtctcatgctgctctccctactcttagttcctcaaacataccaaactctcctgtcccagagtcttttcgtggtttttccatctgcctaggatgcttctctctcctattttgtgtaccttgctaactcctgcttactgtctttcagttctcagcttaagagttatatcttcatgataacattctttgatatccttaccctaagattaagttagattgatatccttaccctaagaataagttagattaggtctctctattgtagcaccttagactctgtcatttgacaaatcacagccctaattaattattcttaaaattatttaacattctctctcatgctagaccacaagtttcatgcaggtaaggcggagattgtgtccatttgtttgacccctttgtctccagggcctggtagaatgcctcatacatagtaagaattcaattaatattttacacagagaaaaaattagcaacttatttaaacaaatataactgcttcagaggtaaactgggcacatcttagttatattatgtgatatatgatgctttttgattgtttttttaaatgttctacaaggtagatattgttagaggtcctaagttacttgatgtgttacttgtggtgattgtattcttttctttttattcatttaggcagagccttaagcaccagtccataataaaaagccagttgaaacacaaagatataattactagcttgtgtgaagacattcttttctccttccattcttgtttacagttagctgagcagatgacacagtcagatgcacaggtaaaatttgggctaatagcattttaaacagcaactcttattttctttggcagttagtaaatctcatttgaatgtctgggtcagtctatttaagaggattttaatttatttcatttgggtgtttttttttgatctgtgggattatttatatcccataattacttttcacccagagcattgtattagattcctaactgctgtcattgcctctggggtctgcctggctccctctttgcttggtaactggttggtcacagcattcttctcagaatcctttcattcttttctgcatgagaacaaaaattcttttgttcatatttgtataagatctgatatagctgcaatcaatcttgcattttttcttcaccaacgcattgcgacctttagggatacaagtatgtttgtgcatgtatatgtatgtatcagtcttttaaatttgatatagtcatacatttgtttttattttgaaaagttagagtgttgaattggtatcccatttatgaaacattatattctaaaaatttgtagtacgattattgggaattataactcattttcctgtaacactgttatacatagtaccttttgctttcagactagccctcaattttatttaactatagtagtcctaaattataagattaatagtactcaggacctaacagttatatgtcatttgttttttttttttttgagatggcgtctcactctgtcacccaagctggagtgcagtggtatgaccttggctcactgcagcctctgcctcacgggttcaagggatcgttctgccttagcctcctgagtagctgggattataggcgcctgccaccacgcctggctaatttttttagtagagacggggtttcgccatgttggccaggctggtctcgaactcctgacctcaggtggtccacccgccttggcctcccaaagtgctgggattacaggtgtgagccaccgcgcccagcctatatgtaataattttaatgggaccatgaattgaatatttcttccttgaatagcaatgacatagccccttctattgtacatctgcaagctgatacagggaattcctttgtacctgcgctcttccctgccagtcagctatgggggtgaaagtgtaggggttcatccaagtcctaaaactggtagcaactcctagggcagggctgatctggaaggacagaccctaggggagggtggaactttaaaaagaagttctgaaggtagtaagaaggaaatgaggagtagtgttaggaaggggctaacttttttcttcttgcttctcttctttatctcacctgcccctccccttgtatcccttcttcctttttccctttccttttttgtcctcacttcattcgtgcatcctttctgattcctcttaccttgctaaaaggagaagtttgtttgggtatcctatatcaatggcaggaaggttgttttcttctttacctttatcctatagattcatattctcaacaccaacctcctcctttttcagtttccttcttgcttctcttgacaccacagagtttgcagctagtacttggagaggaaaattaaacagagatacttggaccaagagtaagatgaagaaagtctaaacaacagtatagtctatagtggcaagagagagtatgggggctgcttagccagggtggctgtacataaagtatatcttcagtttatataaactgcttatagatggaaatcagaaaatttaaattctcttaactgtccaagaaaattctcattttttcaaatttgggactgataaatgtgaccagttctgcttactgtccattgcctgaaatggagctttgaggtggactgtataatttcttcaatcttaactccaaattctgatcagcgacgccctctgctgttcactattaatatttatttaccaatcaaagtaaagtattgaagttttcctggcagttttcactttgtgttttagtccatttaggctgctataacaaaatcccttaaactgggtaagggattataaatattagaaatttatctctcacagttctggaagctgggaagcccaatatcaaggcaccagtagatttggtgtctaacgagggtgtgccgtctgcttcaaaaatggccccttgttgctgcatcctcacttagtgcaaggggcaagacagctcccttcaacctcttttataagggcacttatgtcattcatgagggcagagccctcatgacttaatcacttccccaaaggccccacctcttaatagtatcacattgggtgttaggtgtctgggaggacaccaatcttcaagccatatcatctcacttggaaaaaagtcaaaataaaaccagtagatttaattaatattacactatttatagaagcatgtgatgtatcattccttgtattaatttcctggggttgccgtaacaagttaccacaaactaggtggcttaaaacaatagaattttattctctcacatttctagaggcagaagttcacagtgtgtcaatagggccatgttctctggaaggctttaggggagaatatatttcatatctttctcttagcttctcggtgtcactggcaatccttagcttactttggctttctgtgtcttcacatcatctttttataagaacaccagtgatagtgattaagggcataccttactttaatatgacctcatcttaactaattatgtcttcaataaccctatttccaaataaggccacattctgaagtattgggagttagaacttaaagctttttgggagggacacagttcaacccataacaacccctaaaatcgatatttattctcaattaagtcttgaaattggtttcaaaaagagaatattctattagagtttttaatgtatagttttaacatatagttctttagcccccaattttttttttttttttttttttttttttttttttttgagacggagtctcgctctgtcgcccaggccggactgcggactgcagtggcgcaatctcggctcactgcaagctccgcttcccgggttcacgccattcccctgcctcagcctcccgagtagctgggactacaggcgcctgccaccgcgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcctgcccccaattatttagtttttctataaacagggaaatttatttgtgtggcccttagaactaatttaatttccactctaattcctacttatgtttatataatgcttttagaaatttgtattattcagaaaataaacatatactattgtatctgttgcctacacttagattttattgcctgctatatttaaattttattagtattttaattgttttattaaagaaagaatgtgcctgtaatctcagcacttttgagaggccaaggcagaaggattgcttgagcccaggagtttgagaccagactgagcaacacagggagacccccatctctacaaaaaataaaaaaattctccaggcctcatggcacatacctgtagttctagttacttgggagactggggtgggaggatgcattgagcccaggagattgaggctgcagtgagccatgatcaggccactgtactccagcttggacaacagagtgagagcttgtctagatagatagatagatagataatctaaatagataatagacagattatctaaatagataatagacagattatctaaatagataatagacagattatctaaatagataatagacagattatctaaatagataatagacagattatctaaatagataatagacagattatctatctaaatagataatagattatctaaatagataatagatagatagattagatagatagatagatagatagagcttggacaacagagtgagagcctgtctagatagatagaaacaaagaaagaaagaaagaatggtgctcatattttaaagcattgaaaaatggtcttccttgcttatattacccacaccttctttgttggcattaagatgcaaactttgttttaaacagttgagtaaatcaaagatgggactgttaagttatttgtgttatttacctgctttttgaaaatgtaaaaataaaactctaggtttaattagtagtatgctatttagtaatgaagtaaagctagaggcttcgaacaaatcttgtgtaatttcctcttgaatgagagagaaaatttaaagtaagcaaacaaataagttgtgtgtcaccactcattcagtcatttaacaagtatttccagagtacttattctgtgccaggaaatgttgtaggtgccctcaacaacttagagtctagcctgagacacaagtaagtaggtaattattatagaatggtatgatctttggaggactgggtattggctggctcatgggagtacaagataggtacccagtgatgaagtcaggaaaggtttcttatggtgatatgatgacgtctatgctgattataaggtcagtgtagaataaactttgtgcttttaaatttgcatagcactgtattagagagttcatcttcaaaataatcgaaaaggctgagtgtggtgacccatggctgtaatcccagcactttgggaggccgaggtgggcagattgcttgagctaggagttcgagaccaggctggccaacatggtgaaaccccgtctctactaaaaatacaaaaattagccaggagtgatggtgcgcacctgtaatgccagctacttgggaggctgaggcaggaggatcacttgaacccaggaggtggaggttgaagtaagccgaggtcatgccactgcactccagcctgggcaacagagtgagactccatctcaaaaaaaaaaaaaatgatcaaagaaaggtgaattttcatctaccctatttctgctgaggaaaatggactattttcaaatatttttaataagggtcaaaatgagggatcatattccattagcgaaccatccaactctgttttgatttggtttaatgaagattttgctatattggaaaagaaacatagccaatcaacatataagttaagatatgttattttcatatgaaataattcacaaattaaagacagtaatttatttgacttaattttatggcactatttaaagctgtttggattatagtgtgtattataaacttgggtggtggaacaaccaatatttattgagctaagttgcttaaacgtcagacactgtttaaatctcacaataatcctgtattagcctcattatagatgagaaaactgggccacagaaaggtttaataactttccccagatcatatagtagttgtagtaggaccaggacttaaatccaggcagatgaatctatagccctccctgcatattattggcactacccactgttttatcaatttacaaatgtaatacgtaatcagaaaactcacacatattacacaagtatctaacatggaaggttaaatcctattttcgtctactagaaagaatcacaggaaaggttttgatttattttgggggtggtttaacacatttaaaaataatgataggattgtgttatcattagagtcaatagacaaatctctgaaaacagaacgttttatttgggaggaagtaattgcactttggagcattcatgcagaccaattgttcggtatgtccacagaaaaaggagaaggttagcggtcttataaaaaaggagacatattacatatagctcttcaagaaagtccattggcactagatttggggagctgtcaagctctgattggtgagtgatggcagtgggtaacactggtcttagagttgcactagtttctttcagtagcccttagataaaactggtttccggttacagcaggcagtttcagcagccaggcctacagagaattacattttgggagaaatgttttgtgccctgagtgcttttcccctaggcctgttgactctgttttagttgggtatgacaagaatgactcaatttttgtaattaattttacattatacaagttgtttacaatttgattttttacttaacagtttatccttagggctttctgtgtccatgaagatatatgtacctgattcttatgtgattatactataaatttatagttgacccttgaacaatgcaggtctgaactgcacaggtcaacttatgcagacttttttaaattgtcatttattaccataaaataatacaaatctattatcaaaggttaaaatttatcaaaacttagcacacagagaccatacatggtaccatgcagttgagagaaatgtaaacaaaggtaaatatgcagtattaaatcataactgcataaaattaactgtggtacatattgtagtactattaggttgtgccaaagtaattgcagtttttgccattattttctatatattcagtatacaataatttcatagccacttcctgttgctgttactgtgaaaagtgttgcaaggccatgtgatactaaccatccccacgtgagcagtttgtctctccagtaagtaaattgcttttctcagtaaaaagttattgcttgaggtgcctccatattttttcatcatctttaatgcaatatggaaacccataagaagtgccactagtgatcctggaagtgctcccgagaattccttgatacatattgtaaattgaggtctgcaactgcaattacctgccatttcagatagatgattcttcttgtaaatagacagtgttaatacatatacaaaatatgttaatcagctctttttattagtaaggcttatagtcagtggtaggctattagtagttaagttttgggagactcaaaagttatcctcggattttagaccacatgggggttggcacccctagaccccatgttgttcaaaggtcaactgtatttaggtgttctccacatgatgcacacttggtacatttcagttttcactatataaaaaaagttttgtttttttttttgtaaagcgaaagcaagtttattaagaaagtaaaggaataaggccaggcgcggtggctcacgcctgtaatcccagcactttgggaggcagaggtgggtagatcatgaggtcaggagttggagaccagcctggccaacgtggtaaaaccccatctctactaaaaatacaaaaattagctgggcacagtggtgggtgcctgtaatcccagctactccggaggctgaggcaggagaatctcttgaacccaggaggtggaggttgcagtgagccgagatcgcgccactgcactccagcctgggtgacagagcaagactctgtctcaaaaaaaaaaaaaagaaaagaataaagaatggttactccataggtggagcaacccctaagtctcctggttggccacttttatggccatttcctgatttatatgctaaacaaggggtagattattccctttctgggaaaggggtgggcaattcccagaactaagggtttctcccctttgtagatcatatagggtaacttctggttgttgccagggtatttgtaaactgtgatggaactgatgggagtatcttttatcatgctaatgcattataattagtgtatagtgagcagtgaggacaaccagaagtcacttttgtcaccatcttagatttggtgggttttggccagcttctctactgcatgctgttttatcagcaaggtctttgtgacctgtcttgtgctgacctcctatctcatcctgtgacttaggatgcctaacctggaaatgcagtcctgtaggtcttgtcctcattttactcagccccttttcaagatggagtcctctggttaaaacacctctgacatatttccctcctcccttttataagggaacccttaatcctaagggttgtagagggacaaatagacatcttctataacttcttcgggctgaatagggatgatgatattcctgcctaactattggggtctcttatatttggggtagagaggagatcagtcagaaagtgtcagtatgatgagggccattcataactctcaattccaaaaaaagatgatatctggaagattagtaagtgttcgatttaataaaacattcagtaattcatattcctacacagaattatcttgtattcctacacagagaacaacagcagtatattctacaacagtaaagcaaaataagtaaaattatcccaagtaaactaaataagaaggctttccatgaactgggcaactgttggaaaccaagctgattccagtatgggcccagaattagaatactgatccagattttcacattaccatctctcttgtttcttctgagcagcagccagagatcactggttggttcacaggaataagcagggttagtctaaattgcagaaaaaaccctcaagaacaactgatgagaaaaacactcaaaaacacctaataacaagtgtaccatagtttttgaaacataatttttttctctctccagtctcccatttttactaaaggcaaatcatgataagactgatttgcttttttatacttggtctgattatctgtataaagtacagcaagaataattatttttcacatgggctttttaaaattggctttgatggaactctgtttcataaggaaactcagataagactttttaaaatatgaattgggtaaattcctttcctcttgaggtcccaagataacttggggctcctgggcctgtcagaaagtgacattctttatttaccacaggtaaggaaccctgtacagggactgcataaacaaggtatgaggcaagttttcccaagggcctttattggctttataagtcaagtttgattccttaaaggaaagcacactattccagccaaagccttggtaaaataaccagtttctccagttgtgtcctgttgcaaaagaaaacattcgtattgcacttatgcaaataactatattgctgtaagttaagaatattcataaataggttccaaattctggagaaatcagaaacaaatatgctccaaattttattcacagtgatatactttactcaattgttaaacagctcaaagaaaagctcacaacagctcaaaagaagttttcttgactctgaaaaataaaacaaagaatcagcaacattttaaacaaaaagtaaaaaaaaaaaaattacttcagtcttctgttagttcagtccatgtagttaatgcttgccctgtttgatatccacgaacactccatctcttcatgagagtcctgaaaatttctttcctctattttaatgtcacaattgccaaagttatcagaaacctgcattgaaaagcacctgtcaaagtcctgtagctgattaaaaatcaacttttgattaaaacaagacaacaattgtctgtggatgacaaaaagccttagggcagcctctgttaaagccataattgactggggattttggttacttctgtggcagataacaattttatataacaattatagtatacattaagtcatatcagaattatagttgtttcccataattttggaacacatgccaataacatatttatacaaatatagcccaaagaaagccaaacatcattttatatttgactatgcttcctgtatgatttttataccaaaaaagccaagtttcacctttgcactagtgtcctattgatgttaaccccaattcttaataaaactgtatagacaaatctatctaattttaatcagtataaaatgtaatcagtataaaactgtatagacaaatctatctaattttaatcagtataaaatttaatcagtataaaatctaattttaatcaatataaccataaggtaagattctcataaactatttacaactctttacaatttttgttaaagagtagattattgctctcaggaaatcctgttgtgattttttccagtgttcaatttatggaaaaactgaataatgcccctttaactttagccaatatgttcacacagatttttttttttgcaagattaattttttacaaatgttgtacaacttgctcaaaccttcagcgttatcctatttaacttaaaacaatcctatccccctttaatctaggtcaaaaatccacattcccatgctttcttataatcttttaccaaaaacacatttcactttccttacatacctgtaatgtaaaactgtttcttcagtagtcttcaattacatgttacaatgttaactcttagcaacttttacttatggtggaaaaccttggtaagtaaggaattctaattatgtactaggtatggagcctaggacacagaacagaagtgtaggtaaggtctgactctttctagcatagctagggggcatggctaacaccacatgtccccaggccttacctagaatctgctccaaagttaaacagttttcaaaagtcaaagaagcagtttatgaccttaaagcatttagcaaacctaatatctaacctgcctaatttaaaccacgtctttattttgaagatattttaattttaccaataatctttaaaactgtatttcccagaaattacttaagtcacatgaactaaaaggcattccactttttacttttctgacaaaatatttaagtgttcattatttttaaaccagttatcaagctcttttatatttcatacacaatacatataaatatacagaagaagagatccagtagttattagatttttcatttgccagttttatttatttatttatttattttgagacagagtcttgctctgttgcccatgctggagtacaatggcatgatcttagctcactgcaacctccgcttcctgggttcaagtgattctcttgcctcagcctcccaagtagctgggattacaagcatgagccaccacacctggctaatttttgtgtttttagtagagacagggtttcgccatgttggccaggctggtcttgaactcctgaccccaggtgatctgcctgcctcagcctcccaaagtgctgggattacaggtgagccatcacccctggctcatttgccagtttcttaattggattactggctttagggtagagcccttggaggaacagggccaggaaagcatgcggtttctacagcctaataagcaggcacagttggaacgcaaaatagatccgccaaaattaagtgtcccatttgtatactggatcctggattcccaaaagagaaacactatagaaaaaggcagtccaatgattttaccatgcatttcattgcaaagtaacccaaagccaatcagtctattctgtgatcagcccatcactcatgggagttgtatctctcaatgggggttgaggggaaggtggggacatccccataccttctaagtggccaagagcatgcttctgatccaaatgtgcaaagatcttgagtatccccctcgtgccattagttatccccaaaagtatatttcctacctagttatataccaaagctctgtgaagtaatttatgatacctccaaagtgaaaaacatcagataatgcaatgcaaagcagaacagaacagagccttagattttgagagggatctatccacttttaattcttggggttccatgaggaaaatagaggttttcactaaaaaaggatctgtggtgccccctctgttttccgatggagtcccaggctgttagagcttgaatgtctactttgaattaagctgacttttaaccacagcactttttaaaacgtccttttaaatcccctattacccgactttagccatgccaaagtgcggatatttctggcttttgaacgttaccaaaggtaaccttccaggtgctcagagaaagaaaaattcaagacagttcatggaggggaagagaatcaacaaatggtaaaggtcacacagatatcaaccagaaagtactcattgcctttgccagattgaacccgggccgccagccattgtaaaatggcaaagccttagctgctgaactccagcactaggcaatttccattgttctttccagaaggagcccagagcagccaattttgagcttgcaaaggctcaagataatttttagagctaattaaaacatgaacccccaaattcctgtcctctggatggtagagacaaagagcaagtactgccatgtggttacaaggtcaagctcctaaggacatttttcaacatgtggtctctgggcaagatgaaagagtggacagttgatctgagtaacagaaaagataagaaagggaaaggagagaatgggagaaaagcattgcctgtggcagggtggggaaggtgaggagctcagggaggcctgagaaagacccctccattgcagtgacactgaatcaagttcaggcagcacttgtctgtagtgaagggacctttttcagcagtcccatcagctcaagtttccccttttggggaggataaaagctccccacgtcccatgattctgtacatgcctaatcctgtcacccacagccgtcagcaggagtgcaaggccaagtaatccaaagagaatagcagttaacatcccgtagtgccaaaccagttcttagccaagagggactttactgagggggatctctaaccccctaaatcttaagaaggagtctaattttcctaagttgggccgcaaaccaaagttcagtcaagcatcttttccttttattaagaggggcgtttaaacccaccctgtcttaggagagactctaactcccgtaagttaggcctctaacccaatcctcttcatcacctgggtaccccactacttaacgaaagttgactaattggtgctgcagtctgctttttggggctggaggtttcctcagtattgtccctacagggtttgccaggaagttattactggaaaggggtcctgatccagaccccaaaagaggtctggatcttgtgcaagaaagaattcaaggtgaatccatagagtaaaatgaaagcaagtttatgaagaaagtaaaggaataaagaatggctactccataggcagagcagccaaatatgtcacattgcatacctatgctagtatttctatagactgtatttccagaaattgaattgctactcaattaaggtgttttaacatttcaacttttaataataatgtattattttatgctcccaccaatggtaaaagaaagtgcttgttaacttacttccttactagtgcagggatattatcagtctttttaatctttgctaatcaaataaccctcaaacctcccccttcccgaaatatatataattaagttataatttggatatttttcagtagcagtttgttttgtcttttttgtgtaatgtgtttttatgtctttacctgttttcttttatatatcattctttctttgatttgtaagacctttttcttttgaccatccgttaaattgatccccatgtaacaaagaataaggtatttaaatttctttcactttcagatcaactgagaaggatcacctcttttgctatcgtaggttaagatttcttttcttttcagtaatgtagaatttaatttaatacctctgttgtcatttgttatttgtatcgcacctaataattcaaagaggagttatattttctcggaaaaattttatactgtgtttaagaggggttttttttgtttttgtttttagaaaatattgtctcatttgtaagcttagctaattttatattcttttcttatttattatgctttcttatttccctttttggatcaggataatgctgactacagattatttcagaaaacactcaaattgtgtcgtttttttgccaactcccttttgcactacgctaaggtaaggctttattatacgttactttatttaattgtagttctctcagaaaacgaattattatccctattccacagaatagaaatttcaagctcagatagcatataacttgatcaagtcacatatctagaaaccggtaaggctgggatttaagtacaggtgtgatttctttatcatttatggttagactatgtcttagaaagtaaaaaaaaaatagtttttattgtattataagatataggaaaaagctgatggtcatttaaaaatttttaaagattcccctgatagaattgattttttcagaaagacaagcagcatagttagagaaaactttgcttccctacacaccaagtaaatatcagatgggtaacaactacccgtcaagtgccattggtacatttcccacaatgtgtctttgccactggaatacaaaccctgcaagctgcagggaacccagtgtaagaagcagccaactactcttaaatggcagctgcccagaaagaccaatttggatggcagtgtatcagtagccagggtaccagccatggcattctgactataataaatcgtcattggaaacccttatctttcgtcaaaaacagaagactaggtcaaaaacaaattgaacatggacaatagtttttttaaaaaccactaatatcttttactaataatgttttgttcactggctgctgtaagcattctctgctcatctttgcaaataatctgccttgacaacttttctatttattaatttttttgagacagagtctcgctctgttgcccaggctggagtgcaatggcgtgatcttggctcactgcaacctctgcctcccaggttcaagtgattctcctgcctcagcctcccgaggagctgagaccacaggcgcctgccaccacacccagctaatttttgtatttttagtagagatggggtttcaccatgttggtcagtctggtcttgaactcctgacctcaggtgatctgcctgccctgccctcccaaaatgctgggattacaggtgtgagccactgtgcccggtcgacaacttttctattttacagttatcgctactgttctgatgactctcaaatacgcagccctctttaaaattatgacacagtttttaacgtttgaacattgtggttaaatagaacaatgagttttttagcctcatcctcctttcattctcatgttaagaatttttttttagtgctgggtgtggtggctcatgcctgtaatcccagcactttgggaggccaaggcaggtggatgacctgaggtcaggagttcaagaccagcctggacaacatggtgaaacccctcctctactaacaatacaaaattagccgggcatggtggtacatgcctgtaatcccagctgcctgggaggctgaggcacgagaattgcttgaacctgggaggcagaggtttcatgagccgagatcacaacattgtactgcagcctgggcaacaagagtgaaacgctatctcaaaaaaaaaaaaagaaaagaaaagaaagaaaaacaaataatttttttaaaaggggtcacattcaggattttatgttattttgcatacctttgtgagattatatgtactaaagagacatatttttatgcaaagaatgaatagagttgttttattttaggaatttcttcctttcctctctgattcttgctgtactttgcaccaactgtatcttcagatacacaggtaagaagaatgccatatgattattaagatacaacaatgccatctgtgccatgcagtgcttaagtacctaccattttatgataaaacagaataatttttcttaatgttttagtaatttttatctgctagcttgaaataattggagatagaggcttttgaaagatacattccacatgagttatgcttatctttgtattttattagtaccttatacaggagtaataattagtaggtgataaaatccaatggcaaatataaatatatatatacacaaatatacgtatacctttatttttctattggcattttttaatctttatttttattttgtttctatgaagtttaagtcacttagcctccatttaaatttacattttgatacctttctgtaattcactttacaggacagtcttttttctgaaaccatctcagaaaagaactgaattacagaaaggtatcaaaatttagatgggggctaagtgacttctaaaattgatggtttcctccaaagagccctaaatttgacacaaagtgagttcatttatccagcagtcctgttgcagcttcataattcatttagtgtcccagacaactttttcacacctttccttcctcaaacttcctgtatcttccaacaccttcccaattcctcactgtcaatgacctcacttcctgtgtcactgaggaaaaatggaagcaattaagagagctgctgtatgtttcctctaacacatctactattctatgtgtatctagacccatatattcattccctcactcccatgagtgaactgtgcccctaagactagcctctccattgtgcattggatttcatcctctctcacaggctcagtgaccttgcaccagcaattattccctttccctcttgcatcatcagcctttcctccatactgggtcactctcatgagtatacaaatatgctgttatttttcccatcttaacaatacaaaacaaaatctcttgactctacgtcctcctacaaataccgtctcgtttctctgcctttctttacagcaaaatttctagaaagagttgtctatacccctgtctcaactctttcttgaatctagtccaatcaggctttctgtaccaacacttcatcaaaatagttcttgttaaggtcatcagtgaccaccacattgctgcatccagtagtcaattatagtccttctgtaacctgtcagtagcacttgatcctcttttttgaacactttgttctgttggtttctagggcatgtctcactcttggttctcttctagtcttactagctgctccttctcagcctccttagcaggtttctcttctaagttaagtgtgtcccagcacttactcctcaggcctgttatctgtctattatcatttagtctcaagactttaagtttatgtctcctttaatgtttaactactagtcaggacatctatactaaattgtcccaaactgaactcttgatttccacccatatcatcctcatacccaacaaaatctgttccttttgtaacttctttatttcagtttaagtggcagttcttcaaattgatcaggccaaaaaaccttgccctattaacatgttctgtcaatgttaccttcagtgcacacacgcacacgtacacgcacttctcatcacctgaactgctaccatctgatctgaccccctattattttcttgcctggattttgcaaaaaactttctatctttgcctcgcgctagtttgttctccacaaagtagccaaagtaaatgataaaatacataaatcagatgatgtgacttctctgctcaacccctcaaaatgactttcatcaatggaacttcttgtctttctttccttgttttatttttcttctttacagcattgaattaacctctgctatattatgtatttacttgtacacttgtctgttaactgtcccctttcattagaattgtaaactataaagacagtgactttgtatattctctttattactgtatcacccactcgtggaacagtgcatggcatgtatacataggcacttagtaaacatatgtcaaattaatttaaaaatagttgattgaaaaaataaattcttgcaatgatgctcagtagatgtaattcaagtctgtggaatttcattactatgttttatttgtatatgtcttttatttatttataatttaatcctcacagtaactcagaatcaatgtcacaaatgatgaaactgagtctcagggagggcaaatgaatgaaccaaagtcatgtaactaattgacagattggtgctttttccatcactctacaaaaacctcaagtgtttatcttaagtgcatactttaaaatgctgttatcctctgctagacagagttttctcatgtattgtcaagtttacaattaatgtggcaaaaaatatagaatacatatcttagttcacataagttttgattgaagttcagtttaaaatccagttactgagacattttcatgaaataatctttccattcttcagtgttagtatacagtttatttcttgtaaagctcttgcttctgagaaactgagtattaattcatagtaaattcagcattctgcctattttaaaacaactttttttttcttttttgagatggagtttcgctcttgctgtctaggctggagtgcaatggcgaaatctcggctcactgcaacctccacctcccaggttcaagcaattctcctgactccgcctcccaagtagctgggattacaggcatgtgccaccatgcttggctaattttgtatttttagtagagacgaggtttctccatgtttgtcaggctggtcttgaactcccaacctcgcttgcctcggcctcccaaagtgctgggattacaggcgtgagccaccacacccggcattttttttttttttttctgagatagagtttcactctgccgcccaggctggagtgcagtggcgcagtcttggctcacagcaacctctgccttctggtttcaagtgattctcctgcctcagcctcccgagtagctgggattacaggcatgcaccaccacaaccagctaatttttgtatttttagtagagacggggtttcaccatgttggcaaggctggtcttgaactcctgacctcaggtgatccacccgcctcaacctcccaaagtgctgggattacaggcatgagccaccacgctccgcccaaaaacaacttttaatagaaataagctagaatttatcagacatagtcttttcaatatatatttttacttttgatttaagatttagatttttatagtatttttaaggatattgtgaaaatgatatcagtgcctcaaagcaacaaagatttctctaagattatcaacttctcattttatagaattatggctatgtttagtttagagatcttgatccaattctggtatcaattcagtactttgaattttgttttataaaatgcacacttatttttaaaaacttagtttttaatatatttttactaccagaacatcagtttatagtacttactctacctaaaattagaagatagctattaatgaatgagttttttttctctcccttcccagcaagtttcctccaagcctttatgctaccaggatttctaaagcacaccaagaggaaatagcaggtgctttcctagtgacactggatccacttatcagtcagctgctcacatttcagcctttcatgcaggtggttttggacagtaaattaggtaagcttcaaaatagatttaatgataaatcatctattatgacatgttagagacactgatttcccctagccattcttttttacaattaagaaatttttattaagtttcttttactttcttttcttgaaacatatttcttatttaaaaattatacctggctgggcacagtgaatcacacctgtaatcccagcactttgggaggccgaggtgggcagatcacctgaggtcaggagttcaagaccagcctgaccaatatggtgaaacgccatctctactaaaaatacaaaaattagctgggtgtggtggcatgtacctatagtcccagctactcgggaggctgagacaggagaatcgcttgaacccagacggtggaggttgcagtgagctgagattacaccactgcactccaggctgggtgacagagtgagactctgactcaaacaaaaaaaaattattcctttacgtattaatcagatttctgctgaattaatgtgtttttattacatgtaagacctgccatgtgaactgcagtttccacaatgtcttcttctggttgttgtcatggataagctgccatctcagcctaaggaagtgcaaaccctgtggtgcacagacagccaggtctcagaaacgacaaccaggtagcaaacatgtttttatccagtcatattaccaatggttaagaaggccctgttgtttggaatggtcttgaaattaagtttgtgtgttttttttttaaatcagatatttatgttaatagttattgtgtagacacacatatatattgctactttataaaagcagataaatataaaatatataaacctatattagatgctaaaaatattttaatatttaattttgttcagtattgcttaatggtcagcattataaacattgattgtaatagagtagctataagtagaaacatttaaaaacgagctctgataaatagaacactagacactgtaaggtatatcctggcaaatttaacctttaatcatcttccttgccaacaccgtagtccaggctctagtttctttcttcctggattactctgtgctctaatttttcacctcttcctttatcccattctgcgtaccacgatgaggttagtctccctaaacctggctctgagcttcctattctgctcaaaaactgaaacataatgttagaacttctcagctttggatttaaagcctgtcccatactattgtcatcttctgctttttctcctcattcttgtattcattttcaacacatattccttgcttctgtcacccccttatttgtgtgcttttactcgtgcttttgtcttctttacgtacttacaatttgaacagttttgttttgttttttttttgtttggagcagggtcttgctctgtcacccaggctggagtgcagtggcatgaccatgggtcactgcagcctcaacttcctgggctcaagtgattctcctaccttagcctcctaaataactgggactaatggtgtgtgccagctgtcctggctaatttttaaattttttctagggataaggtctcactatgttgcccaggtcttccaactcctgggctcaagtgatcttcccgcctcggcctcccaaaatgctgggattacaggcgtgagccactacaccctgcccataacttgactatttttaatttgttgtttaaatcctctaagtttcttcaaccattttaatcttaaaatgactcctcgtctgctacttattttctgtttttccatataatatctaatttagctatttaagtttcaagttccttgaggaactttgactttgtgtaactcagtaccaagataaacagttggtaaatgatgcaaaaaatgtccaggaaaattctcctttaaggaatttctttgacagtgaatatattttccttttatgtgtacatattcacacgtgttggaaactattgctgattatacctcttgaaacattttctgcttaaacaaccttccatgttacatattattattataattgctaattagtaaatgttattaatgttgggttcaatgttctcaatttccctgcaggatatctctactcaaagccgttttctacagttttgagcagtgttctggtgaactctctctacctgttcatttacagggattaaagagtaaggggaaagctgaggtggctgtcaccttgtatcagcatgtttgtgttcatctgtgtacatttattacttcctttcatccctcactgtttgctgaactggtaagcatattacttactgtgctaagctaaggttacacttttgctttctcttcattgaaattgtgattcatatacagaagaaaatgtgggaatacttagtatattccttttgagtgaaacttagttgtgtcctagaaaatggtaatcccagattcctgtattatttagatctaatatttggctaaaatatttgagaaaacattttgggtggggaggtatgcaaagacaatgtgagaagaggaaaaatatgtagtacttaagtaagtttcaaaagaaaagtaaatagcttgtagtatcaggtctcttatagatctcagacataatatagattttaaaaaggatagaatttgatttgaaaagaggttaagaaattctaggaattcgatacttgtaatatctgaaatttaaagatcagtagcatttcagatattacacaatatctagcacctattaaatgttgtatgtgaataaaggcagaaagaggaatataagcatatatgttatttatgttgttttgaatatttcaggctacttagagaatctttgtggatcctagtgactgagttattacatttaaaatcatgttgaactctccatagcacagcacagtacttaatgtatagtaggtgctcaataaatattgagggaatggcagtgtcctttcagatactagaaagtagaactcccccattgaggatctgttatttggattctgatagtgctttcttgttttattttgagaaatataatattattgcttattgtgaactttagtatttaaataaattaatttttctgtttttgattaggatgctgctctgctgaatgctgtacttagtgctaatatgatcacctctttgttagctatggatgcatggtgcttccttgctcggtacaacatatttgcttttttgttctttggattggttattagtagtgactgacagtagataattttataattgtaagcttatagaaaaactgtttcaataatcctttaaaaataattcccaaaacgctttgatttcatattacagcattaaattaggaaacaagttctttctttggttcaagccaatagatgagtactgtttagggagttttgtatattgtgatattatttggtcatggaaataatggcagtttttaatgtcctcatcagaatatttagtgctttatgcaagttcatctccttatgtttctgagtaattgtataaacatagttgtcttctcttttatattgcagatatgggactgctgaactgtgtgcacaccatgtcaccatagtggctcatctggtgcgtagaattacaaggcctaaaacacccactttctatgcacttcctttggggatatgataatctttaagaatgtgaatatcggcgggagaaatatcacagtaacaagattgttttgacagtctttgtcttgtattaatgctgatgcttttaagaaggatgtactaaaaaaccgttagtgtgaaactgggaatgttttctcatattctcaggattttatgtaatttcagtaattgttctgggaaggaaagactgggttaattgaaattacatttaaaattgaatgcaaagtagaaaataagagcgacttataattgatggccaagaggtttctctcttctgtctctctaatatgccttagacaagtcgactcttgattttgttgtattttttttttaagtcaagatgatttgagaggaacttgagtttgacattgatagatacttttggcaaaagaagtcatgttttatgaatgggtacagacagaaaattattttataatgatttcatcatcttaacattaacattttttgcttttaaattctgaggtgttttatgtgttccatataagatgattatgacctatttgttacatatttttttccctggcctttaagatcttatgtgggccatacatcttttgttttctaatagtcttattgtatcatatatttcttggtttacctttaaaggattttgtagatcagatccagtgaggtgtgtaataacctgaacagctgacatctatgtctccatggctgatggtctggattatcacttacacactttactaaatccttaacatatctttcacaaagcagataaagagtgatttttatgttatgtgttttatgtctgaagtttcctttaaataaaagctttcttagtgcattatgttgtaggaatggatttcttctagttcattatgataaaattgattccaggatggaatgatactatattatgataggaattgataaaattgaatttataaaatttttttgttagtggtggtttttttcttagagacagggtctcattctgtcacccaggctggaatgcagtggtgtgcaatcatagttcactacagcctcaaacttctgggtgcaaatggtcctcctccctcaccctgctgagtagctgggactacaggcatgcgccactatgcccagctgatttttaaaactttttgtggatatggagttcttgctgtgttgcccaggctagtttcaaactcccgggctcaagcagtcctcccaccttggcctcccaaagtgctgggattacagttgtgaaccaccacactcagcccctgtaacatcttttaatgaagcttctgtcttgtagagttttatctacctctctactattgtagttagatcttaaaaagttccatgaattgtctttgagtaggaggactgacatacccagttatcatcaaaatgataattagaaatagaaattacagtgttaaatatgtcagaagttcaatctcattctaaatttagattcattgaagataagaaaagccccaaattaaaagtcaatattacctacaatcttttcccctagaaagagctgctattaatattttggcatattctcttcttgtaaaaattctgattctaaattagtcagtctctcctctctctctcatgtctttttccagataaagtcatgccctggagaatgttatcaactcatcaacctatcaatactgttgaagcgtctctttttcttcatggcaccaccccatcaggcaaggaaggatatcatctttgtcactgtctgtgaagctgctcagagttggattcagactcctttgatagcctttttttttccatttttaaaaatttatcttattattttttttgagacagagtctcgctctgtcacccaggctggttttacagtggctcgatcacagctcactgcagcctcgacttcctgggctcaagcaatcctcccacctcagcctcctgagtagctgggactacaggcacacaccactacgcctggctaatttttaaaaaaattacttgtagagactgggtctcactatgttgcctaggctggtctcaaactcctgggctcaagtgatccatctctgccttccaaagtgctgagattgcaggtgtgagccactctgcctggccttgcctccatttattttaaatttaaatactggtgtgatctaagcataaatttttgacgttgattgctgtgcttgttgctgggtatagattttgatgtccttgctttgagttatagataattattctaattctgtcttcctgaaatagatctttccccttatttttcatatatatttgagatacatgatatgaaatggttctatatcccctgccccttttattttgaagagctagaatattatttttgctcttagtggtctttacttacataaacctgtatggcctagtgcagtccctcagactggtcacattggaactgttgtaggagctcttttaaaaatataagttcctggactctaatctgtggatgggtgggtatggaggcatgggtatgaagtaaggctcaataatttgtttttgttggtactatcattaagttcctgcgtgagtcagacttggatctaagcttgggaaccactagattagtgaagaggattagactttaaggtcttatggtcctcggtttgaatcctggcataccatgaccttaggcaagtcatcctttctgaacttcattttccttgtctgcaaagcagaagatatgtataactattttgaaaaagtttgtaaagacttggaaataatacatgcaaaacaggatagtgctgggtttaagagggtgctcagtaaatgctaggagttatttctgactagggtttttgcctcaagtccaagtcttttcctgccctagagtggttggccaggaaccagaggtactacacctacctcttagccttcttttcgtagccccacctattagccctctaagagcacggggagcttgcttgcttacaaaagaattttctactccagatatcttagaagaagtgggactgggagggaaagggtcacatgtcataagactttaagaaagtcactttcctttttttttttttttttttttttttaaatagagacagggtctggttatgttgcccaggctggtctcaaacttgaactcagacgatcctcctgcctcggcgtcccaaagtgctgggattagaggtgtgagctattgagctcagctgtcactttccttttaacctcaattttcttatttatacaacaggaataaaattattttcccaaggtggttatgaaattttaacttttaaaataatataactcagaatgaattagctatgaggtctagaagcagtgttctaaattagataaattatagtttatgcctagagatctcttactctcagttttctaaatttttccaaataattgagactatcagatatgtaaattataggtaaatgaggggttacttttaatttgtatcttcagttatcaaatgcagattttctttatgtacaagttattgtgataaaatttaagaaaacctgaatctgcatacctattttaagagtccttaggagagttaattataaaattgagatagatactaatactcatatggcagttaagaaacttgataagatacacatatggcatgaaaagaccatttaacaaatgttaggtctcctctcctgcttggctcttttttttaaccccttaagacattatcctttctcttaaatgaaggaggaagggaaataatatttttgagactgtaacaggccaggcacttaattcatttagtccttacagcagccttgtgggatagataatattgtgtccatttgacagatgaagaaacaatagctcgaggaaattaaataacttccacaaattcacacctaacagctgatctgggatgctgaggcaggaggatcagaggatctttttatttagcccaaagttcaagtccagccggacaacatagcaagactgtcttattgtaaaaaaacaacttggaaaccacggcactatctcatgatatcttaaggaacataaaatctagtagaaattataaatttataaagatactcatattaaagagtggtttgtgatgaatgccaaaactgaggcacaaatcaaatgttgttgggtgtttgtagctgagacagtcatttctgaagaggtgcagtatgggaacaggtaggcataggagttggaattgatggcatttgagttacatgttacaggatgaatgtggaaggtggtgggactagagaagcaaaggtaagaaagcatattagagaaaaaaggagaagtgagcaatgaaacttgaaataattattcaactatttgcatacaagatggtgtctttttaaatagtaaaataagaacccaaatttttttacgagtgatgtcaccttaacataaatgaaaatagttaatcccagtatggtgatgatatactttaaaaaacaaaggtgtctatgatgctaatttggaagaaaatgctaatagaaagatgttagaatgcatttactgttctaataggagtaattattgaaatcacattatttcttttagtatgtaactattagtagtattccattgtatcaagaaaagcaaaaatacaaggaggttacctacttgagggaaaagtatttaatatgccttatctaagcacactgataattgtactacctttttaatgtaaagtaaaaattactgtatttgcattttaaacccacaagtgtattttttctctttccaattttaagaagtcataattctctgtgtattgtccccttttactttagtcttttatgaactattttgtcatagcagttttaagtctttagaattgtgttgaaaccagggttttcaacctcagaataaatcttgaactctttctataacaaattttggcaatacctacccttttatgttgtccaggacattatttttttagtttctattttggaaagggaagtagttcacttacttactggactttattataaagaaaggtgatatttgaactgatgtttaccagttggcacagttctcttggctttcctgatgtagtttggttttatgaataaagctgctttttgtaatagacactcgctcatcaagggatctgtttttctggctgtagcctctgtcacagcagatagccacatgatttctagcttgcattgactggtaaatattttccacaaaagaaataaaattgaaatacaaatatagcatatgacagaaaagtttctctgtcagatttaattttttttttttttttttggtgggtttttagtttttggtatgggaaaagttttcatcaagtagattttgaatattttaaattgaattattctacttcttagaaaatacactaatatacttcctagttggattatacttattttaatcattaaatgcagcattggtttttaccatttttctaccaaaaactgattcaacatttaaactgtttcttagaacttttgttttccatttttatctagtctctaacatctgcattttaacaaaacagtacttttctgttaacctagtaagcactttggttatttcagtggtggaatggatttgccaaccacgctctttttgatttgtggcttacctttgtgaaactgatttagtatgttgtctaaagtaggacagaaccagctaactcatttgaaagctgaatctttgcttctttaagttctctgctataatcaagtgagataacagtaagctatgaaggttgactaaatccagtttgtatatttggaatattacttttgacttaactgtacaaggtgacgagtatataggaaaataagacttattggtaagtaggagcatgataagatatctgacataactaataatgaaatacattatttaatgtcttggtgcatttatattgtgctccacttaagctgtgtttttgttttggaaaccaatgcagcatcaataacaataataataaagcatgttcatttatgttaccttggtctggaatgtagatattaccgtaccattataaagctttctcgaaatattaaatgtggaaactaatacttagcttttgtgtatccattcctctgacttgtctcatgttactcttctttctttaacaatttatttcagctggagtttatccagaaattttccccaaaagaagcagaaaatctgcctctgtggcaacatatttccttccaggcgttacctcctgagcttagggaacaaactgtccatgaggtcaccacagtaggcactgcagaatgcaggaaatggctgagcaggagtcgtactttgggagaactagaatctctggtaagataataattttgatttattttattcattcagcagctgtttattgagcattgttttaggtactggggttaggttgttaataagatgcacacactctctgttctctgtttctgttagaacctagtaagattttcagatttcttcattgtaaaagaatctgtgagaaacttaactgttattttaattgatgtattatattggggggttgtttcctatgtcgcttaaggtatgttgagacatgatcaaacacactatggaacacttcacttgtgtatttttgctgatgtatctctggattatgcagatgtaattcttccattcgacaaaatacaacccccattttatgctaacttactctgaacctttatgtaccttttacatagaatgttccctcataaaataatggaataataagagacttatctactagaagaagtaggaaatgtgagatttttaaaagttggctggatatagtacatgtagttgaaatttcgagtttagtgttcatatgctcattcattcattcaacaaatatatttggagtacttttatgtgccactttgttctaggcattgggggtacatcgggaaccaaaaatttctactctcatagactcacatttgagcttagcagtggacagtaaaataagaaatgccaattatgttaagtagagaaaagcaaagataaggatagggcattcaaagggacagaggtctatttgcagttctaaattaggagttcaggtttttctgagggcatatgtttccatgctgagtacaaatgttctgataccgttatatgtaatgacacttgatcataattattataattttttggcggggatgaggtttcgttcttattgcccaggctggagtgcaatggtgtgatcttggctcactgcaacctccacctcacggattcaggcaattctcctgcctcagcctcctgagtagcagggattacaggctcccaccaccatgcccagctaattttttgtatttttagtagagacggactttcaccatgttggccaggcaggtcacgaactcctgatgtcaggtaatctaccctccttggcctcccaaagtgctgggattacaggtgtgagccactgtgcccaggcttatccaaaggaaatgtttttatgtgactttattttagaaaaagtatcaaatacctagttaagaatgggttaaatgtgtccgagtttagcatttaatgtgtaccaatttctatagtaaggacaaaggatgttttgttttatattaggtaaagaaaagcactataagtaaactttttgaagtatgaccacagctttttagtccagcaggttgttcaacatacgtcttttattttaaattttttcaacttttattttttattttattttttgagatggagtctcgctctgttgcccaggctagagtgcagtggcatgattttggctcaccgcaacctctgcctcctgggcttaagcgattatcctgcctcagcctccagagcagctgggattacaggcacccgccaccatgcctggctcatttttgtatttttagtagagatggggtttcaccatgttgaccaggctggtctcgaactcctgacctcaggtgatctgtccacctcggtctcccaaagtgctgggattagaggagtgagccaccacacccagcctcaacttttattttagatttaggggatacttgtgcaggtttgtttcctggttttattgcgtgatgctgaggtttgggatatgaatgatttcatcacccaggtactcagcatagtacccaaccgtttatcaacccttaccatctctcctccctccccctactagtcccgtgtttattgttgccatctttatgtccatgagtgcccagtgtttagctctcacttataagtgagaacatgtggtatttggttttctgttcctttgttaatttgcttagggtaatggtgtctagccgctctctgttgctgcaaaggacatgatttcattcttttttatgactgtatactattccatggtatatatgtaccacattttctttaatctgttgatggacatctaggttgattccatgtctgctgttgtgagtagtgctgcaatgaacatgtgagtacatgtgtctttttggtagaacgatttgttttctttcggatatgtacccagtaatgagattgctgggtagaatggtagttctgagttctttgagaaatctccaaactgctttccacagtggctgaaataatatacattcctaccaacagtatataagcatttactttctctgcagcctcaccagcatctgttgtttgactttttaataacggccattgtgactggtgtgagatagtatctcgttgtgattttgatttgcatttccctgatagctttttcatatgatggttggcctcttgtgtgtcttgttttgagaagcgtctgttcatgtcttttgcccattttctaatggggttgttttttacttgttcaggtgtttaagttccttatagattctggatattagacctttgtcacatgcatagtttgcaagtattttctcccattttatgggttgtctgtttactttgttgatagtttcttttgctgtgcagaagctctttaattaggtcccacttgtcaatttttgttttcattacaattgctattggtgtctttctcaaggctgatgtctagaatggtgtttcctaggttttttcctaggattcttatagtttgaggtcttatatttaaatctttaatccatcttgagttaatttttgtatatgctgaaaggtggctatccagtttcattcttctgcatgtaggctagctagctatcccagcaccatttattgaataggagtcctttctctgttgcttgtttttgttgactttttcaatgatcacatggctgtaggtatgtggctttatttgtaggttctctattgtgtttcattgatccatttctgtttttgtacctgtatcatgatgttttggttactgtagtcttatagtatagtttcaagtcaagtcacgtgatgcctctggccttcttcattttgcttaggattactttggctattcaggctcttttttgattccatatgaattttagaatagtttcttctaattctgtgaaaaatggtgtcaatagtttggtaggaaaagcattgaatctgtagattgctttgggcagtatggccattttaatgatactgactcttccaatctatgagcatggaatgtttttccatttgtttgtgtcatctatgatttcttttagcaatgttttatagttctccttgtagagatctttcacctccttggttaaatgtattcctaggggtgtgcgtgtatctactgtaaacaggatcgtgttcttttcttttttcttttttttttttttgttgagacggagtctcgcactgtcgctcaggctggagtgcagtggtgtgatctcggctcactgtgagctctgcctcctgggttcctgccattctcctgcctcagcctcccgagtagctgggactacaggtgcccgccaacacgcccggctaattttttgtatttttagtagagatggggtctcactgtgttagccaggatggcctcgatctcctgacattgtgatccacccacctcggcctcccaaagtgctgggattacaggcatgagccactgcgctcggccttgtgttcctgatttgccactcagcttgaatgttattggtgtatagaaatggtactgatttttgtacattgattttgtatcctgaaacagatagtttgacttcttcttttcgtacttgtgtgctgcttttatttttttctcttgcttattgctctggcttgaactttcaatactatgttgaataggagtggtgagagtgggcatccttgtcttgttccatttctgaagaggaatgcctccagtttttgcctgttcagtacgacgttggctgtgagtttgtcatagatggctcttattatttcgatgtatgttcttttgatgcctagtgtcttgatggcctttattataaagggatgttggattttatcaaaagctttttccatatctattgagatgatgaatatggtttttgtctttaattctgcttatgtggtgaatcacacttattgatttgcatatgttgaaccaaccttgcatcccaggaatggagtatacttgatcatgttgaattaatttttgatgtgctattgaatttggtttgctagtatcgttttgaggatttctgcatctagaacatgtttatttgtaaaaggaaataggtaaatcttaagaagttgtatggtaattgcataaaattaagtgtggttgtgtaagtataatagattcaaggcattcattgttactgtttattacattctcataagaccttccctgtacccccaccacacctcaaacaacctcatttctggccagagagagaattgagtattttcacacatggtaaaagttaatccagaaaacattgcctttagtttcaaatactagtattttttaagtactatctttgcttattaaatgcagtgttgctgaggcatttaaaattttaaaacaacaggaaaaataaaaatctagtaacctataaagattgctgggtgcgtaatgtgaaaaaataactttttgttgatgtatattataaattagcttgattatactggccacttgtatcaaaactatttattaaagtagatttctgcttccatttggtaactttgggttaccaacatttcaccctaaaaggaagtttatggctgggtgcggtggctcatgcctgtaatcctagcactttgggaggccgaggctggcagatcatgaggtcaagagatcgagaccatcctggccaacatggtgaaaactgagtctctaattaaaatacaaaaattagctcgtgtggtggtatgtgcctgtagtcccagcttctcgggaggttgaggtaggagaatcgctcgaacctgggagttggaggttgcagtgagccgagattgcaccactgcactccagcctggtgacggagtgagatgccatctcaaaaaaaaaaaaaaagtttatttagaaaaataaagcaaatgtttctgtgtacaaggaaaattatttttaatatatacttgtgttaaatagctgaaaagatggctttggctcttagaaatattattctacatggactttatgaagagttaaaagtaacttttataacctctagttaagtcggctcttggtggtgctttagactggtgtttaaactcaagtcctttcctgtttctgtccttcagaacacagtactgtctgctttgcttgcagtatgtaattctgctggtgaagctttggatacaggaaaacaaactgcaattatcgaagttgtgagtcagctttgggcttttttaaacattaaacaggtaaggaaagcaactgatcctttccttatcaaaaaatagaaaatatcaaaaaaagaggattgtactgaaattttccagtgtagagtaaaatgtatctaattcttttgggtgcttggtagacctttataagaacttaaagtacctgtactctctcacgcagctttttcagagtgtgatagcattatattagtaaaatcagaatacgtaatgtgatggcagtccacctacttactttcctaactggttataccctttccccacctccccatctcttcccctattgtttctgttctgtcttaggttaatgtatcctatttctgtaattctaggacctttaataaatcttttgggcaatggagagtgagctgacttaaaggtggaaagggctagtgaatggatgtggctaatttgtatttctctttcccagcaaagccaaaaagccaagtgatgatctaaaactaatgatatgcatcccacacatggttgtacacgtgtttcttagtttgaaaatatagcctgtttgttttctttgactaagtagaaattaacattggcctctggcagctagaggaagctaaaggcaacagccatacttttgggaaatgatagatatgattttacagataatgttttattattgttttttatggtcagattgccctactgcagtgttttggcttcaacaaatacttttcctgatgttcacaaatcattcagtattcattcaggatatctgtgctggagatatagcttacaatattataatgtaaaccaaaattatgaagaagggaaatgaaattttaagattactaaggaacatacaagcctttcagtgatagacaagtaattagatcccttttagacttaaatttggatttcagtcacagctctgctttttgtcctagccatgtgatcttgaacaaattgtttaacctctttgaccctgttttcttatcagtaaagtgaaggtaataatatctacctcatagagctgttttgtaaggcataaatgaggtaataaatataaaatacttaacatattacctgatatataataaatgctcaataaaagcttgctattattattcttatgtgattgaaaatttttcttcaaaattactttgtgtttcttaggtagcagatcaaccttatgttcaacagacattcagccttttacttccactgttgggatttttcattcaaactctagatcctaaactgatacttcaggtaagaataatgaccagattgatactttgtttgctaaggaggttgctaaaactgctatcatgtaaaataactttctagaaatagttcctttaaacctcctcttgttgtgtcatatattgacttgtcttcatcaaggatatctcatttctctttcttccttacagtattgttaatatatggcgctgttaattcagcctttatctgttcttctctgtcaccctatactgagcagtcaatactttttgttattactgttaactacccactgcaaacccctgaggttaggagtcatagttcatgtgttgaaccctgcattcatagcagtttcaaaagcatttcagcagctgtgggaatgtggaatctaaccagtgtgtattaaaagatagcacctattgtttctttgaaaaaataaaattattttgaaagaagagcactgctgaatttcctctttggcctccaacttacatggctaggacaggcagagcctgggtcactgtctagggaacccttgtggtgcctcagctgtgcctttcttttggaagttctaagatgacagagaaagtggaaaagcccttcagctaaactgaagtgatttagaggctttggaatgagtccatactagacagaattgatgccccaaattaagagttagcttaagctcagggtcaggtaagaaagataaacaataactgttaagaggagaaactacccttcttatttatgaagatgatcgaagagatgattcctgtcacagtatgtggtggaacagaaaggaatgaaactagtaacagctttgcttttagtagctgtttttaatggtgtatgtatatgaagaagttagcaataacaagtatgtcctataccatatgtataacatggattttactaagttataaagagtcagaatacagtaattaactcattgaatgcaacaatttgattctgattctgaaagctctaatatttttagaaaaaatacaataattttgatataatgtgcctacctttaaaaaacccaaataaagttctaaaatttctaaataagtagattgttcaaagggtattgcttcctttataaaagatttcacctcaagattcttttaaattgggggtttgcagattatggccttctgtctaaattttgccctcctgttttcagcccaagagctaggcatgaattttaaaggtttgcaaaataaaaaataatatgtaacagagaacatgttgcctacaaagcctaaaatacttactatttggcctgttagagaaaaagcttaccagtccttgctaaataatgaacttctctcaatagaattttaaatacaggcataccacagagagattacaggttgtgttccagaccaccacaataaagtgagtgagtcacatgaattttttggcttcccagtgcatacagaagttatgtttacactatactgtaggttgtgtataatagcattatgtgtaaaaaatgtacataattaaaaaacactttattgctaaaaacactaatgatcatataagccttcagcaaaacataatctttttggtagtggagggtcttgcttcagtgtggatggctgctaacccatcaggatggtggttgctgaaggttagggtggctgtggcaatttcttaaaatacgacaatgaagtctgccacatcaattgactcttcccttcatgaaagatttctctgtagcatgtgatgctgtttgatggtattttacccacagtaaaacttctttcaaaattagagtcaatcttctcaaatcctgctagtgctttaataactcagtttatgtaatactctaaattctttgttttcatttcaacaatgttcacaccatcttctataccaggagtagttatgtgtcaagaaaccactttctttgctcattcatgagaagcaactcctcttcaagtttgatcatgagattgcagcaattcagtcacatcttcaggatctacttctagtttgctagctatttctaccacatctgcagttacttcctccacggtaggcttgaaccccccaaagtcatccatgagggatggaatcaacttctaattcctgttaatgttgatattttgacctcctccaaatgaatcatgaatgtttttcatggcatctgaaatgatgactccttcccagaaggtttccaatttactttgtccaggttcatcagaggaatcactatccatggcagctatagccttataaaacgtatttcttaaacagtaagacttgaaagtcacaattattccttgattgatgggctgcagaatgactgttgtattaacaaacatgaaaacaatattcatctccttatacgtctccttcagagcgcctggttgagcaggtgcattgtcaatgagcagtatattttgaaagaaatctttttttctgagcagtaggcctctcaatagtgggccaaaaaatattcagtaaacagtgatataaacaggtatgccatcatcctggctttgttgttccattgatagagtacatgcagagtagatttagcagaattcttaagggccttaggatttttttaatagtaagtgaacattggcttcaacttcagcagctgcattagcccccaagaagagagtctgtcctttgagctttgaagccaggcattgacttcacccctctagctatgaaaatcctaggtagcatcttcttccaatagaatggtgtttcctctacattaaaaatatattgtttaatgcaaccacttccatcagtgatcttagccagatcttctggataattgactgcagcttcttcatcagcacttgttgcttcaccttgtgcttttgtgttacggagattgcttcttaaacttcacgggtcaacctcattagcatcaaacatttcttctgcagctttttcagctctcagctttcacagaattggagagagggcctggctttggatttggctttggcttaaaggaatattgtggctggtttgatctatccagaccactaaaactttccacatcaacaataagactttccgtgttcattggaatagcatttttcatttccttcaagaacttttcctttgcattcacgacttggctaacttgcaaaagaggcctagcttttcacctctcttgacttttgacagcaccaggctgaattatctttagcttttgatttaaagtgagagatgagattatacttttcactcgaacacttaagaggccattttagggttaattttaatattgtgtctcagggaatagggaagcccaaggagagggggagagactggtgacctacctgttggtagaacagtcacaacacacaatttattatatttgccatcttataggggcacagtttgtggtgctccaaaacaatgacaatagtaacatcaaagatcacaaatcagcgtaataaaatcctaatgaacaagttgaaatattgcaggaattaccaatctgtgacagccatgaagtgaacacatgctgttgcagaaatggtacaggtagacttgttcagtacagagttgccacacaccttatatttctaaaaaaaaaaaaaaaaaaaaaaaaaaagcagtatcttcaaattgcaataaatcaaagcacaataaaatactgtttgtacaaaatatgttttaaaggtttggtatataaagtttttcagaaacatgtatacttttattttttacgtggttggaggcaggagggtgtggtaagaataatgctttaactgttaacttgttcataggattgtcttatttaaattctaccagtgaagttcaggggctgtggtgtgtttgtttttttctgggtttggttttgtttcccctccccacatttccatccaaatcttaggcagttattgtgtctgtacaaaatactggtattatttataactgttctttggtcttcacctctgtaggcagtaactttgcagacctcgctacttaaattagagcttcctgactatgttcgtttggcaatgttggattttgtatcttctttaggaaaactttttatacctgaagctatccaggtaatattgcttaactctgttcttgtattattaaaacaaaatctctataagagttagtgattaagggatttttaggctttttctgaaattttgcaattactgacaaagttggaaaaaaaaaactatgttccagacagattataaaatctatttataacttataatacaactcattttaagttcttttcttttagaaaaatatatgttgatacacaaataattagttggctgtagtctaccatattagattcttattccagttgggttctaatacatagttcctgtgtatttgtcttatagggaacagcatgtaattaggaaatttggtaatttattaaagttattctcttcgttttttatccatgaaagagaacctgtttttaaagacgatatttttgaaagtgttgcaaaatatgtatagctgacaaatagattatttataaaattatactgcactggcctggcaatacacatctactgaattttaaaacctcagtaaatgtatattaccaggccagtacataatttaaagaacttacagcaaagagatcttcataaattgagaattacgccttccttattactatagtcaaaatttagtaattctagtaattgacacttcaatctccaagggagagactataaagagttcactaatgagaactttcttacataattaaagcaaacacattatagacagtatctcagaacatgtagattaaactctttgaaaccaaaaatttaatttctaaggggctcttttatttgttcataagttaacagtatcccatctgtctccatcatgttaaggttttatttcatgagataagcatagaatgttgacagcttttcagctctcttgacaaaaatatccaaagacacttggcatctgagctgtcttctttttaccatgaaataaatctattccaaaatgctgcttcatttgtgaaccactatggactatgcacgggcctagaaattatgaaacaaatgttttataagcagaaatcgcagtgccttctgtattcccaggagtgaggtcaagacctgaagaaatttttgagattcatcagaacataggaggcatttaaagccatgaaatgagattgactgatttatccattcgggaaagattacgtttttgctgtacccagtgctgttttaatcattggcaatgcagtaatgaaccaaactaataaatccccactgttagcctgtttagaggcaataaacaataacaacatgatgatatgtgcagtatattaaatggtggtgagtgctatggagaaaaataaagcagggaaggaagatagggaatatgaatgtgggggtccaatttgaaatgggatatatagttagtgaagtcctcaccaaggtgacatgcaagtaaaaacctgaaatgcaaagcactggagatgggagcatgcctcatattcagggaagcaagtatagctaacacaaaggtagcaggactttgcaggtcatttgaggactttggctttcactaacaagggaaatagggagctactggaaggatttgagtaaaagagtgacattacctaatatgttttagtgtgtgtcccctgggacaggattatgttaacttgacaacactgggcttattgaatgtatggctattttatgattatctattatggtttcttttctctattataataaggcttggttcttttaggacagaattctgcccaacctgtcctgtatgtttgccttactgctagctgacaggagttggctgctagaacaacataccttggaggcgtttactcagttcgctgaggtaattataaaactgatttatcacagtgactttcaaaccattttaatatttcaaatattccagaacaatcccaaaacatttattgaactgcttctgtattgcaatcggaaaattgtctgaagggtacattactcgttatctcttttacagcttctcaaaatgaggcttagataaatgaagtgaatttcgtaaggtcctctgaataaacaaggaccagaacaggcatacacagcaggcctactgatacagacagacacagacacagtcttccagcagatagtatttttgggtcaaatgataatacatttcattttgtgctatcagtcataagggttaggctgatgaacctaaacctgtaagatgggttgctcctttactcttactgcatttgctgtatagtcatgcctatgatcataagggagtccagaagcattagtatgacccagcagaagtaattaaagcttacaacacttgtacagaagttaattttgtattatccttagggaccctgaaggaatcatgagtttatcacctttgaggatcctctgggactcttacttaaaatgaatttttggttaaggtagctcataaaactcatctatttgtctttgcaagttgttgaaatgttaaaattggtcttgttcatcaattttttaatagggaacaaatcatgaagagatagttccacagtgtctcagttctgaagaaactaagaacaaagttgtatcctttctggagaaggtactttctttacatggctcatgttttattctttgtcctatttttttttttccgaaattatgtaactgtaaccaacctgagtgtcttcttagcttaaacttttcacagtgctgagcacagtgctgacgacttttactaagcaattgaggccacagaagtaaaacacttggggccaggcgcggcggctcatgcctgtaatcccagcactttgggaggccaaggtgggtggatcatgaggtcaggagttcaagaccagcctggccaacatggggaaaccctgtttctactaaaaatacaaaaattagccgggcatggtggtacgcgcctgcagtcccagctactcgggaggctgaggcaggagaattgcttgaactggggaggtagagattgcagtaagccaagatcatgccactgcactccagcctgagcgacagagtgagactgtctcaaaaaaggacacttgtagttcctctgcctgtagtttggggtgtaatagcactgattatccaggcagtgagatgactaatgaggatccctaagctattaataatcataattaaatacacttgatcacataattaggtaggcctgagaggatgtttactaccatattttgggtataatttaggcatggcttttttttttttttttttttttttttatttgggcagcctcccaagccagggtaagctcagggcccttttttttttttttttttttttttttttggcatggcttttttattctctttgcagccaagacctgtttttacaattaaaaccaaaattttgaatcacaaggttcctatgtctatgcatacttgggaacttagtgtgaggaaataatagttaattgaaatactagtggaactgttaaaccacaaatttagactaccaggagaaactgaattatttgatatattacatgtaatgatgcacgttatatattttacatatattacatatatatttttttaggtgaaatgggcccacttgactcactgaactttattttttagacagagtctcgctctgtcgcccagattggagtgtggtggtgtgatcatagctcgctataacctcaaactcctgggctcaagcattcctcccaccaaagtcctgggattagaggcatgagccaccacacttggcctacttatattacatctaagctggattttaagtacatgtgtatacactgctgttgccagtttcttagcttatacagtaaaggttagcagactatcattttttcctgcaaagacaactctataactaactattttgtaaggaagaacacagtagagtgatttaatccagattatactaagagtatttatagatcagtccatgtgacttccagaatttgcctagtatggttgaacactcagcacttaaattatgtggccatttcatatctagtagagtgctaacatgttgctatttgcttggtttttcatggtccctggcagactgggtttgtagatgaaactgaagctgccaaagtggaacgtgtgaaacaggaaaaaggtattttctgggaaccctttgctaatgtgactgtagaagaagcaaagaggtcatctttacaggtatgggctgatttcaataggggccaaactttaacaaggcaaattctgccctttttacttactgacgaaacaaaccagtgtggtttccagccttatgctgaatttcaaatcaaatagatctagacatgtaaaattctgttttatggtagttgcttttaaaattaagaagtgggactacaccatatcaaatatattctttcagtatgtttgaattattggtagtaacctttaagggaagttacatattgtaccagtgatgctataaatgcagtctttactgaaccacagaagaaaatgaaagaaacttactcctaaatgtttagtttgattccttgccttattaatcaaatgagtctcctaataatttttggcagtaactgaagatcacatctacttattaaaaggcagaatttgacaccaataaggatattcaaaatattgttttgagcactattagtatagtaattagtatagtagtaattcatgaagaacaacattctgataagttttagtcaaactctcataaaaagaaaatacatttatgaacttgtttataagacatgtaagcttggactatgcagcacttctcattgggagccctttgggacaggatacttgttgtataccacatacaaactaagacactggtagtagcactctgaattgctatgataaaccaaaatgcctttacatatttttctagatgactgtgtaggggttttggggtgcatcctcctacccttgtgatccaatgactagaataaaatttgcatgtaagctttactccagtccaaaaggaaggttctttatatttagaatggatattgtgatattacttatgttttttttccagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagttgaatctagtgaaaataatctttatttgacatttagagaacaggattgtggggaatattcttattaagaactttggtacaatgtactacatgtggaacagtcaggaactgcctaggtccacaaagaaccatttactcagatagtctaactgtaaacaaataaataagctgcctaaggaaacctcagcaatttaaaatcatttatataatttatagctaaaattttttaaagttgtatttcataatagagcttactcttatgttaaagaatggcacaaaattaagctaaccagcttgaattacattttctttacttccagaattgtcctggaaaaagcagtaaattcgacctctcctcagctacttgctcttcatagaaactggcctcagtcaaatgcacaaaggctcttcctcctggaaaccagtactgtgagcctcaccacccagggcttttagccagcactcacagtcagtctcctacttcagttggcacagactggataatgagctcctgggatgggaaaagcaggccactttggggttttcttgtcccaaagcctgcttttgaggtattgattttttttaaaaaaagggaatcctttttcctaaagtttaactcacatctattgtcaccagttattatcttcccagttcagctccccttcttcttcccagccttcagcctctccctgcaacaaaataaagcacaccaagaacccactgaaacaaatcatatgcaaaaatcatacgcaaatttgaaaaagcaggaatttaaaatttatcttttgatgccagaaacactacctcgtactaagtaaaataacttagagctctaacagaaagttgaaaagtaggattacaaaaccatggcactggaaaatagcttttcaaaaaccataaaatccagtaaaaatcagtgtggatgacaccaaatccttattttaatcccttttttttctttttcaaataaaaaggttacaatagctcattaaacaaa

SEQ ID NO: 355 - DNA, 43237 bp, Homo sapiens
attcccgacactccttgcttttccaagtccagctgccggaagtcgctcgacttctacttccggtccgttcaaaaagcccgcgaggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccggtaaccgatgcggacggtaaagccgtttgggttagagcggcgcgggtgtccagtccgcggaacggggagatcgttggcaccttcgcttttttaggggaacggggatagttcggtaaactgaattgagaagcggatccgagggaggttgaaagctgtcaagcccgtgtagctctcccgctaggaggcggcacgcgggggaataggggcgctggagtttccccagctctacctcatctttctccacagccatggagccagagagggaagggaccgagagacaccccaggaaggtcagggaaagcaggcaggccccaaataagctggtcggggcagctgaggcgatgaaagccggttgggatctcgaggagagtcagcccgaggccaaggtgagcaacggggatcccgagcaggcggccctaggcggtttggagctcccggaccctcgcccaaccgccgtcgggggcactggattcgggcgggctctccgccctggcctctccgaacctgatccctgatcattaaaatgggaatgagtgtaataccaccttcctgcaacaaggctgtcattggctgtcactgggatagtgagtcggccgagtgcggtggctcatgcctgtaattccagcactttgggaggccgaggcgggcggatcacgaggtcaggagttcgagaccagccttgtcaacatggagaaatccccgtctctaccaaaaacacacacacaaaattagccaggcgtggtagtgggtgactgtaatcccacctacttgggaggctgaggcaggagaatcgctagaacccaggaaccagaggttgcaatgagccaagaccacgccattacactccaccctggacaacaagaaagaaatcacgtctcagaaaaaaaaaaaaaaaaaaaaaaactgggatggtgggccgggtgcagtggctcacgcctgtaatcccagcagtttgggaggccaaggcgggagcatcatttgaggccaggaattcaagaccagcctgggcaatatagcaaggaccccatctcttaaaaaaaaaaaacaaaaaacaaaacaaaaaaaaaactgcctgtacataataggaatgttcatcgatatcctggggcacaaaaatacaattccttgccctcgtgcagtttacattccagtagggcgggggtccccaaccccctgtgcacagactagtacctgcctgtccatggggtccccaacccactgtccacagctggcctgttaggaaccgggccacaaagcagcaggaggtgagcggtggccgatagaacgttaccccctgagctccacctaggcattagattctcataggaatgtgccaaacctattgtgagccctattgtgaactttgcatacgagggtcctaggtggcatgctgcttatgagactctaatgataaatgtaatgcacttgaatcaccccgaaaccatccccccagcccttctcccagtcagtggaaagattatctaacacgaaaccggtccctggtgccaacggttggggaccgctgcaataggggaataaaaaggctgattatccctatcatccttaccatttactgagaactaaatatacttcattcatcccttcagtcgttcattgggcttttttgtttgtttttgtgtttgagacagggtctctgctctgctggactcaggctggactacagtggtgtgacaaggatcctcctgtctctgcctcttacaggcatgagccactgcacccagctattcattggtttttattgtctgccatgtgctggggcactgacctaggtgcttggggtacatcagtgaatcaagttcactgccctagtaggtcttatattctagtgggcagagacaaatgataaaaataagttataatatgtgagagagggattagggatgtgatttttttttttttttttttttttgaggtggagtctccctctgttgcccaggctggatttggctcactgcaacttttgcctcccaggttgaagtgatcctcccacctcagttccaccaattagatgggactacagatgtgtgccactgtgccagctaatttttcttttttttgtagagacggggttttgccatgttgcccaggctggtcttgaactcctggacttaagcgatctgtccaccttggcctctgcaagttctgggattacaggcatgagccactgcttttttttgtttttttttcgtttgtttttttttaaagagagacagggtctccaactcctgggatcaggagattcacctgcctcagcctcccatagtgctggggattacatgtgtgagccactgcacccagctgaaaattttttttattaaagtgggattccagtttttttgcctatcaaatttgcaaaaaaatgtttaatgtttatgtggttagtgtaaggagattgacaatcacatattttgttatgttgaaacaatctcaaacttttagaaaagttgtaagaatagtatcaaaacctcccctcaaccaacatttgaaagtagttgctgacacaatggtctttttctacccaccctcaagatattttattatatattctctataaacctacataatcacaatgcaaccatcaaaattggaaattaccatggatatatcatgaccatctactcctcagatgccatccaaattttctgtagttgtttgaataacgctttttagcaataagatccagtctagaattgtgttaaatttaattgtcatgtctccatcaaacagttccttagtcttcccttgatattcatgactttactgcatttgaataatcctgggccaattattttgttgaatgtcccttaaattagatttgtctgtttcttcattgattagattcaggttatatacatctttagcaggaatatcacaggagtgatactctgctcccttgcagattgtacacaatttgatttgtcccattattggtgatattaaccttgataactagattaagatagtttctactaaagttctctaaagttatctttttctctgtgtaattttcattcttatttttttgagacaggatcttgctatattgcccaggctagtctggaattcctgggctaaagcaatcctcccacctcagcctcagtgtagctgaggttacaggcccaagccactgctcccagctgtctgtaatgtgcttcctcaaacactttgggcttatgcatttacttttttatcagtatgatgaactcagtggtacctattttgttcagtgtgttactatcttttactggattgtgatgctttaaatatccaagattttgtcattaagctagcttctgtggccttttgacatgacaacatcattctttgagcatgtcattactttctggcacaagaagatattccaggctcatatgtgctttccctgccccaagcctggaatcagtcatttctcttagggtacctggttctttttagtgtagaatgatatttagatttgggtgctatggtgatgttaatacagatgcttcttcacttaaaataagattacgtcccaataaatccatcgtaaattgaaaattttgtaagttgaaagtgtatacacacacacatacttacatttaaatatttttctgtattttacttatgtgaattcacatcagtatctccactttaatccaaatccagtaatacagggttcattctattcattctagttttctcctttttttttttcttttgagacaaaagtcttgccctgtcacccaggctggagtgcagtggcatgatctctgctcattgcaacctctccctcccagcgattctcctacctcagcctcctgagtagctgggattacaggcacccaccaccacgcctggctaatttttgtacatttagtggagatggcgtttgaccatgttggctggtctcaaattcatgacctcaagtgatctgcccacctcggcttcgcaaagtgttgggattacaggcgtgaaccaccgcgcccagtccattttcatatttgtaacttccttcactaacaatgagaaacccgacacccaacatcttcagtatatttgatcaatccttattgctgccgctgacccaccctcacaccctcttgactctgcttaggctctgtcaccctgcactggctccatcaccttgtaccaggtcatcttcctttgtgagcaccctcatcctatgacaggtggctgccaccatccctctcaggtttataccctcatcctgttcaggctttaaaccctgcaacaggccactactgtccctcagcattgatgccctccttaccctaaatagtttctgacatctgatgtcaggactcactgccctcccttccttcctgtatgggtgacgtccttgtgctgctgaggctttgacaccccacaccagagcaccctcctgcatgaatgtcctcagcttctgctcctagtcctggactgtctcctctacaggacaccttcctcacccaactcaggctcttgacatcccatgcctggcaaccagggttactcaccgccatatagactccatcttgctcagtctcaccttattaatctcatgtttttatttggtaaaaacaaactggcatattctttcaggagttcatttgaaccaggaattgatcctaagaaagtagatagatgtacaaaggtgtctgtacaaggatgttcatcataatgttgtttgtaatttaaaaaaccagtgttatcaatagggaatgtttttcagatatattataaattttcaggtaaatttagaaaatggactattattcaagtattaaaattgattttttttaactgatatggaaagatacagcttaagttcgggagtagggagttggtttcaaaaaagaatgattgataaaatccactgcgggctgtatagtatagagataagcctgcattccagtcttggttctatcatttatctgtctctccaatttatctgtaaaatggggatgatagtagtacacacttacaaagttgtgagaattaaatgatttaatgcatgtaaaatgatcagaactgtgtttcgctaatgtaagagtttaacattagcttaaggccatgggaatacattagcaataatatctaatgtttattaagtacttatgtcaggtactagcctcagtacattgtacttgaactatttcattggtcctcccaattatttaatgagataaaattataattactctctagatgaggaaactgagtcttagaaaggctatggcactggtccaagatgatgatgatggtccaaggctatggcactggtccaagcctggtgtttgaactcaggtagtatgactagggcttgagcttctaaccgctatgctctgctgcctcgcagaccaaaacgaaagtggtgattacctctaagttgtacttttattttaattatctctgaggtgacttttattttcgtttctctgtatcatttattttacaattctctgttaatgagtcttttgtaacaaacacgaattactttattaaacaaatataggctgggcgtggtgactataggccgggcgtggtggctcatgcttgtaatcccagcactttgggaggctgaggagagcagatcgcttgagctcaggagctcgagaccagcctgggcaacatggtaaaaactcatctctaccaaaaatacaaaaaaaattagccaggtgtggtggcatacatctgtggtcccagctactcaggacactgaggcaggaggatcgcttgagcctgggaggcagaggttgtagtgagcaaagatagcgccactgtactccatcctgggtgacagagtgagactctgtctcagaaaagaaaaaaacaagtataagttcaaagcctttttaaaggggttgggagctttgctgaactcttgttgcccaggggataaattctgattcattagcttaggccgcattgatctatgatctggctcctgcttccctctcctcatacctccactactatgcaacatgcaatcctggctccttgccaaaccatactacatgttgaatgcgatgttccctccaacatggcattgttttcaaggctcagcctcagtattttcatctcagtagccttccccaaactctctaacccctaaggcagttagactccttgttctcatagctttgtaatagcacttacccacactgtgttggaattagctattgctttctctccctagtagaatggactctttgagagcatgaattatgctttatttatcctattcctagcatgtaaccaagtatctataattcagttttgtgtcaatgataattactttattaataatgtcatacctaccacatattgttattttaggccatcattttcaattaattagcacttccttatgttagaatatacctgtatgttaaagtaatcagaagctagaataatttaacttgctttgttggtattcttgataaccaataatggcttgctacgccctgattaatctttgcagaaagcccgcttatctaccattttatttactgacaactgtgaagtaacccatgaccagctgtgtgaattgctgaagtatgcagttctgggcaaatccaatgttccaaaacccaggtatgagatgaatttaaatggtgggtattgaccagcggtttcttttttttttttttttttttacctctcccaagctccatcattcaaaccagaggtttcaaactggcttatcgacagtatttttttgctatgcagcatgtcctgaattttttatgatggctgccaagtgttaattctggaaattcctatataaaaatctacattttcttcttccaaaaactcaaagatggcagctatccctatattcccacatggcaataatttgtcaaagctgagtggtggtctccccctttatatgggacatgtatactacaatgtcctacctggcctgcttcccatatttacagtatctgtctggctactatagatattttagtttgtttcccgtgttgcagactcagctgaaataacaatgatctgtgaagaattccagttaatcttttttctttcttttacaaataaaaggcaaagagagccccggcatagtggctcacagttataatcccagcactttgggaggccaaggtgtgaggatcacttgagtcccagagtctgagaccagcctgggcaacatagcgagactcaggccctacaaaaaaaaaagagaatcttactgttctgatattgttggtgccattattaagtgtcttatgaaaaatattttgtatgtatgcaaataatacacacgtctttctgggggaggttgttatgaattggctagctacttcgagaactgtcttctccatcaacaattacagccatcagtctgtcagtttatctaaaactgtttttttttttttttggtaggttttatgtctctattgcaactacccaacttggccattgtagcccaaagcagccatacataacacatagacaaataagcatgactgtagttcaatagtcttatttacaaaaatgggtggagcaggatttgacatttttttggtgggggatggagcctcgctctgtcacctaggctggagtgcagtggcacgatctccgctcaatgcaacctccacctcccaggttcaagtgatcctcttgcctcagcctccagagtagctaggattgtaggctcatacaaccaggcccagctaatttttttgtattttttttagtagagatggggtttcgccatgttgcccaggttggtcttgaactcctgacctcaagtcatccacctgcctcggcctcccaaagtgctgggattacaggcgtgagtcaccgtgcccagcgaaaactgaatttcttaaagccagccatttgattccctggtttaggaaggaccgcagagtaggttggtatcttagggatgactttgtaaagtgagcttagttctgattccaaacaaaccttaataggactgtgaatttaaatgcattgcattttgcttggtattttactggatttgaatacaacaagtatttatctctagggatctttatttgaattctgtgcaataatggctgtcttccagttccaggcagacggtgaatggtgataaattctattaactctcactcactgcttttcctgcgccttctcccctatttcccctctatatgactgtaactgacttaaggccatctgtcttaactgtgttggtttgatttcttggcagctggtgccagctttttcatcaaaaccacctaaacaacgtagtggtttttgttctgcagggaatgagtcagctacacttttacaggttctatttggagtttggatgtcttcgaaaagcattcagacatgtaagttaagaatactttgtactaggggctgagtctgttttcccattctgagactaatacatgtgtcagggaccatgctccttggcaacctaactgaacaaacagtaggggatatagaaagcaaaaagaccttagaggcctcatgtagatttgtctctgattttctttggaaatctaggcaaactcttattcccaggttataatctgtagctcctaggttgatattgttctattttatttgggctatggtgttttcagaaattgtaaaatataatacaagctgagttttctacctctctttaaaaaaatcgcaagattgggcacccttaaaacagtatatggaactgaatagcagttgtcatctttaaaaagaggcacctgctgtccattttcccgtagcctcttccatttcctagtgacccatttcatccatttattcctgaaggcatttgagttggtgagccctaatttaacctccctgggtcaccattttttttgctttcatttattgagcacttcctgtgtatcaggctctctattaaccacggaccacctgctacacgtatcatctttaattatcacaatagtcttataaaatagatactttttaatttccattttgtacatgagaaactgagtaacttgcccgagttccagctagtaagtggtagggctgaaatttaagcccaggtgaacctgaagctgaagctctcaacctttttgccgtgtgataccatctattctgatggcaatggcatgctttccaatgaaataatagatttggaagaactttgaaaatacaaagggacttttcttgtctaagttgtatatttctgtaaagtttgtctattttacaatatataatcatagggatcagttagtgttgtgtggcttcatttacttagtcacttttctatattaaggaaacagttcttattttaaaatgctaacaattactgtctagaactttcaaagcactgaggtgacaataaaagtccaggcctttcacagtattttagctgttttcaaccatttttgtaaaacctgttaatatattttcagaaattccgcttgcctccaccatcatctgattttctagctgatgttgttgggctacaaactgaacaaagagctggagatctgcccaagacaatggaaggtatagctatgatgctggtttgatgctttgctcactctaaaagatacggatatgattgtaagtaggtttagcacaacaaaactcaattctaactagcttaagcacaaaaacaattttttttttttttgaaacgggggtctcactcttgtcacccaggtgtgagtgcagtggcgtgatcacacggctcactgcagccttgacctcccagactcaagcagtccttccacctcagcctcctgagtagctggggaactaccagcacaggccacatccccagctaattttgtttgtttgtttgtttgtttgttttgagaaacggggctccactgtgctgcccaggctggtctcaaactcctgagctcaagtgatcttcccaccttggcttcccaaagtgtggggattataggcatgagccaccatacctgggccacaaaaacagtttttttaaggaaaaatgggcaggtactcagggaagttagatagcaggaaccacagccagggttcatgtctcagaaacaatctggttagatagctaaggatacctgggtatcactgatgttggactcttatgaattactgtgaataatttctaaactgtcactgggtctttgtacccaccagtgtacaggtgggaaggaagatcttgcctttgactaatataagggatacctgctgatactactcacagtgaagaataggcaggaggtttagatactagccagctgaaagattcatgatagcagtgtgtttttcaaactgtgggttgtgtcctattggtaagttataagtaatctttttggttttgcaggaaggtgagtgatagagtagtataggacttatcagagttagttgcatatagtaaggttaggtattgttcaatgatactctattttgtgttcagaaataattaattgaataattgcactgagggaacatgaaaaagtagtgaggagtaacttgatttcttatctcctctagaaatgtgcttgcattatcctctgtcctaatccccacttctaattttctatctttctgttgttctcttcttctcatggatgcccatttttgatctgcaattgtatttgatttgatttgcactgtattttaaacatctgtgattaaatcacagagtaatcattatgagattctaggttcaagtaaaagcatcacgttgcaaaagaaaagatgtaatcaggaaaaagaaatctgacatgtttgaagagtacagcttgttggacatgctgagaagaataggaggaggtggtgatgagagacaaagctggaaaggcagattaaagccatatcctgcaggctttgtttttattttatgttttatttttatattctgtaccagccacggagagacaacctacaggctttgaatgtcatgccaaaagaatttggattttattctgtaggccttgaggagccagagaggttagggcaacttctccatcctcctaagtatttcacttcattttccagtgctaaatatcagagtccccaaggcatagtccctcgcactctgatcttcgttaatcagtctttccttcggagcattcatctgttcttgccaagtttacctattagttttctttgaatgactcctgtatctttatctctaggtctgatgccccagattgcaggcctgcattctcaactgcctgctgaatattccaattgctatttggatattctactgtcctcagtcataacatagctaaatgcgtttttctcatcctcaaataatggtctcttcatattccctcttgttggtgtcatttttctctaagacaccagtgttgaattttacagttttcttttggctccctatccccaaactgtctgcatgcctaattccctttgctcctataaatctctattcagatgtcaatttaacagagaccttctcagctcatcctatacaaaatatatgacagtaaccctttccctgccccaatatttcctatacttttctcctccttttcttcaaagcccttatcttacctgatatattacgtatttatttgtttattatccatatttccaactataagttaaatgtcatgaggaattttgttggttttgtgcattggggaattcctagtggccaaaacagtgccggctacataataaagttataaatatttaaatattttgctggctgaataattttttcaccatgttctaccagtttttcatgtatgttttatatatccctttttctccatagcttccactatcttaattcagatgctgtaacaacttctttttgaaacagagtctcgctctgtcgctgaggctggagtgcagtgggatgatcccagttcactgcaacctctgccacctgggttcaagcgatttttgtgcctctcagcctcctgagtagctgggactacaggcgtgcaccaccataccagctaatttttgtatttttagtaacgacagagtttcaccatgtttggccaggctggtattgaacgcttggcctcaagtgatccacctgcctcagcctcttaaaatgctgaaagtacaggcgtgagccactgcacttggccttttttcatcaacatttattttaagttcctgggtacatgtgcaggatgtgtaggtttgttacataggtaaatgtgtgctgtagtggtttactacacagatcagccaatcacctaggtattaagctcagcctccattaactattcttcctgatgctttacctccaccaacccctctgacaaccccaaatgtgtgttgtcatgtgtccatgtgttttcatcattcagctccctcttataagtgagaacatggtgttgtttggttttctgtttctgcatttgctgagaataatggcttccagttccatccatgtccctgcaaaggacatggtcttgttcctttttgtggctgcatagtattccatggtgtatatgtaccacatttttttttatctgatctatcatttatgggcatttgggttgataccatgtcttttccacctgcgcatatctttataatagaatgatttatattcctttagaatatacccagtaacatgattgctggctcaaatggtatttctgcccctagcagatgctcataattttttggccagaattattgtaaagccctttctagcctctttctacttcgctttctttctttcttcatttctttcctttcctttcctttcttttcctttcctttccttcctttcttttctttctttctttcctcctttttttttttttttttttaaatttaggctgggcgcagtggctcacacctataatcccagcactttgggaggctgaggcaggtggatcacctgaggtcgggagttggagaccagcctgaccaacatggagaaatcccatctctactaaaaatacaaaattagccgggcgtggtggtacatgcctgtaatcccagctactcaggaggctgaggcaggagaatcatctgaacctgggaggcagaggttacagtgagccgagatcgcgccattgcactccagcctgggcaacaagagcgaaactccgtctccaaaaaaaaaaaaaaatttagagtcaggatctccctctgttgcccaggctaaagtgcagtggtacaatctaagctcactgcagtctcaaactcctacattcaagcgatcctcctgcctcagcctcctgagtagctaagacttgcagttatgcactaccatgcctggctaatttttgtttttgtagagactgggtcttgctccgttgcctagggtggtctcaaactcctggactcaagcaatcctcttgccttggcctcccaaattgctgggattacaggcatgccatgcacccagcctctactccattttttacaaatctttgaggttgatgtttcttaaaacactgctttaattacatcacttccgttctcaggagctttttgtggctccccattacgtattgaatggtggacgaaagttaattatgctcctgtctcaactttgtttcctatgctcatctcttgcacagacctttctttcttcattactggtctactgacaaaccaagtttactctacatttctgtcttgcctggaatgtcctcttctacttatgatactttggctattttctttacaaggatcagctactcacttaggtcatcttgagcaaatattgtttgaagaaggatgtatgtgggtagaaagccagcaggaacctaagtgcccctagtaaaaagattttctccaaccctttcatagcatctacttatctgtgtattttcttttctcttctgactagtcagttctctctctttatatatatatatatatatatatatatatatatttttttttttttttttttttttttttttttttttttgagacagagcctcgctctgttgcccaggcaggagtgcagtggcacaatctctgctcactgcaacctctgcctcccgagttcaagcaattcttgtgccttagcctcctgaataggtggaattacaggtgcatgccactacacctggctaatttttgtgtttttagtagagatggggtttcaccatgttggccaggctggtcttgaactcctgacctcaagggttccacctacctcagcctcccaaagtgctggaattacaggtgtgagccactgtacctagcccagttctttatattttttagtgaaaatccttaaagcaggcggtctgatgaacttaactacttaagattttccctctgagaacatgtcttgataaggaatatcaagtcattggtcaatctatagatgatctctcttgagccaggtcatacccttaatccaatcagtaatggtccctggttaaagaacaagcttttgctgcttaaataggtggctgagggtggagtatatttagctagaatgaaccataagggagagacaggcactgtaaagaacaggttgaatataccaactatctgaattctgtcttttttttaagactcaatcttttcctttcttgatctctgacactctattgtgaagtatattcctcctcctatccctttactgttttagctcatttgggacttcattttctctgtgttttttttgtttgtttgttttgagacggagtctcgctctgctgcccaggctggagtgcagtggcgcgatctcggctcactgcaagctctgcctctcgggttcacgccattctgccacctcagcctcccaagtagctgggactacaggcacccaccaccacacccggctaattttgtttttgtatttttagtagagacagggtttcaccatgttagccaggatggatggtctcgatctcctgacctcgtgatctgcctgcctcagcctcccaaagtgctgggattacaggcgtgagccactgcaccctgcctttctgtgttcttataattgtaatagattgcaagcccctaaatggttggggctgagttttatacatcttttgatcttccttgtgcttagcctatacaaccttaggagacatttcttctagggttcttaaacacacattctaatatacgttcaattgtttttctttcagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttggcttaggcttactctgatattgctaacaatgtaagaatatctaacagcttatttaaatactactgtttgagattcatttatctggctgttttctgagtggcttattcttatttcatcttctattaatgaggaaatatcttcggcacagtgtatctcaaaagtgtgtgatgtctaccgtgattggcaaagtgatgattttaggtagtacatgaatgtgacattaaatagcattgaaataatatttaataagaaagttattccctttccttttcattcagttttctttcatttcttcttaatatattaaaaacagtcagtatgtctttaacattttaacacttttccagtacttctaattctcctcccacactgcccccatatttctttaacaaatagagcaggtctaggctcggagccttggtcaattatatagcaagaatttaataaaagtactttgatttcattttattttctttgttacctcctaattatagcaatgataattaaatttccttttttaaaaacagatataatttaacataccacacaattcacccacttaaagttacaattaagtattttttactatgttcacagagttgtacagccatcaccacaattttagaacacttctatcatcccaaaagaaaccctgtattataatttccctccaactccctgagcctttgacaaccgttaatctagtttctatatatagatttacccattctgggtatttcctgtaagtggatgtgcaatatgtgggctttgtgactggcttctttaacttagcataatgttctcaagcttcatccatgttgtagcatgtatcagtactacatttattttcactgcttaatgatactgcattggatagactgttcatcaggtgatggacatttgggttgtttccactttttagttaataatgctgctatgaatattcaggtccaagttttttgtgtgggcacatgctttcatttctgttgggtatatacctaggagtataattgctgggtcatgtgacaactctgtgtttaaccttttgaggaactgtcaggctgtgaaagctgccgtaccattttactttcccaccagcagcatatgaggtttccagttcctgcacattcttgccaacatttactattatcttgtctgaatatatccatcctagtgggtatgaagtggtgtctcattgtgattttgatttgcatgtttctgttggctgatgattttgagcaacttttcacatgcttattagtcatttgtatagcttcagagaactgtctattcagatcctttgtccatttttaaattgggctgtattttatcatggaattattggagttcttattttctggatgcataaattttatttttttaattttttaagttgatgtaggcgtgttttataggtgccaggcaccgtactaagtgcctttttgtacattaactggcagtcctatgatatatgaactaaattttaactccattttatacatggcttttttctctatttattttaacatatttataaccatctttttcttgaggttgcactactgtcacatgagcacgtagtaagggcagtactgctaacacctataaaacaccactgataatatagataaggtaggcagcaaatatagtgtctgtgagatttgaggctgcctttcttctctgggatagaccatcttttgattcttttcattgcgattagttggaaatttcacagtaccgggaatcagaaattggtcaaaggtttgcatagccccctttgttccgtgtcaaacaagatttagatgttacctttactgctccagcctctgcctgaaggtagaaatcttcaacaattcagatgcttttgggtttttgagctaaatatgcatggttatggactcagggttcacaaatagagggagtaccttaaatctatagctgagcctctgtaggaaatatgtgattccagaaaatgcaggcaaggctctgaataggtgtttcagaggaatctcacaggttgagttgggtggagggacacatatggtgaatgttacttaaactttcttcctactatgaaatccttttagatctccattatggtggaatctcattcctattttctcttcctgtatttaggaaagaaagatgccacatacagttatttgcatactttattcattctttcttagtgctgacatggaaagcgcctaatgactttgggtttagccatgatttagttatctcttttctcatgaggaggaaaaattgttacttggtaactgccaggaagttcaagccccagaatctcctcctaacagcaagcctacattattctttcaatataaaaatgagtagatggagaaaaacttgaggacagagattgtatcttatttagtcattgtatttcaagtgtctaacataccaacatatctgactaaaatatctagtattgtagttttacctgcttgaatctaagagtgatgtttaccatctctattctaaaggcaaacattttcttcctttttctcctaggttttcctgattgtgaaaactttttacttaccaaatgtaatggttctatagcagacaatagtcctctctttggacttgactgtgaaatggcacgtactacttttaatttttcaattggagtgttgcaagctgaggtctagtagaaaatgatttcttgagtctaatgcactaatgaacgaatacattcatttttagtattctgttttaatagctgaaagtaggtccttttactcacactttagaaaacttagatctgtattccaggataaagaataaatatcacataagtggctgggtgccgtggctcacacctgtaatcccagcactttgggaggctgaggcgggtggatcatgaggtcaggagatcaagaccatcctggccaacatggtgaaaccccatctctactaaaaatacaaaaaattagctgggcatggcagcatgcacctgtagtcccaggtactcgggaggctgaggcaggagaatcgcttgaacccagtaggcagaggttgcagtgagctgagatagcgccactgcactccagcctggcgacagagtgagactcgatctcaaaaaaaaaaaatcacgttttccaactagttactatgtttaatcaggtctttgcatgttgctagaagttgattccttgtgtttgaagaagtattttgttgttgctgccatgaggactttgccttaattgttggtttggcttagttttacaccttgaagatcagaaataggatttccctgcttaagttcccctcgtgctttgctttatctaattgtagtaagcctcttttcaaagacagtgcatcccctctcagtactcaggaaacagtttctcaattcttaatagagtaactaagacctaaaatttgagaatctgacatatcagggtgtatatcctgtccttgcctgttagtggctatgtcgccttagacaaatacccctaacctatcagcctcggcttctccctctgtgaagtgggggtaataataaagcctacctcaaaaggtaattatgagagtggcatatataaaattcttagtacagcactagctgataatagaatgggcttcataaaaattacctattagtggtatttagcataatactggatatagtacacactccataaatggtagatacaattattaatattatttgcattcatcttctttgtgcagactacactgtgttgatcctcttaagtgtaacattcagcagcctgcccagctttaatttcactcacactagatcctctagaaagcaagtttgtgccattgctgcagggaccctggtagattacagtagatggcagttgacatagtgtaaatagtaagaagaagcaataacttccacagttcagcagcctgactacatgttggtctttcagtgcctcacatccaaggggagagagctaacacgcatctcactggttgctgaaggaggctgctgtgttatggatgaactggtcaaacctgaaaacaagattctggactacctcaccaggtatttttcaccttgcctgcagctcttctaagagctatcgggctagaatggaataatacttaagaatggcccacagcttcagtttagttaggttttatctacttaaatattatcaaaggttagggcatcacataggtatattttaatgctgaaattgcacaatgtcagtgtataatgctcttgcccttcttgatcttcaatcttcttgtgaccttaagtcagcagaatattatcttccttgttccagaatctcccaattataatcattatctacaactgccaaacagctagagctttgctttctgataagacctcatctgaaaatctgcaagtcatcatttggcagtcaagtgatgttagagcttaatctgccttgacccccaaaacacaaacaaatatttttcataacagaaatttgaagctgaaaatgttagtctacttttccaaagattagcatgtaatctcagaatgtacacacagtgactaggcaagaagccagtgaaacattactgttcccatccgttgacgtggcaccagtagattcgtgatgacttagggacagagaggcaatgatagtgataaatactgtcctattagcagacttgacaattagattcttagagaacagtcacgtgtggcaaagttgtatgcacaagcatgtttgtcacagtattgcaaaaatgtgagtatataaatgtctgaaagtaggggattagttaaaatatgctgtatctgtataatggaatactctgtaaccatttaaaaggatgtgctaaatagatttattgatgtgcaaatgtgtttatgacatattataaatgatagattcattgtaaagcagctcatgcattatgattacatttttataaaaattaaatatatacctgaatctatatcaaaagtatggaacgacatttactaaaatgtaaaaaagcaatcatctctgggtgataggattatgactaatttttaattcttatttgtcactttggacactaagcatatatatattaacagtaattttaaaaaatgttatttttaaaatcactttccagagaggaaaacttgttaatatcctagcctgtccatttctctttttttaatgaaagcttttcgggaatcacgaagaagattcttaacccagtgacgaccaaactcaaagatgtacagaggcagttaaaagcactgcttcctcctgatgctgtgttagtgggccactccttagatttggatctcagagcactgaaagtgagtatctgatttaggactttgcattttcagtataaatgcctgttccatttatctcaaatctaaagtcttgggctcttctctcccaccctgctagcccacttgttttttcctttagcataagacactactcattttattctctttcttcctcagatgatacatccatatgttattgatacatcgttgctttatgtcagagagcagggcagaagatttaagctcaagttcttagccaaagttattttggggtaggtttgcttatatgctgtaatattgttctgacaaactgcatacaagttagcatgtagtatctaatttaatgcatattgcaaaattcagggtttctgctctctttgctttaaacatgtttttttgcatttcttatgaaatgaagaaattgtagcaatagagacaggggtttacattcacagtcgaggcttaatggacagaactgaaccatgaaggcagaagaggtaaccaaaatttcaaaacataacatacctatatgcctatacaaggtagtataacatacttatactgtcctattgtattaagacacatatgtacaaaggtgttcattataacatggtttaaaatagcaaaatagaaaacctcaaatattctagaagtctggttgagtaaattatggttatctgtattattgaatattttgttgttcagaagaatatgataaatctgtttgtgatatgaacacctctctaagacactcctgagaataagggatgcagagcaagatctatatatgcctcaatatttatatgatatagattagatttagttctatctataaatatatacatatattaagctttttaaaaacacctaagaaagtatttaagtatgtatagacacttatatacaaataaaaaagtttcaggaaggcaactttaaacaatggttagatctgagaaatgggcctggtccatttcttagagaagggcctggccagggagtcagccagaaactttttgttgggtagccttttgtccggatgctatgcttgctgtgaacaaagctattcctgattgttttgcacccccagttcctctcgcagggctgggcaattagctggaataaaggaaccttgatttttgtgatgcaaatctaattatcagaattctaacattttatatgtaatcagaacacttgagatggttgaaaaagcctatcattaaaagtgcttccagtatgtcaattttatattgactttccaggaaggatatacagtgtccagacagacttggtcatgatgccacagaagatgctagaacaatccttgaattggctcggtatttccttaagcatggcccaaaaaaggttagtatctttgcccagtgtgttcaccttttcttaaaatcatgggactagatcagattatcacagactaccaactcctattatctatttttatgaaaatggcagtgtgggccaggtgcagtggctcatgcctgtaatcccagcactttgggaggccagggtgggcagatcaccaggtcaggagttcgagaccagcctggccaatatggtgaaaccccgtctctactaaaaatacaaaaattagccaggtgtggtggcgcgtgcctgtagtcccagctactccagaggctgagacaggagaatcgcttgaaccagggaggcagaggttgcggggaggcagaggttgcagtgagccgagattgcaccactgcactccagcttaggtgacagagcaagacttcatctcaaaaaaaaaaaaaagaaaagaaaatggcagtgtgattgaatcctaaaaaaagaaaatggcagtgtgattgaagcctagcatgtatttcgaattaagacccatatcactagcataatgtggttaagtatatagtccctgcagttgggcttatctgttttaaaatatatgttctactatgtctagctgtataatctagggcaatttctctgaacaacatcagtttttggatctataatatgggaatacacacttttctgggatattgttgagagtaaatgagatattgtgtataaaattcttagcacagtgtcttgaatatactaagcactatcctggtggtgtggtgattattgtagttaatactaataattataaaaaatctgcatagatttttgttttcttggagtagggggagcatacaattgtttcaacagcagttcagtgggtaaatgttagaacaacacataagggagacatggaagaggacatagtctctgacaaactttattataatgcattctaacctattagattgtcccattgcatagtacattccatcatgactccattatgaaataaattgtactccacatagaataataagtaacagccagaatagtcttttgtgtcaggtggtagaaagacattctaacagatcttctttgagcatatagataataatagccaccactcactgaggtcttaagtgtactgttctaaaatgctgtatatacattatcttatttaatcctcacaacagccctgtgagttagctattatcattccaattttatacatgagcctttcgaggttaccaaaggttagataacttatctgaggtcccacagtcagtcagaggtggaaccagaattgaaacccaggtctgtcacattctgtcttttctgtataccagggattagcaaactttttctgtaaaggccaactagtaaatattgtaggctttgcagatcatattgtctttattgcagctactcaacttgctgtggtactgcaagagcagccatagacattatgtcaacactggtgggcacagctgaaataaaactttatttatttacaaaaaaatatgtattggtgtctgctaatctctgctctaaatcactacaataggttctaaaacccttttggtctcatgactctttttatattgttacccacacaatggtgtgttcagtcacttagtgggtgttaacccaatgaccactaccaaggaatatttatttttatttttattttttttgagacagagtctcactctgtttcccaggctggagtgcagtggtgcgatctctcttcactgcagcctctgcctccccggttcaagtgattctcctgcctcagcttcccgagcagctgggattacaggtgcctgccaccacaccttgctaattttttttttttttgtatttttattagagatggggtttcaccatgttggccaggctggtctcaaactcctaacctcaggtgatccacccatctcagcctcccaaagtgctgggattacaggcatgagtcactgtgcctggcccaagaggatttaacaaggggattttattactttgcaacaagtaagaacaccagggatagttcccaaagcactatctccccaaatgaaggcaaaagcagggcttttattttgctagtcggctgagtcattgcatgtaaaggcagggtttgttccttgacacatacatgtatagaaaatggagaataagttcctccctaggtgagatttttagtatggtaatgcagagagtttgccaagttcatctctaacttcaggcatctctggttccagctggtttttatcttgctgtagctggtggtcttcctgtacccttttgaaacaacaaggtgcaacaggggttacacttttatagtgtgcacctgaagacccagggactctgggttacaatatctatcaacatttaccatattagaaattaaataaatttttaatattagtttaagataaataaaaagccattatatgttaacacaaatcactttttttctttttctgttttttttttttttttttttttgagacggggtctcactgtgttgcctaagctggactggaactcctgggctcaagggatcctcctacttcagcctcctgagtagctggaacttaagcatatacagccactctgtccagctacaaataacttacttttatggaaaaaagaattttccataaaaattagtggaaagaacatcattgttttaggtatttttgtgaaaccttttaatatctagcttaatagaaaacaagtggcttttcatatctgctttcacattcagtctgttatgtcacatagttggagaaggaaggacctcaccccttgtgagaagatgtctggaaaccccaggattctcaaaccacacttggggcacttaattatgcttgatttccagtgaaaattgtgtctcacttggataaaaactaaccaaatctgaattaagcatgggcttaattaataataatgcattactattggttcattaattgtgacaaatgcaccatacaaatctattactaataggtaaaaatggaggtatgctatatgggaactctgtactattttcataatttttctgtaaatctaaactgattctaaaaaaaaagtttatttttaaaatttgtaactttaaaaattattctctctacatcacaactccctggtgggctcccactttacggaaggagaagaaataactagaatagacttct[450 bp omitted]gattgcagaactaaatctagaagcactagctaatcaccaagaaatacaagcagcaggccaagagcctaaaaacacagcagaagtacttcagcacccaaacacaaggtaatattttcagtttgaaacaagagcaaagacaaatggagtatctagtttcttatttaacaacacctgagaatgtttttatcctcttttgagtctattaaaaactatttaccaaaaaatgataacatctatcacaaaaaccacggaaaaaataccaccttctagccttaatatatagtatttaatttctaattttctgaatctagtggctggtctaaaatgatatccttgatcaaaaaaaaaaaaaagaaaaaataattggaatacgttgaacctaggtagcactgggaaagatgatagactagttggtattttggctagaagagtcaatctgtagccttgttgtattgcccagactatgaaagacacacacacagactcaaaagggctttgtctccagactatagcaaatgtatcagatctttagaattttgcctaatcttttgatagagagctttgggtatatttcttgtttatccttcctctctctattgaagcaacactgtccaaaacaattttctgtgatgatggaagtgctctacatctgtgctatctcgtttggtagctgctagtcacatttgactagtgcagttgaggaactgaatttttaattttatttaattttaattttaatagctatatattgctagtggctaccatattgtataatgcaagtatagagaaataactgtcaggttctggaaaactgttgttcttaccttaactcttctacttctttatagtgttttagaatgcttggattcagtgggtcagaagcttctttttttgacccgggagacagatgctggtgaacttccatcttccagaaattgtcaaactattaagtgtctttcaaataaagaggtgagtggcctgctgaacctttgcaggttatattcaaagcagaggggaatgtagccctttgcacccatgccagtgtcaagctttttttcatcagcaaccctggctacagttagcaagcctggcttgtgtctcacatcttgtatggagtacctaagtcctcataggggcagaactgtcagctgccaatgcctgcttccagagcccagcaggcctctggctttggtcttgcatacatctttgagtttctgttgtgtttctggttcatggaaacgtttatcttggttttgagcctggctatatcctttcgattttttctttttatattttatgtatcattgctgtatgttaagtcagagaggctacatcaaacatgagcttattatgttatcatattcagaagatctgtgtttgtttttttttaacattttgtttgtaaataatttcaaccttacagaaagcgtgcatgaatggtagaacacctgtatactttctgtctagattcaccttttttagcactctgccccagttgctttattattttatatgtaccctcatgcttatgctctctcatgtacacactctctctttcttcctctctgtatggcatttcctgaaccatttgagagtaagctgcatatatcatggccctaaacacttcagagtgtatttcatgagaataaaaatattattttatataaccacatcttaacatagttaccaattttagtaaatctaatattgtcctggtacctttatctacttgtcatctgtattctaattttcttggctgaccaaataatgtctttatagcatgtcttttccctttagaacagtatcatttctagggtcatgtattacaattacttgtcatatctttttagtctcctttaaagctgtaacagttcctcaacctttctttgtctttcataaccttaatactttttgagtaatgcatgcccccctccctttcttagcagagttgcttattttaggtttgtgtggtgtttgctcatgattaaattcagattatgcattcttagccaaatttcttggggtgttgcatccagaggcagttattactcatctgcccctcttttgtgctgtttattttgatcacctggtcaaggtgttgtctgctttctctattgcagagttcttgttttttctcttaattctaataaatatgtggggagatattttaagaacatgccagtatcgcttgagcgcaggaggttgaggctgcagtgaactatgatcgcaccactacactccagcctgggattacaggtgtgagccaccaggctcggccaagtgttcttttttatgcgtcttttgcttgagcttgttgagcttttgcaatttgcgggtttatcatttttatcaaattagaaaaaatgttgaccattatttctccccattattttttctttcaccaccctcccctcctttgggcactcccattgcatatgtattaggccgtttaaagttgtcccatagctcactgatgtgctgttcatgttttttccagttttttttcctgtctgttttattttagattgtttccgttgctatgtcttaggtttctaattctgctgcagtatctaatctactgataatccaatccagtgtactttcacctcacacattgtattttttacctctagaagttaacttttgttctattttgtatcttccatgtgtctagttaacattcagactttcctctagcttcttaaatttcagaatatagttacaataactattttaacatccttctctattaatttgataatctgtgtcatttttagattaactgaaattgattggtttttctccttattatggactatattcattcttctttgcagcctggtagtttttgtattggatgccagacatagtgaattttaatttgttgggtgctatatatttttgtatttctataaatatttgtgagctttggtctgagatgtggtaaagttacttggaaacactttggtccttttggatcttctttctttctttccttccttcttttcttatctttcttttcttttctttcttatgttgcctaggctgatctcaaactcctggcctcaagtaatctgcccacttcagcattccaaagtgctgggattacaggggtgagccactatgcctggccagatccttttgaattcttgcttttaaggtttgttaggtgaaaccagagtaaattttgtcccactactgaagcaaaaccatactaagtacttaatctccataaattatgagattttacactctagcttttgggaatctaaaccattcctggccttgtgttagcccttgcgattgtttcctctaatccttttgggcatcctttccttgacctcgcatagtttacttacatggatacactaatccctactcaactgaatatttgagggggattatttatagatctatcggtttcctatctttaaggatcactgtccttcattttccaatatcccgagaactgctgttcttaggaattttttttttcttcctgagcacttacatgggcctcaagggctctttgggcattattattgttattttaatagacttttatttttagagcagttttaggttcacaacaatattaaatggaaagtctaagctgggtgcagtagtttacacctgtaatctcaggactttgggaggctgaggtaggtggatctcttgagtccaggagtttgagactgacctgggcaacatggcgaaacactgtcgctacaaaaaattagccaggcctggtagcacatgcctgtggtcccagctgctcaggaggctgagatgggaggattgcttgagcccaggaggtggaggttgcagtgactgacgtatgatcgcactactgcactccagcctggcaacagagaccctgtctcaaaaaaaagaaagtacagagagttcccatttacccccacacccacccacacaaacaacttccaccattatcaacaacctgtacctgggtagtacatttgttaaaatcaatgaacccactatgacatataattaccaaagtccatagtttacgttagggttctgtcttggtgttgacaaatgtatagtgacatatatctaccattatagtatcatacagaatagtttcattggcctaaaaatctgtgatgaatgtgctctgcctgttggaaaccactgattttttttttactgtctccataattttgcctgttttagaaagtcacatagttggaatcatatagtatatagctttttcagactggcttctttaacttagtatatgtatttaagttttctccatgtcttttcactgctttatagttttttttcctttttaacactgaataactatacattacctagatttaccacaatttatccattcacctgctgatagacatcttggctgcttccaagttttggcaattatggacaaagttgctataaatgtctgtgtgcaggttttcatgtgtacataagtttcaaacacatttgggcaaataccaaagagtacaatttctagattgtatagtaagaatatgtttagtcttgtaagaaactgctgaacttctgaagtgtctatgattttgcattcccaccagcagtgaatgagagttcctgttgctccacattcttttcagcatttgatggtgtcagtgttttgttggattttggctattctgatggatatgtattagtatctcattgttttaatttgcagtcccctaatgacatgtaatgtgaagcatcttttcatatgcttatttgctatatgtatctcttctttggtgaagtgtctgttcaactcttttgcccatttttaaaattggattgttcattttcttattggtgagttttaatagttctttgtatatttgggtaagagtcctttaacagataagtcttttgcaaatattttctcccagtctggcttgtcttctcattctctttatcgtatattttttatagtttcttaggtgtttgaggagagagggtaactctactctttgttattcagtcttgactggggatggaaatccttgtaagttgcatttgagaaacttaatggcaatctaattttcttggccttttaagttacttttactgaggatttatttttcccgttttgtttaaagtctaattgttttactaagctatgtctcagagttgatcattccaagtcactttttattggtacccaaggcccctttcaatatttaggttatagtttcttttatttccagaaggttttcttggattgtattttcaagtatttggttccattgctttaattttcttcctcatggacttcacttatgcatatatgttgttccccgctggcctatctttcattcacctactttctctctgatccttttgatttcatttgtatactcctaattctttccatgcttttcattaatgccctttattaaaatttcacttgaatctattctttcttgacaacttgtagttgctttttcatatcctcaaatgcttggctgctaatattcaattcagtttagaccgtaatgttaactgtatcctttagccccatggttgatttttttttttagggggaataattttcatcagctgaaatgcttcgattctcactttatgtcttggcttttgtttttgtttttgagacagggtcttgctctattgcccaggctggagtgcagtggcgtgagcagagctcactgcagccttgacctccgggctcaagcgatcctcctgcctcagccacccaagtagctgggactacaggcatgtgccaccatgcctggctaatttttaaattttttatacagatgaggtctcattatgttgcccaggctcgtctcaaaactcctgagctcaaaatatcttcccaccttggcttcccaaagtgccaggatcacaagcatgagccaccgcgcccagctgttgctgtttttttaatagtagtttagattaatatggtctactattttctaattttactgatttgtttttgaacaaggttttcattcaagagcatctcttttattctgccttcctcagtgcagttttttcttctttttttgtgcttttcctctacttatcaagggattctctctccctttcctctcctgcctctcttcttattgtagtaaaaaacataaaatttaccatcttaactgtttttatgtacatagttcagtaatgttaggtatatttatattattgtgaaagagatcttataacttttttattttgcagaagtgaaacttgggctatgtttctttgtatgccttgtgacttattgttgttggtattgttgaggcttgggcatttgaataaatacccagttgttgtctttacagactgcttcgtgcaggggaagaccttcaccaatcagcctagttagagatttcatgacctcccaaacctgttctggagatttgtcttctctggggttatgcatgtgcctttagttgttccctgagccccttgtccctacttcttttcagagcccataatctctttcttcccctggtttcttactgcagctctaacatgccatggtgatcacatctgttttcagtggcttccaaacaaggccttcttcagtcctgtcagccttccgagtcacgcaaaacagaaaatagtccctcagacagcccccacagtacccagaacattggacacatggtcccctcttttttttccatcccaagagaagatctgtggtgtggaagaagccatattatgtcagatagggagaggtgtagatgggaccacaaaacatcacaaattttcctttcccatttactggaaacccttcttggtttcatgctggtctaggtgctatatagtttctcatggaatctctacagttctctcaaaggtgttctggtccgtatattgttgttaactcattgtttctgtgagagtgagaggctgaagtgaagcttcctagttctccatttccagaatgatggtgtggtgttgagggaagggaggaatttataatattgttcagaagagttggcattcttcacagcagtgtctccaaggagtaccaccttttctctatatatctgattcttctccagaagcatggcttctctgaggctgccaagcctcttgcttgtagtcaagtgctgagaactgtcaaaatcatgacccatgttccttatttgacatttaattggagtttttattttggggtttttttatgcttcatctaattcttccatgccccttgatttttttttttttaaccaaatctattaagcctcctctcccttgctttccctactcacaggcttgcagcagtttacaatagtgggagttacacttatttatttaattacaggtcatttgaaaatttttgtaatagcccttgtctcttagtaatgccgaaggtatggctcatatgtattttatttttattctttttattgattctgtggttctttggggaaggtgtgtggtttcaccattttcctgcagacctggaagtcagccccatattacctttcagtatgcgtaaaaagacaactactgtttatattattgtggctcatatccaggagccacaatagagtatgaggttcctaccttatccaggctgtgctgttctctacaggttcttgagcaggccagagtggaaatccccctgtttcccttcagcattgttcagttctcttttaaggccttttcacctgtcctcactgaggagatgaacaaaagggtaagtgaatgggttctgctgaatgatttatttagtgacttattataacctctcatcattaaggaaagtaatacatgctttatttaatttgttgtgtttttctctagatttttactatctgcatattaacatttaaaaatatttttatgaaaatgggaatcagactatgcatactgttttgcaactttattttttcatttaacagtatatcatacatctttctgtatcactacatatcttatttcccttgtttttaatggctacatagtattctgctatatgatatacctattaacatttgtgctttatacatttttgctattacaaataatacttcagtgaacatccttggacatttggcaagtatttatatcaaaaaaatctttggtgaataatcccatgcattgactcatgatttcagttctctttccatattcattcccatactatattctgttgtttttcctacagatgaggatcaagtggacagagatatcaactgtctatgctgggccatttagcaaaaattgcaatctcagggctctgaagaggctgtttaaaagctttggcccagtccagtcaatgacttttgttcttgaaacccgtcaggtaagaccggaaaattcagatttcattttctagattagtgttagacattcaggtgactgcttgggccatgcagatagcaaatattcgtaaagtaagcttgattgctaccaactggagtgtgagacatactctaatgagagcagttgttgacccacaagaatgtatacccagtattgtgagatcttttgttgtgtgtgtttaaagaattgagaaatctggctgggcgcagtggcctatacctgtaatcccagcactttgggagtttgaggagggaggattgcttgagcccaggagttcaagaccagcctgggctcaagcaatgtgagaccacattgctacaaacaatttaaaaacaagaattaagaaatctgtcagttttcatatgttggctcccatttctcaaataccaggccatacgaaaaaatatgtctgctggttgaatataacctgtggtccttatgattgtacctcagctttaaatgataaaatactctttcaaaaagagaagtaactttcatatcttagaaagttacttctttttttacattacagagtaggctcatggcttgcttggttaagatacaggaggaagattatgggagggcttttgttgttattgttatctcttatctcttagggtaagtttttggtattgtaggtttgtatttacataaaagccctttaaagagattagttttactttaacaaaaataatacttgcatatggttttaaaaatttatgtagttcaaaaggacttcacaagttatgtctccatcttcacagtcataacaataccatatcaatagataaagtttatatgtgaagcaataacatcataagcatatagagacatggaagaaatcatgaaaagaaaaatggaaacagtgtaatgtaggatgtttgtagaatgatatacaataaaggtaacaatggaggcctctagggggaagaattaggcagctagctaatgggattaggggaagacttcactgtaaatatattgttcctttagaattcggaactaggtaactattaaactggtgtattacaatgtatgaaagtgaagtaaaaacacttctaaagtgatctaagtgcaggatcctagatattttaaaatggctgtctctaaattttttaatttaatttttattttatttttatttttgagacagaggcccaggctgcagtgcagtggtgccatcttggctcaccacagcctctgcctccccagttcaaatgatttctcatgcctcagcctcccaagtagctgagacgacaggtatgtgcccccacgcctggctaatttttgtatttttagtagagactgggtttcaccatattggccaggctggtcgcgaactcctgacctcaagtgatccacctcccaaagtgctgggattacaggcatgagccactgcacccagcttccaaatcttttattaatggcttttctatgactaaaaataaaaatacaaagattgtccctgagaagatggattgggggatgagaagtgtatagcaagggactataacatcttcctttctcttggcccctttttttggttgcgggggtggcgggtaaaatacatataaaataaaatgtacctttttaaccatttttaagtggcattcagtatgttgatattgtgcagctatcatcaccatccatctctagaactttttcatcatcccgaactgaaatttcctattaagcaataatttcctattacccctccccccagcccctggtaatcattgttttactttctgtctttatgaatttgactactctgtgtacgtacctcacataagtggaatcatacaatatttgtccttttgtgtctggtttatttcatttagcatgtcttcaaggttcattcatgttgtagcatgtattagaatttcattttcaaggcaaaataatattccatttcatgtatataccacattttgtttatccatttgttgatggacatttgggttgtttcttgtttctaccctttgttttgtttgttttttttttttttgagatagggtcttgctcacccaggctggagttcagtggcgtgatcacaactaactacagcctcaacctcctgggctcgagcaatcctcccacctcagcctcctgctgggaccacaggcatgcacgcctggctaattttttgtaagacagggtctctctatgttgcccaggctgatcttgaactcctggactcaagagatccacccaccttggcctcccaaagttcttggattacaggcgtgagccactgtgcctgaccctgggttgtttctacctttgactatcatgaataatgctgctatgaacatggttgtacacatatctgttcaagtccctgctttcagttcttctgggtgtatacccagaagtggaattgatggatcaaatagtaattctatgtttaattttttgaggaaccattatactgttttccacagtggctataccattttacattcctaccagcaaagaacaaaggttccaacttatctacatcttcactgacacttgttttctattttatttaatagtagccatcctaatggatgtgaaatggtatctcatttgggtttgatttgcgtttccctaatgattagtgatgttgagtgtcgcaggcaatttgtacatcttttacagcaaagtctattcacttgtttgccctttttttcttatttatttttttcagttccagctactctgcagtgtttgcccatttttaaatcaggttgtttggcttttttattgttgaattgtaggatttctctgtacattctggatattaatcttttattagctatgtgattgcaactatttctccattctgtgggttgctttttgacactgctgttagtgtcctttgatatacaaaaggttttaatttttatgaagtctaatttgtctatttttaattttgttgcctgcctttgatgtcatattcaagaaaccattgccaaatccagtgtcatgaaacttttctatgggaaggcttttatctccatattgatgctatggctcagataatcacaaagatttagttactccgagttaacaaacagaaaagcagaccatttgaagatgtagcctatccagtggaagaacttatccttcccaagcttataaagttaagccaaaagacaaatgggaatctctgcccgtgacttgcagtgatgactttagtgatgcataataaatattatgaaaagcctgttgggtagttccattttaaatgacaaagttatttgttgtctgaaagctagtttctgaactttgatgatcccatttaaagttgacagtttacaatcaatacttgtgtagcccagcacagtaaaggcatccattctggtggctttggccactgtagtttgaatcctttccccaaccccttctttagcagtttgagctggaaagcaatgatgaggaaatcttggtctttctgcagcctcatctctgtatacagtatgaagtcctagaagctgcccagctggccatagaatccttggatggtattctggtagatggtatctgcatcaaggtagggtgacaagagaaagccccctttgcttgggtctggcctaccacagcctgtatttatagtgccccaggacatataggaaacactctcaagaggcccacgcacaagactttgttatggaaagtcttcagccaagtctaacattctcctactggcagtgattgaagacataacggctttcatttgtgtcagaaatcatcctgggctagatttgggtcttccttgcattctttgttactacttaagtcccctgtggtttattctggttggttctttgtggttacccttttcttcacctttcagggagatcaaatggtggtattttgaagtttcttgtgcacataaacagaatttcattaagggtgggaggcaggaaactgaagagaatatgtttacatgaaaatatgtatttatcaattaagtctctaacataattctgtgaggccattatctttagtttccttttacagaaaagaaaagaaacggaaaattttaggaaactgaaaaatgaagttattagtaatggcaacaacttgctagtatccaataggcctgaggattaaattgattttctaccactaacaccaactttccttggttaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgagtaagtctatgctactgaatgtagctttggggaaggaaactggggatggtgataacatgaggtcagagaaaggaagattcacctcctgggctggaccagggcagcagttcctgattctgtccttctcctttgaccctggccaggcagcttggatggtgatcagctttcttggcccttaataacataaggtgggggttcttgctttcagaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcaggtgagtgagtgaaggcgtcttggagaagatgtcaggagagtcctgctcagtgacacttaatcctttaatcttttttttttttctaccctggccctcagtcttatttcactctccagcttcctccagtcctggccacatcttttctcgcagatctctcatacttttgcccccaccatacctgctaaacttagttttttagtcttccagatctccaagggactttgaaggacaaaggcaggaagtcagagagctggacaattattcagtgatctagtctagggtttcccaaagtgtggtatatacacaagataaattgtggttgtcatagatggtcttttcttttttgttttcacttttatgattatggacttgtccgtctttttattatatctaagacatctgaatggacttgttttgctaatacttgttaaagtatacaataactacattgagcctatgattttgtggatggcattagttagacaaggctaaggaagaaattaactcactttatggaaaaatgttagagggatatacaagcagaagagtggaggtagaaggtaaatggctgaagcttgggaaaccctgtcttagtctaatctctcatacttaacagatgaaaagtaggggctagagttggtaagtcacttgcccaaggtcacaaagagacttaatggcagaagccagactagacccctcatcagcaatgtggctcccctagcttggggtcttggaagacccatgtggaggaaaggacagtagctgtcctcccctgaggaagtccttagccaacttggaggcctggggatgctgggtcagcagagaacctgcagtgtgggctccagtgttagaaaagggatttgtctggaacctttactggaatcccatagccttagaggcagaggaagagtgttgcagcccttccaaaggtaacgagagagtgttctggctgagtatcgacacatggctttgatcccagactctgaaactggaccacccgaagatagcagcctggcgctggagccggaagattggaaagctctacaacagcttgtgcccgggcactctctgcctcatcctgctgccaggaaccaagaggtaaggactagaaagggtatcccttcaggactctgtcccctggatttcagctgttcttagagaaaaagccttttgctgatatttaggcacatagtgaggacttacatgaatcatctctttaattttcaccgttctaaaagataggcattgtattcccatttcacatttatatgctcttgtataactacatttattggtccctcaaggagataatttatccccagttaaaaccaggagtcttatgtccttactgctctctggagtaagaagtagctgctaaccccacttgagtaaaaaaagtaaagtctcagaacaagccctaggcttaggtgtaaccactctacatgtgaggaatgtgttcctgccttctgtacccttttccccattgacacctatgttttaagagataacagggcctggtttgctgattctaagcctgaggaatactggagcaggactttgagtctagttgcagctttatcacctatctcctctgacaagtggccaagctacttccccactgtaggtctcaatgtccttttagtaacatgagggatttggaataaatcagttgattttcaaacccttttaactgtaaaccctttctttaaagaaaaactgatattaaatcttaaagcataaagatgggcagttttggaatgagtgagtgggcagctaaatgaatgagtgtatattggggaagggagggaaagatggtggcttttttgaacagtgtgaaaaccttgggttgtgttaatttttaaaagtcccttgagattctgacatctggttaggcgcagtggctcatgcctataatcctagcactttagaaggccaaggtgagcggagcacttgagctcaggagttcaagaccagactaggcaacatgacaagaccctgtctctaccaaaaacacacacacaaaaaaaaaaacaaaaaaaaaaaacccagccaggtttggtgttgtgtgcctgtggtcccaactacttgggaggctgaggcacgagaatcacttgaacccagggggcagaggttgcagtgagctgagattgcaccactgcactccagcctgggctacagagtaagactcttatctcaaaaaaaaaaaaaaaaaaagattcttacattctaggagttgacagagcatgaatacctctggccttgaaggtggatcagaagaaattcatttcctagcataaagttcttataacatgcatctgaggaccattagggagatggtctacctactgggcacctttgaaagaaccgctttctctgaaaagcagaaacaagtattaggtgcttacattgaggggaaaaaaaatcttagaccaacatactttaaacaggcttgtgggtaagctaacaggaacaggttaaaaagtgaccacaagttgccagtaaaagctttttggttaagatgtgggctctggggaacagacagacttgctcctcaggggcagtgtatggtggtaggtggactgggttttcatgttctcacgtagaatacttagattacagtccaccattgtttaggtaaactaagtcaagagtagcccaaatcattgttcttcctggatgttccacagagggtgaagccagaggaggaagtgctggggtcagggagcaaaaacacttaagttgtgactgagacaaaggtcctaagtttgacaagtcagtagaattaagcaccccctggaagcagcaaatcctgtggtgaagaaacctgaactactcctatcctttaaaagtcacattctgatttctgtagacatattgatcaaactcagcagcagtagcatgcatttccccaggctgtggaagcttgctgtgtgactgacttctctgggccttgtttgtgcagttgtgtccgtgatggcagcagatactcttgggaaacgttggggaaaaaaggaatagcaaaaacaatagaaggtttccttaggctggggtcttgatgcagctcttaatccttacatttttggtagcttcttaaattaatattgaaaacaacagtaatgtattaaacccaggtactgtgctaaatgcttctatatgcatttttggttgaggttgtcagaatctttactgaacaagtggagaaaaagtctcagattaaccaattttcctagggtcacatagctagtaagtgcatagtcaggacttgtaccctgatggtgtgtctgactccagagcaactctcctgccctcaaagctctagttctccatacacaaaagtctagtgtttgcatgtttaagttcatacatcaggtggagacagattctgtgtttgtctttgctcatttctacctgctttgcctcagagagctcctcaacgctgacccagttccatgaatattcattacaaggtggcagggaactaacaagtattgaaggctcctaaattccaagcaccacaccaggttttttacaacaaacattgttaaataagttaatgttttgtaacttttttaaacagcctctggcacctagcaggtgctacaaaagtatggaatgaacaaagactaagactctttaacagcaacttataagggatctaatgacagattgctattattgatatcctggttctgtcacttaacagttgtgtgacttcagcaagtcatataatgtctatgagcttttttattttttaaatgaggataacacttgtacctacatcagtgagcagttttgaggattaaatgagacaagtgcttagaacaactcttggcatgtagtaagtgctcagtgtatgtttgctattgtcgatagtcttcaccaaatccctgtgagatagtaatttaaatatttcatagttttatagatatgcctcatatctcttaattggtaaaggtaggatttgaatctagacctctgagactcatcagtgctttttccattaaaccatcttcagcaggcagctttccataaaccttcctgcccttgccccatggcacacacacatacttggaaaaatatctcctctaactaggcatttataaccattcattcaaccttatggataaaaacatacctttgtttcttatttattgcagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagctttatggaaacttggtatagcagctaaaagagtttagtttgtttatatggcatgtataagttttcaataaatgcctaaagttcaagcata

SEQ ID NO: 356 - DNA, 11860 bp, Homo sapiens
ggcaccctgaggatgcagagttcggggatgtaagggactcgggaaggagccaaggaggagagagggagaggagaagtgggggaaggagaggtggggtgagggcgggaggggagatgggggagaacgagcaagaggacggggccccgaggaaagggaggccacgcgcgagagggggccgcggggcggcgcggaggcggggcggcggcggcgggcaggcggcgggcggcgctgtcagtgcgaggcggcgagcggaatgcagcggcccgaggctggccacgtccgcacccgggggagggggccgcggcggcaggccgggggccggcgccgcctgctcgagccggggagccctcggggctgcgggtacggagcgggcgggcgcggggatcccgggcggcgggagctgggcagggacagagcagggttagggggagcagccaactcagaactcgcgcgcccggcggctgggaactttgtgtcacccctgactggccccaggacccgggaggaaaagttcgtcccagcgccgaccggagaggaggcctgtcctgagtccgtcggcgcggggctgaagttctgggtccgtttggagtgggggtggcgggtgagttgcgattccgcggggagggtaaggagtggcctgtccgtcccagactcggctcccatcaccggtgggtgatgggcatgcttctggagtctacccgggccagggcctgggggcgcgctgatagcgcaggtccagcccggccagggatcagctggaagaaggaggctcggcccgctgtcccccccggcccaggttctgtgatacactccgactcgggctctggagcagtcagtgcatgacagaacttgggcccggaaggaccttctgcacccaacgggcacagcgcccactcggggcctgcagtggaacatctgcctgggagtggagtgggcacctgggttggcccatgtggcacagggctgggcagaaccagctgtggaccttgaggactggggttgctggggcctgaggatgtatcctagggccagcagatcccatagacacagggtgtccacctcgagtcaggggccaaacggaactctcctctccggtgtcagttgcaggaaccttccctctacaccatcaaggctgttttcatcctagataatgacgggcgccggctgctggccaaggtaacctctgaccccacccatgagggacacagttcccactcagctgacactcctgtctcaggagaaactccactgtgatctctgtgactcagggcagctcagcttagacccctccagaggtccttctcatcctcctgccttgtcaaggtgctgctccctgaaatgaggggtctcctctatttctactcatgttccctgaaatgtttccttatcatcctgctactggccagttggacctgggcatgggaaggttctgcctaatgggtcagtggagtgttgagcctgggacccaggagtcttagtccccaaacccccacacaagttcttttgttctttggggtttgtctctaaacctccacttttgttctacagcttggtaaacactaacgatttagtctaaggagtctaaggatttagaaccagatgggattttagaaactgtataatccaactctttaatttcgtagatgaagaaaatgaggggtagagaagctaagtgagttgcctgaggtcacaagtattaatatcctaacagatccaaactcaaattttatttatttacttatttaattttttcacttctcccatttcacaggtttcacaggcaaactcgggttttttgacatgaagctcaaggtggttttcactgtacccccattcaattagctgttatctatcctagcaaacatggcctgagcgaaccaaactaaaataatccaaaaataaatttctgctgtcaacacaattaattgtaggggagctatagcatctgcattagctatgaaatgcattataaggccaggtgtgatggctcatgcctgtaatcccagcactttgggaggccaaggcgggcagatcacttgaggtcaggagttcgaaaccagcctggacaacatggtgaaaccctgtctctactaaaaatacaaagaattagccaggcatggtggtgggcgcctgtaatcccagctactcgagaggctgaggcaggagaattgcttgaacctgggaggcagaggttgcagtgagccgagatcacaccattgcactccagcctgggcaacaagagcgaaactctgtctcaaaaaaaaaaaaaaaaagaaaagaaaaagaaaagaaatgtgttgtaaggccaggcgcagtggctgatgcctgtaatcccagtactttgggaggccgaggcgggtggactgcttgagcccaggagtgccagaccagcctgggcaacatggcacaccccatctctacaaaaaacaaaacaaaacaaaaacaaaaaacaaaaaaacgaaaattagccgggcgtggtggtgtgtgcctgtagtcccacctactcgggaggctgaagtgggaggattgcctgagcccgagaggttgaggctgcagtgagccatgatcgagctactgcactccaatctgggttatagagtgagaccccatcccaaaaaatagattttctgtttgtttatttggaactgaaagttttttgtttttatgaaattcaaataagcagcggccactagggagatggctaatctgcctgcggattgagtattaagtggcaaaatccacatccagaaaattgaaaactgagctgaccacaccttgccccagcagatggtcagaggtggatcagcaaggccaaaggcttttcctccctacagattaagaaactgagtcagagagagaggctcaccattcccaaacaaaaaacattaatttagttatgggatatgtgtgaggaattgtttcttagatatttaatcttcactataaccctgtctgcagtcagaccgtccttagtggtcaaacccagctttggcctcacaactgtgagatgttggggaagttacctgacttcttttttttttgagacggagtctccctctgctgcccacgctgaagttcagtggcgcgatctcagctcactgcaacctccgcctcccgggttcaagcgattctcctgcctcaccctcccaagtagctgggattacaggcacccgccaccatgcccagctaatttattttgtataattagtagagatggggtttcaccatgttggcaaagctggtctggaacgcctgacctcaggtgatccacccgcctcggcctcccaaagtgctgagattacaggcatgagccaccatgccaggccattacctgacttcttgatgcctcggtttccccatccgtgtaatggggataataaagtagctgttgttattatcattattattgtttaagaaggactcctggttttgccgtctttcctgtagagactcagggtgctgtagaattagtgtgccctcgtgaccatgccaatccttagcaccctgcacatctgctgaatgtacaagatcctccaagaaaccaggaggggactccaaaagcaggcctcaatatccctctactttttgggactttctttgctcagaatttgttttggagggggccaagcacagtggctcatgcctgtaatcccagcactttgggaggccaaggtgggcagatcacctgaggtcgggagttcgagaccagcctgaccaacatggagaaaccctgtctactaaaaatacaaaattagctgggcgtggtggcgcatgcctgtaatcccagctactcaggaggctgaggcaggagaattgcttgaacccgggaggtggaggttgtggtgagccgagatcgtgccactgcactccagcctgtgcagtaagagcaaaactccatctaaaaaagaataatttgttttggaggaagtaatgagcctgcaggcctagggtgcagtaatggagagatggggcagggaagcaggatcccgcttgcccagcgcctactctttcctgccccccaatctagggaggatccaggctgtgtggaaagctatggtcctttctccttccctttctcatagtattatgatgacacattcccctccatgaaggagcagatggttttcgagaaaaatgtcttcaacaagaccagccggactgagagtaagtgtccccctcttcctccagcagactatcagatgcacactgtcatcttctccatctggacacatctgtccccatcagccttgcacacccacaggccatttccctttcttcagaggctttttgtcctctccttccctgctgttctccactcccttcctccagggaacctccactccctgtcactctccagttcccccaactacccaaccccccagcatccccaggcctctctctagctgaggaggccaactgtgttgtggtcccaacctggatctggtcccaaggtgctgcacagggtgggagcgtgggcaggaggtaaacgggtcaacaactgggcttgttgactccttggcctgaggcagtccctagaaatagagtagcagataaggggaaggacacggggctgcctgatggtagtgtccctagtgctggtctttccaagggttctccagaaaggggagaaggaaataggagagtcacagagtcatacatgaggaggaggggctaggctaggaccaggcaaggtggccaggactgaaagctccctccacttctaggtgagattgcattttttgggggtatgaccatcgtctacaagaacagcattgacctcttcctatacgtggtgggctcatcctacgagaatgaggtgaattcaggaggttggggcagtaagaagggtctgtctatggggaaatgttgttatttggaatctgggcttgaggctgggacctggaggctcaccattggaccccttcttttaggctccatggggtagaggagggcagccagaagggttctttctgggacaatgtgtatcttcgatgccccttagtttccttgggaaccaggaatgaagtaatcacttcatcttcaagggaggctttgtccttcttaaacataactagagaaggatacactcaatgtctcccagtggagaactccagtttcccagcccagacacatggaagttccctctaatgtcacaccgcagtcagtctccagcccaggcctctgaaactctccattgctgcccgcacaggtgggctccaagtgcttcttttgaccttctcaatctcaaactctccttttcctcctcccgtatctgcccatcccagctgatgctcatgtctgttctcacctgcctgtttgagtctctgaaccacatgttaaggtgagtgaggttctctgccctccgaggccccatccccctggccctgatatgtcacaggacccttcctccctgtttttctcctgaagtccccacaagactaagataatccaaaaagaaaagttcacagtcgacacaatgaacgaaagtagggctgtgctatagcatctaacctagttgtgaaacgcatctggggtcctgtggtgggtgccagggtgtcaaggcccaaagtatgggaggttggacaaggtagggtgtaaggaagcagaactgccctttgctcagaaatgccttgcatgggctctgtgctcactgcccttcacattctccttcccagtccttgtttggtgaggggtgaatgaggcagtctttggagagtggggtcagcctcacctaggcagggactcagttcctcccagccacagggaggctcaggagcttgtgtccaccttcaggaagaacgtggagaagcgctggttgctggagaacatggacggagccttcttggtgctggacgagattgtggatggcgggtgaggaggggacagtcagggacactcacagcaggagtgcctttgataatcatcagccccagatggcacccagcatggctagaactctgaccaacttctcactcccttcccccagcatattcccagggatcccattcccctagcccttccccttactagcgccccactcatgaagatagaagttgatttcaatgttagccaaagtcaagccaaacaagagactaacctgatgtcaaactatgggagactgttgaataggcagggtttggggaaaatccagtttggtctccaatgcccaggggaagcactggcacagatgctggccctctctggaaggacttcagacagtcccaccagccccacatgtcctgctcttagggctcaattccaacacaagctagatgcgtgacctgggtcaattactgaccctccccgaggcttactttctccatctttaggatggaggtaataagggattgtggggattaaatacatgtgtgagaagatacatgtgaagcttgtggttctcattcaatagatgttgcctcctattggtatgctagtatattcttaggaagctaggagctcttttgagaaaagttggcttgtgaatttccatcaggggatcaatattcagagagaaaaagaagttctggctctggggcaaaggataataaaaatttcttttttttttttttttgagacagagtctcgctctgtcacccaggctggtgtgcagtaagtggcgtgatctcggctcactgcaagctccacctcccgggttcacaccattctcctgcttcagcctcctgagtagctgggactacaggcacccaccaccacaccaagctaattttttgtatttttagtagagacggggtttcaccatgttagccaggatggtctcgatctcctgacctcgtgatccgcccacctcagcctcccaaagtgctgggattacaggtgtgagccaccatccccggccaatagaaatttcttgagctccttaaaaacatacatccctctatcattacatcattttatacattaggaaacaggctcaaagtttcaagtgacacgccggaggtctctcacacagctagggagtggcagggccaagatctaaaaccatgtgaatagttccagaggccatgctgtttctatggcactgtactggactgcctggggcactaaggaatgcctcctgcagatttctgggacccaaaagggagtggggtaacgccaggttttggggagccagaagcatatacaatttggtgaaccctcttgaaggaaaactttacacaaacacacacaaaactataaatgcaaaacaagatgcagggctctggatggctgtgcaaaggaggatgcctgaggtgtaagcttcacaagcttcccgtctctgcctctgaggaactcagtttcctgccaagaaaaactggggaagcgccagtcgggaggcaacgcctaaactggagccttggcctgggatgctctttctttatggattacaggacccctggttagggagcttgggacagggggtgctcagcccaaggatggggactggaagaggctcccaagaaatgtttgtcatttccagtgatttagtaacaaagagaaacaaagcttctgccttggaggagtctcagtgggtaaggaggtacactcagatcctgtcatctttgtcctgccgcagtgacaggccctcacgcccatgtaccctgtacataaccccaaggcctcacgaaggagcgcctgctctctgagaaaagctacaatatttgggtctatcaaaagggaatttttttgtttgtttctttgtgtgtgtgtgtgtgtgtgtgtgtgtgtgtgtgtgtgtgttttgagatggagtctcactctgtcgcccaggctggagtgcagtggcgtgatcttggctcactgcaacctctgcctcctgggttcaagcaattctcctgcctcagcctcccgagtagctgggattataggcgtgcgccaccattaccggctaattttttttgtattttcagtaaagacggggtttcaccatattggccaggctggtctcgaactcttcaccttgtgatcctcccaccttagcctcccaaagtgctaggattgcaggcgtgagccactgtgcctggcctaaaagggaagatttaaaaaaaaaattttttttttttagacagagtctcactgtgatgcccaggctggagtgcagtggcgcaatcttggctcactgcaacctctgcctcccgggttgaagcgattctcctgcctcaccctcccaattagctggaattacaatgtgtgccaccatgcctggctgatttttgtacttttactagagacagggtttcgccatgttggccaggctggtctggaactcctgacctcaggtgatccacccgcctcggcctcccaaagtgctgggattacaggcatgagccaccgtgcccagccttaaaaaaaaaaaaaaagggaggaagtaggggagaaggtagatgctgatttttggagtttcatttcttttatgcagggcatgaccccatgccataaaataacagtgcaacaagataagaacccccagggcctctcttcctaactcttttcacagggaatccaatcctatacccagaaagtgaagtgaactttcaagagctctgagttttgagagtccctgcttttgacaacctgatcatcctagaccagactgttcttatccagtttcaaagattttgcccagggatgacaaagcatgtggaccactgggttgaagcatcaaagaatcagagctgagggctctccatgctgagggagagttctgacttgagggctatcagtgggaagggacctggaaggtggagatgttgcaggatgccttcggagagggaagaggcttggcaaggagaaggggcggaggggaggattgtgccactgatttgcctcctggtttttcctctcatcttgtagtgtgattctggagagtgacccccagcaagtgatccagaaggtgaattttagggtaagagtcttcctggacacctcctcttttaggctgcccttcctgtcctccctgggaatagggctgctagggcctagatggtagaagcccaagctcctctagcagaagccaaccactgggctgacacacttgttaggggtgagatgagcagcagtttctgggtgggatgccagttaatggaagaaatcttcctgtcctctccccggctaggagcacaagtacctcacctctttcctggtaggaagtatagactggggaaataaatacatcttcaaagaggcactaggtggctgccttggccttgaggttgggggtcaggggtatggatagaacctccctgccttgtttggctttctcatgtctggatgaaacctttcttcccatctttcttcccatcttccctcaccctccacgcaccatagcacaatcccagaggtcctggcttccaaatgacaggctgcaggacttctattaaccagtgacacaggtgcagctctgaatcaccctaaccactgcaccacctcacccatacccccaagcccctttccttcacctccctgacccaggaccctcatgctggccctaccccaccccttgactctgcttccttacaggcagatgatggcggcttgactgaacagagtgtggcccaggtaggcccccctgcatctgccttggctagaaatggtctagagagatacggggagcagagcatcctagagcatcctagggggacccagtgaagttatcaagtctgaaaaatcaggggtgagaagggaagggatgaggcagtgacaggtcatatcttggaaagactcactggaggcctccgggctctccaactcaggggagctgggtactaatggatggatgggcatgttaccatcagcccacctcatctcctggcttggtttagttggattgaaactaggatgagctgcctaccttggagatggctgggtcacttgtgcaccccaaaaatctgggaactcaggcctctgatgcgccctctaccgaaacctggaaagggtaccaaataggagtttggctcttaacccctgtccttgccacttagggtgcacactgggattgttaagggactctcaaacccatgataggatctgactttccccactcatcacttgtcaccttacccctgagtgacctggctatggaagaacctgccacaaccctgcatggtcttatctggaggtgcttgcagagcgtaaggccagggggaggttcctggctctgaagcctgatcagttccccagctgcacaaacttcctgctagttcaggacgactgtcttgacctctcttctgtccacctgcaggtctctctgctcagactaatcctgcttgtatggaacttcccgccctggcgctaactcctcgtgctgtggtggccctaccgagatgagcctgtgctgtctcgtgtggagtcccaggtgtggcgcccattttcctgcactgcccttagcgctcactctgcttcgccctcccctctgattccccatgtttcctcataccatgctggaatgaatgcagctgcaaggcaatttttagagtggaaagagggtagggagtaataagcagagcagataagaacacaggtgctcatgggagtcatcccagggtacgtgttctaccttaccacctaaagctgggtgacctagggcaagttactcaacctctctgggcctcacataataacaggaccctcttcatggagttatgagaattcaatgagccaatgcgtgacaagctcttagtagggctccaagccagttaacacatgctgaataaccatcagtatttctccaaagggagaaagaatgaaaacatagcatttttgatggaattcttgagtaaaaacaaaggaagctacaggtagccaatgggggataaaatgaggacaaagttagattctggctaggagaatcaggggaaccctaagccactgtccccaagagaggagggagactgtgcaggaggaggagacacagcgttccctccttctctagaggggaataaggctgagtggctggagggacaatctgagggacacacctgagtcctgtccccctctcctgctttggtattgtgcatgcacgtgtgcacttatatggatttgtgtaagcactgggctgagactttccaccaggcatcccaccgcagggtctggctggccaccctttgccagctatgccacatcagcagtgggttgcggtggggtgttgaggacacattgccagccatggccagagctaggggtttgctgaggcgtctgagcacagggagtgtcaggcctgggccccgtctccgcctggacgtggcactgtgggcgggaactctcatggcatgacagcggggagacaggctgctgccacacccacgctgcagatgcaggagccagaggtctgggcaggcttgggcctgaggtgggagctggctgcagccggtttggtctgcgctttctgacttggagggttggccgcgtttaagccaagtggagacaagctgctgccacctagtgaccggtggttgcaggggcgcttcggcaaggtgggctgtggacctccccatgactgtgtatggaggcatttgacattctcaattctctctcaacctcccccaccccaccccaggttcttcagtctgccaaggaacaaattaaatggtcgttattgaaatgaaggctgtggattcaaggctccctgccccccagatcatttccccaatcctggcaaaagcccaaagatcccagggtcaggagagacccctctgtatccccaggtccctcccagaactgactcctaaggtctccagccagggcttctgagatgcaaaggtttggcctcaggagagtcaccttttctcacggccctggccttaactcatatcttaggcattcctggccccagggccctaataaacctgcttttgtcttctgccaa

SEQ ID NO: 357 - DNA, 31739 bp, Homo sapiens
agcaggagcggagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggtagcaaagccgagctctgggcagggggcttcggcgcgctggatagtggaaggggcggggaaagccccctaaaagggcgagcgaaagcaagggcgaggtggggtggggtggggtggggttccgccgcgaggcagctggctgcaggctgcgcgttgtgaggggcctgagggggggcggtgttggcgacggcggagacagagacggaggtggtggtggagcagcaggggaaggaaggaggcgccgcgctcagaatccggctgcggaggcgcggctgtgggcctggagttcctgtggtcgcgctgtcccgggcctgagctggaaggtcagcctcccctggggcgcagacgctgacccttcccggggctcctcccctcccttcaccccatcctctggccttagctggcctgaaattaaggccacggtaataggggtagcaggaggcggcggactgacctaaagcagctggttctttgtgcgcatagaccgtaagggggaatgatctggacttggtcagctgcctcggggcctaggcagggatctgctcatccagatgttcagttgcgttgcccttctttcccttcaatattattaacttaatagtccacttgaagcttgccggcttttttccgggcgacgtggtgtaaacaaccacaacctcgttggtgctgcaacgagctggtggagcccagaaacctttcacatgccagtgtgtcatcctcgtagtaacgtacataacatctccccctaattccacatgcgtgtcatttgtgcatttcttccttgcgattttccctggttcttgttctttgccaagaggattaattatgtagaacatcttggactcaggatatttattagtcgtctcatcagctgatgtgctgagaaaccttcataagccctcaaattgatcacatgtagtaaattgttactataatcataaattgttacattcatcattgcctttctgttccttactatttcattgcttagaatgattttttctttcttccattttatcccttctttttttttttaagtttatcgatttattggcgtacaatacagatgttttgagctatgcaagttaaaattcttctgtaaactttttaagtgctgtgaaaaagacacacatgatcagtaaatttggaattttggaatttggcagaaataaagtagttccgaacagggtgcagaagggaattagaaagaggcagatttcgagttcagacagataagactaggtcttaagatcagtagaagtttctaattatactgttcttaatctttcaagagttagtgttattcctctgacgtgggtatacagtattttattagattgtatattgaaattgtctgtcagatttgtacttacagaactccttagatttacacttgacagtacaattttatgcccttcaatacacattgttttacaattccagttgctctttaatattgttgtaagggctatataattcaccttttgaatagctgctcttatttagttgtgatcttatattaaacagaggctgtggagtaatgtgacagtggcagagagctaaaacttgagccaaactgcctgtttgtaccccacctccaccaattattggctgagtaactttgagcaagttaatttttacctccctgtctgcatcggtaagaaaacatatttacctcaaaaaaaaaaaaagcaagaaaaaagaaaaactttaagattgctgtgaaaataataggtgagtcaacttatttattaaaagttattaaaagtgtttggcacgcagcccctcccttctattctactccttacccaggatgaaggatttagattggattgttattttattttttgttaactactctttgatatgctgaagaaagattaacaaccctctattcagtaaactattaggttgggagttatgtagagtatagctgtttactttctattatttgaggattgattattaaaatctactgggcatactgcaaaattaagtgacatttatttttctgtccttgaaattttctacatggctgtataaaatgtttgtgagagatcttagagtactactttcatgcagcctaacacacttatgaaaatatactagcctagaaagtacctcagttttatcattccagataatcagaaactataatacatcacttgtgataaaaagatcaaatgtaatgaaaagttcagagtttaacttacaaaaaagatcctgttgtagaatttttaggcaaaaggtctgtaataccaactgagtttctgtcatttgttgcttgatgttttatgtttagaaagatggttaatagattcagtgatctttaattatactttgcacattggggagaaatgtttgatacaaacaaataagttcagggttaaaaaaaaaagtagctaatttgctttttctttgtaattcagtataatttcagattctcgtgtcccatcgaagtttctagcaagaggactgttgtcacatttccttcttggactcattactggtcactgaaaaccagaagtgagctacatgtactcatacagtaactacatatagattaacaatgtgctgctgcatagtagaagttgatttacaatcctggtatcaagaaattttagagtttaaaaggatctagtagggtttgtttggaagcctttttcataaattcagtcttaacatgaaagcagagtggtgatcctacagctgactgatctcacccaacaccctcgtttttcagataaactgaggtccagtgaggttttgtgacttaatccaggatcgtcaatcaagatagtaaaaccagatttagaccaggtcttctgattcccaactgaatactctttctgtctcacaatagataaaaaataagttgctttgaaatactttaatcctgacttctttattattgaattatgcaacgtaaagacttaacatgacttgtccttgctaaagagaatcatcccattcagtattctgcttaatgtccagttgagttttgagacatttaaatggctaattcttagaacttttataaccctccattagttatttttgttgcacccatctgtcttcctggcaagcaataaaaccttgacatatcatgggcttatgtgcttaatttcaggacagggaagaaaagagaaaatttgggactatatagccagactatacaggtctaatttctgactctgaatattctgaagagaaagaactcaggaagccagtcctaaatcagaaaactacccctcaaaggcttaatggagggttttgcagtttagcaaacccattgctaaggaaagaatacaatagaagggagttggagctattacagaagggcactgctgttgtctagatactcttgtatagtgttatttgtgtagcacatattgttactaatgattaaggtcccctccagctttcagatcttattgttaaactactatttgcatttttcacaaatattttatactgcttgaaccaagcctttttcttttttgctcagttcatggttgacagatcaactaagctaatttttattggatgtagtaatttttaaaagttcctctgtatcacaaattctgtaagattggtgcctgtgacatacttactcttgatttttttctcaaaaaggttaaatattggctaaaataacttagaaatgtcaaactctatcttattatagtatttgagtgtcggtgtattctaaagtaaaaaacagtatttattaaagaattttataagagtattctaaccaaacttccaatttaaataattttgtattttaagttacagcacccagtgtattggtgttgggtgcaaagaaaggaaaggcagtccagcctaaatttattggctcttagcttcctcattgtaagacagttgtgttcattcattgaactaagaagttctctccatttgtttgaagattgataggttggtttctctttattagtgggtgctactattcccaaaaggccttcactttgttagaagtcttctaggaaaattataaaaatattctgtttacatcaaaagagaacaaagagggggaggtactgtagtccaatgtataaacaaaaagaaggtaaaacttttataccttcttatgctgcatcaggagaacagtgaaagtgaagactgcatgcacgttggatgtggtggcttgtgcttgtaatcccaactatctgttcatgttctcatggtactttttttttttttttttaaagagacaaggtctcactgtggtgcccaggctggaatgcagtgatggcatcatagctcactagagactcaaactcctggtctcaagtgatcctctggccacaacctcccaactagctgggactacaagtgtgtgcaccacctcacctagctaattttttttaattttttgtagagatggagtatcagaaagttacctaggctggtcttaaactcctggtctcatgcgatccacctcggcctcccaaagtggtggggattacagggatgagccactgagccctgcctctcatggtactcttctacagcaatctatctttctggcttcaacgccaaagcaatggcacaaattatattgttgcattgaaggcagtctacaatatggataagttattataagttaataaattgcaatactttaagaaagtatcagtaaacaagttaattctgtgtctagttgggagagattatccaagtccgtgttttctggtctcttcctttcattgcctcttgatagtgcctttacaaaggacagggtgcagttttagaagagtttggtgaacttgaaattaattgttagaatgagatttttaaattttgtgcatacatatcaggttccctattgcgtaatatgtaatcagcttctcaattttttatgtaccctaatatttaatcaggttttacatgtgatgcctctatcagcagtcagtagattagtatatttatgtctgtattcaggaatggtataactgagtgttagtatgagtatatttgtatcatgcctaaatttgatatggtcattctctacaattactttccttccacatttcctttctgttgataaagttggaaatctgacatctttacctagccattttatttatcctttatcattgagttctatgtgttctacatttgaaatgtttcagatatctaaatttctttcccatttatagtccagtatcacactacaatttacttgaatattacagtagtcttccatccatttccctgccttatgcatttttttccagttcatcctacacacagccaccaaaatcatgtctaaatcatttttctagttatgtcctattaagaaactactagtggtctttctgctgcttacagggtaaagtagaaatttccttgcctaccttgatgactattctgcttttacacacttaatctcccagtacttcctagcttgtctctactagagccaaattttgtgtcattctcagccacaatatttatggcttttcagtcagtttacccaaaacttgttcatctttcaaactttatcttcctcttccagtgttcccatccacattgataatctcactcctaatttgggtgctttcactttgttgccaaggctggagtgcagtggcatgatcttggttcactgcagcctcaacctaccagggctcaggtggtcttcctacctcagcctcctgagtagctggaactacacatgtgtagcacctttttctatcttttttttttttttttttttatgtagagaaggagtttcaccatgttgcccaggctggtctcaagcctggtttcctgggctcaagcagtctgcctgcctcagccacccaaagtactgggattacaggcatgagccacccaacccatcctactctgtgtatttcaaaaatattttttctgcccctctttttgggaaataataattactgcttctaacagttatgtaacagagtgtacatatcatgccttacaaatctttgctgttaactgtagcatccaaagatgatagggtgagtactctgtaagtctggaagaacaggtcacatttattcagacttctcccccacaatttttaatcaagcacctcccagtaacaagttatttaattagatcgattttaagttgacaacagatgtatcagatgaggaaaaaattgagcatgtgtggtgtgattatataatagaattggtttctataaaccatttatagtattcaacttttatagtattactttttcagatgtatggatatatagactattatttactaattgaggctctgcgaagtgtagtgtattttacaaacataattaaatactatcatttaatatgcctgatactaacatatattaatatattttagcatggtttcaaaaattttaattaggaatttttgccttttattatatcagaaagtatattttgcagtcaggcctcaaataaatcattatgaatcttgtagttgttcctgaacttggagtgttaaattttgaatttgccattttttaaggttccagttttttgctgggcgtggtggcttacgcctgtaatcccaagactttgggagactgaggcatgcagattatctgaggtcaggaattcgagaccagcctggctaacatggtaaaatcccatccctacaaaaaatacaaaaaattagccggacatggtggtgggcacctgtaatcccagctactcgggaggctgaggcatgagaatcgctggaactcaggaggtgggggttgcagtgagatgagatagcaccattgcactccagcctgggagacagagcaagactgcgtctcaaaaaaaaaaaaaaaatctactttttgtgatacgtattttcatatataaaagttttaatttcataaatacttggtttttatagtagccttcttttgggttgagtgatttgggctcttaatttttattgccacaaatagcccacagctggtagttgcagactgtaggaattgtacactggtatgatcttacacaggtaattgggctactggaagtagaggacttgcgaaatacaaaggaagaaatgagagatgtacctgccaggagactcagtaaccaaaacaaaaacttccacttcatctaacaaattattcctttttgggataaagttaaagctgaaacgtaggtttgttggttgttctttattttcctcaaacataacttaattcagacttctcttaactttggaaaaacccaacatagataagttggatagattcttttttctattttgcatcattagattttttttgcttgaaacagctgtctttagcattaattcttagcatcttagattcttgccagattattttttactattatttgtcattttattctttaatgaagcagcccttcctgaaatcattcacatttagattatatgttgctggaaatactgaatgttctgtgtattgtgcttaagcatgcaattatagacagtaattaagtacagtgcatttgtttcaatagcttacagcaataagacagcttttgaaagtttatacataagatgtatacaaagatagactgccttcattttcttcagtacgtgagtagggaaaataaattcacaggaggaattgtcaaagaagttcagaatgaaagggaataaagggaagatggggaatgagaaacaatgaagaaaataatagaaaatttgggaaaagatatagaagaaagaaagcagagaaggattaaaacggcctttccaaaacgactctttgtcagtgcacttccattaatcacctcttcaaatgagatagtaataactctttttgcatttttcatttttgcctcacccttactggagaagagaagatgagaaagacagtcccaggagtgtctggtatctgcagccacagggggaaaggaaagagaatacaaattgtcattgtgtcagtagttcttatggctaccacattgggggcagctgtcattgattaatttgagaactccttctgcgatctgttgtccattgttcaggatacatatctttggctgttattttaacatttatttatgacacttgtttctacttactttgacatttggatactcactattagcaacatcttatctttttaattactgttttgtggcttataaaaagagactataggccggtgacgatggctcacgcctgtaatcccagcactttgggaggcctaggctggcggatcacttgaggtcaggagttcaagaccaccctagccaacgtggcgaaaccctgtctctactaaaaatacaaaaattagctgggcatggtggcaggcacctgtaataccagctacttgggaggctgaggcaggagagtcacttgaactcaggaggcagaggttgcagtgagccgagatcgcaccactgcactctagcctaggcaacagagtgagactccatctcaaaaaaaaaaaaaaaaaagaccgtataagaatgaaagtgaactggtacaaagtagttaccattgtggaaaaaacaactcaaatgcctcatagttgaagccaagaagcagacaggctttgcctctatcaacttatatttgaaaaacgtagtttctttaaatctccatttttgtcttttgaatactttattaggtcgctccagagaaagcttgaaagcaaggcctgtactccacttgaaaagattcataaaatagatttgtaaattattattcagcgcatgaatttctcaagtatatgattatactaaattaatattcatatgttgcaggaagttggtgaaccatctaaagaagagaaggctgtggccaagtatcttcgattcaactgtccaacaaagtccaccaatatgatgggtcaccgggttgattattttattggtaggattatatcagtaaaatcgtattagtgtacatatgttatgaagttaacctacatttgggatatgtagaagttttaaaagtgctttccaaatgtgattgttctggtgatggacatatggcagttgattattctgttcttttcttttatgattgaaaatgtctataataaaaagataacatgttttctaataacaattgttggaaatttttttaaataggatttattttcagtgttttaaaatactaccttttgtttagatagtatgcgtacttggaactaagagcactggctttttttccccaaacaatgtcattataagctgatgtcatttataacaccagagcttataagtaggggttgagtttgcctttctcatcaattaaaagtgaattgcagctgggtgtcgtggctcacacctatagtaccaacactttgggaagccaaggcaggagggttgcttgaggccaggagttcgagaccagcctatgcaacacaatgagaccccatctctacaaaaaaattagatgagtatgatggcatgcgcctctgaagtgagaggatggcttgagcccaggagttagaggctgcagttaactatgatcccaccactgtactccagcctgggtgacagagcaagaacctgtctcttagaagaaaaaaaaaactaaattgccagtgtagaggaaaagtcctttatcgtctctttctttactgtttttaatgatttgacattcattacaagttttaaaaagtagatgtgctaatctcttcagatataatatgtttagctgtttcttgtgacagcagtggattgttgacagagcttcttcctcagtgtattagagtaaaacttgatgagaatttttattacttgcagggagtggtgaacattttggtttatctacatatgcttgtgattaataagagtgatagttacatacagatattttaaatttttgaatatttccccattaatttaacttgctttagttggtctttctgaatgccattatttcccaacattacttttaaaagatacttaatatagttcacaagttgaggttttggggaactactaatcatgatcatgttagatttagttttctgttgagtttggttttcttttttgttgccagagtgttgaaattttactttataaaatattatttagatagacataaatccccatgtatgctaaatttaaaataatgaatttcttctttagcttcaaaagcagtggactgtcttttggattcaaagtgggcaaaggccaagaaaggagaggaagctttatttacaaccagggagtctgtggttgactactgcaacaggtactgtttatttcttagtgaagaataacataataattttaaattttcttcatagtcctgaagctccttacatcattaaatgtagtgatactacaacataactcaaatactgttttcacatgtaacctgatttctttggtacctctggaaatgtgtttggtattagactattatacttttaactgtatataatttttatttatgttctattttatatatttgtgagccctactgaagggtcagcaacaaaagtcatataccagtgcctacagtagaaaagaaagttttttcttttgtagagcaaattggttgaggagtctttttttcaaaacttttgcaggaattcctattagctgtgttaccgctacttttttagtgcctgcaccctgagccataagcctcataccctttcctatttggttcagtgtttgctaatgtagtatttcttctaaaatcaaggaagctgcaacatctaccttatctttttctgagaatttcaagatgaaatacagctaattcagtaatatacatatatttttcataatagatactttttctgttttgaaaaaacttttgatgttaagtggtttacctaaaagacaaaatcaccttccttttggaaggaagtatgctggtttttctttccatttcttttcttttttttcttggtttacttaatactaagcattttcttaatatatgttaactaaattttgttttcataacactaaagcttatcttttgggattttagattattttatgtgtactaatattttatttaatggcacctaaagtatcagccacataagaaccctcttaaaaaccactatttcacaacctggtttcttaagctgtcaagttaaagaattattgaatatttcttaaaattcttagttgccaaagactagaggttactaacagaccttttagaaacagtaggtttcggccaggcacagtggctcatgcccgtaatcccagcactttgggaggccgaggcaggtggatcacaaggtcaggagatcgagaccattctggctaacaaggtgaaaccccatctctactaaaaatacaaaaaattagccaggtgtggtggcgggcacctatagtcccagctactcgggaggctgaggcaggagaatggcgtgaacccgggaggcggagcttgcagtgagccgaggttgcgccactgcactccagcctgggcgacagagtgagacattgttgagacaaggatgagctaacactcatgcagttgatatttgcttgtcttttgtagcaacttgtctagttagaattagctccagcaagcatatatccagggcaacttgaatctgctcgtggggaaaaaataaaaaggtgaatagaattagctccacggtacaaacttccaggctgggcacagtggttcacgcctgtaatcctgacactttgggagaccaaggcagggagatcacatgaggccaggagttcaagaccagcctggccaacatagcgaaaccccatctctactaaaaatacaaaaattagccaggcgtggtggcatgcacctgtagtcccagcaacttgggtgactgagacatgaaaatagcttcagcccgggaggtggaggttgcagtgagccgagatcgcaccactgcactccaacctgggtgacagagcaagactctgtcttaaaaacaaaccaaaaagtacaaacttccttacctgccacaaaactgatgtattttttacatgttgtgtaaaaattaagagatgctacaaatgcagaaactggggcacagagaacttaagtactttatctaaggctacacagctagcaagtggcagatctagggttctacatctagcagcctgtctccacagtctgtgttcttaactaccgctctatactgtctcctccaacaaaatgacgatgcatttaatggagctattagatctgtaagcccaaatctctgagtagagcagccagtatgaatccacattttttggctttttaggagccttggtaccttgttatttgaaaagctcaaaagacctgagtacagagagtgtccaaagacactcgattttcattgtatacgctcttcccactgatgtcagattgtttgagtcctttctgcactaaaataaatgagaatagcataactttaaggtctccagagccacttctaatataaccgtagagtcttattggccagttctcatgagttgctgcccaatagcagacaaaatcacaaagggtctcttgaccagtttctttttttctttttttggcatcctccaatactgtcagtttttctgaggcagctaagtggcatgagggagtctgaggaaaaacaaaataggaaaatgtaggatgataaaacaatcttttctaatgtgatctatacctttttatggcctatatcatgaatgaactcatacatactaggttaagtctccacaagactttgtatcactgacccccaatccagttatgtcgtcctcagtcttgtgcacatgccacactcattttttcttctagtctttttcctatcataacttgccactttccctaaacggttctgtttcctctgtcccacctgcctctcaaaatcacaaacaaatccctcaagtccttcctctaccgaatgtactcttccccaggccctccagccttcatcagcctttgtatctaaagttctactgagtttatcaagttagtacctcccagtttggcccttaactattttagaattgctacatatgtgtgagtttttttaaaatctcctgccagctaaatctgaaaacaattgtaagactgttttatactttattgtaactccatagcaattaccacagtgtgagcacttcataaaaactcacctttgccacattggtggaagtccccaacatgtctggcatttaataaatgtttgttaaatctgaaaaaaaaatggaagtgaaggaaaaaaatacagaagtaattttttaaatgttttagaagctgttttaaaaccacttactcaacaaatagtctaggctccaggaatacaataataactatgacttggtccctacatcaaaacatattctgatctgttagggaagatttataactaatcacaatgcagtgtgttgaataaggaagagagagatggtgaaactatgaagaatgacatcacacagaaaatgttttaagtaaattttgaaacataaataggtgattacccaacaaacaagagaagaaaggaaattcattccaagcaaagggcatagaacacaccgagataggaaagtatgagtagttgtgtaaaaatgtcagagagttttatgttagtaatgtgttctatgtcatgggtttaaagccaaacaaacggaggctctgatactatacaaatgttaaataatgtcagtctcatctttcaacctaattgtgaaattattttcaacacaatttgattgaaagttaataatctacttttctttcgtgggggtgggcagctgtgcaggaaaattgacagaagcagatgatcctgctggttctattgccttcagtatctactcatcagggaaaaggcttttttctactaaagttgcattgtttgtttttaaaattctttattaagaatcattttttccactaaagtaaatttaagaaaatgggaactgttgcaaatgatttagaagaaaatccaaattactaataatgttgcttcgtagatagccagccacattaccatttgagaatatatacttcaagtatctgtatgtgtacacatgtactcttaatatatggacatgtatattaactgcattataaaatgctgctttttcaattaacatatgaggaacaggatgtatttttattttcatttggagtggaaataaatgttcctgaaagaaaatctggaaatcatataagtgcacaaagaaaattagaatatattttcattatagattttttttgtaagacattctggagtaaaaaatgtaagactacacttcatattcaaatatgccactactattcttaaatcccactttgtactcataagtagttaatcattaaggtctcatttcagattcttgtttgtttatatatgtatatgtattcatagcagatatgatggtagcattttgaggggcagtttgaacatttgcacaattatatgcacaatcatatttacataatttaaaaatagctcttccaaataagtagtatgggccaaatgaggaaacctagaaattagctttgtggaagtgctcataggctggacctaattggggagcagatggaagcccagccaggcaggtaaaacatagaaacataggtgcttcaggggactgaacacagtgacaaaaagaagtggttatctgggcaggaagaaagcatctagttaacaagtgctgtgatgtgctggagcaggcaccagtgaggtgtaagtagaaaggtagctagatagtcaccattagcaggcaccagtggtggtagtgagacgtagcttctagattgtattgtggcaattagacattatcaaagcaggaatggagaaaccaatcagaaattctgaaactagaacatgagatttgaaaaagtgacttttagatgacaaaaataagggcaacccaatttcttgagtaggattgtaaggttaaagagaaactaccaagcaacgttgacttaatctggggtcagataaaaaatgaataaagcaaggatctctctctctcttaagaagtttaccgtctagtgaaggagcaaacaactactacaaattatatagtgagttagaagataagtgctatggatagggtaacaggaaacgagagaatgggaaggtgggcttatgttttaaacagagtaggttgtggttgagggaaaacttgaaggaagggagtgaaacaaaaggacctgcttatttgggggaagagcattctaagtaaagggaacagccagtgtgaaggccctaaggtgagaatataaaatatagtaataactgataaaaagagagaaaacaatctatttagagagaaattagtgaaaccaggaatacatcatgttttgccaaatatattgcacatttttcaatttgatgttgtgcacgtccttttcagagtccaaaaatctcaccttagtatatttaatcattgcttaattgaagataatcattacagtggcacactgaattgcgaagtacttggagaaaaaataacaccaagaaagctgaaaagacattatttggacccatcaaatcatcacttttaatctgttaacatttcttaaactgtttattttctcctttctttattacgtcagctcttgcatttgagacttaacataaagtgaagctgagtcttgattatatgaacccagaaagagtctttatatggataatctcaaacctataatctcttttatacttaaggtacatcattaaaagtgaaaattatattgaatatcactgagttttgacaacttttatataattgactgtaaagtgttttgatttagtggtagagttgactactttttcacgggcatactagttgtaatttctcttgtgttgctaatttatgccttcctttgcttattttattcaggtcttgatatttttgcttttcagtctctatctatatggggagtgtaatgccatacctgtttttcccaaaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggtgagttaatctaaaattaagtaaaaatttaaaaatcattatgtgcacatgaacactactggcctatgagcacatttaagtattatgcaacacctacctgagataactatattagagttgttataaataccgtggttgagaatttttatttctgtgttacaaatagtcagtgaaagttttttgactgtatgaacatcatatttcttgcttacttgtgttatttcttctgtccaacttgtgttttcataggaggaaactccaggaactcctaaaaagaaggaaactaagaaaaaattcaaacttgagccacatgatgatcaggtttttctggatggaaatgaggtgagagtaagcctataactagaagttcagttttctataggagtttttagaaagatgtttgatgccttcactaataaaaggaaaaattttgagaaatctaattatgctcttaaatgtataaaagctactccatttttaaaaatcaataatttctcttatttagatttttaaaagtcagatttgactgtgagtgataggaaacctgaaataaaagcatcttaatacaaaatagatgcttatttcttttttatcagtgaaatctgtaggtaagctgtacagatacgtcagctccatggtggatcccagctcttcttttctcctctgtctgaggcttctagctaaggttaccttatggtccagaatgactgccaatcttatatctgcatcgaaaagaggaaaggagagtgaagaatatgtctcctctttaaggagaccagtttaaggacactgtccagaaagctggtaatttcatttctgcttgaattccattggccagaacatagtcacatggtcatgcatatgagaagtaaaatcttggaaatgcactttttatacaggatgattatttgcccagccgaaatgtagggtttccattattatcaaagaaaaaagagcagaataggagatagctacaagtctctatctcttacagaatgtaagtcagacacatcacttgaggggcttaaaatttttaacatttcttgatgctttatgcttatcatttgtaatggaagatttgtatggtggtagccttccataaagactgcttaattcagtcacttcaccagtacgtaaacatgagttatatactgggcattgaactgttgtgaatttcaggatatatcctttcctgttatacctatacaatagtaacatctataaagtcatggctcctagggttgtgtgtttgaaattcttacttgcatgagactatctagagtgggattgtgggggaggattatatatctataataaagtgtcctcaggtgactgatgtgaaccccttgttgagaaccactgtaatagaaatttttatttttataggcgttgggaatagcttgataagtaggataaaatctcttaatggtctagcaaagatacaggcacttaaacatgttaatatagtacagtgtggtaagcattaatggtgtgaaagcaccaggtaggaatagttaatttagtcaggaaggataagaagggtctaaaggacatttgagcttagacttgaagatgactggcagattgccaggcgtgccaggaaggaggttaggtctgttagggaaggaaacagcctgagcaaacgcatgggtgcttggtatcctgagaagcctagattttattctgtagaaagcagcatgcactccataacttttaaagttgtgaaatatcttttttaaaaaaacatgtttttttagaatggaaactggcagaagtaatatctgtgaatctgattcccaaggaaatgggcagagtaaaataagaggttaaagtggaacctctggtgttaaaaattgaagaaccacgttggaaagacaataaagagttctggtcaatatagaaataagagggaagagtactgttatttatagaaactaagaaataaaactgagttttatggatgaatgatcaaacagagttctgatctgaatgaagtaaatttctgttgtgtaaaataagagcctgataaaagtaaattaagttttgaagtagtggttcccagcttatgggccctccatggaggagtaggcaatgaaattaatacagtcatagagactatgttcaccaagcatgatctttaataattgatctttgtgtcttctcaggagagaaaagtgtggagttgagtgatactagatctgtaatagggcctggctggaatctgtcttaactgcgcttttatcccagactggttcatcattacattagggacaaaaaggttggcagttgctggtgttttggttgaataaataatgatgtgcacacatggaacaatttttttttcccccaagacagagtcttgctctgtcgcccatgctggagtgcagtggtgtgatctcagctaactgcaacctctgcctcctgggttcaagcaattctcctgcctcagcctcccgagtagctgggattacaagcgtccaccaccacacctggctaatttttgtatttttagtagaggcagggtttcaccatgttggccaggcttgtcttgaactcctgacctcaagtgatctgcccgccttggcctccaaagtgctgggattataggcgtgagccaccaagcccagtcaaacaaatttttaagtgtatgtaagaacatacaaatttacttaagtgctttatagaatttatagttatcctataatcattttctagcgccagaagaaccactactactgaaggaaagatctttggaatttatttaccttagaaattacttctcgtatgttaagaggttgatgactgctttaagggacctaaaatatagaattaagcattactttctaatgtgacattagaacttttaagcaccgaggtttcttgattcttctaggtgtatgtatggatctatgacccagttcactttaaaacatttgtcatgggattaattcttggtaagtagtgagatgttaatagctataaagtgcaatctaaaatttagaaaacaatatgcagatactgtaaaagaaaatgttcctaaatttaacataaaatagttgtcattttaaaaatactttaaataaagtcagaagataaataatacactaaggaaaatatttgaaacatattaaagatcttttaagagattaacaaactgatagaaaaatggtcaaggtagttaacagataaagaaatacaatgaccaatcatcatgagtgatacttaatcacactcatatacaaattaaagctgtagtgattaagagtcttgcaaaccttaacattaaaggtcttagaaaaaaatcagctctctctaacagttgataggtatgtctattgttttaatttttgtaaagggcagtttgtcagtatctttgaaattttatgtgtctgcagtgacccagcaattctaggctgttcccatacagttgcacaaagtgtgtgcattgacacattatctgtttttttccaaatcccttagactatacttgagtataatctagcaaatatctttcaaattcaaaatgcttataccatttgatctaataaattccactttaaggaatttaccctatgccataatcacagttgcacaaacgtacatgtgcaaggatattatacctagaatagataaaaaaagaaaagaaagttacagacgagtaagaatagtataagctcatttacttatttagaaaaaaagtccctgtagctagttaattatatataggcagtctctgagaatacaggtaagcttaatagtacttaacctctgggaagtggaataagaattagatgaagacttaattttctctataccttttgatttgcttgtttgtgacagggtctcattcctgtcacccaggctggaatgcaatggcacaatcatggctcactgcagcccgacttgctggggtcaggtgatctcccacatcagcctactgagtagctggaactataggcacactccactacaccccgctaatttttgtatttttttgtagagatggggtttcgccatgttgcccaggctggtctcaaactcctgggcacttgcctcgttgtcccaaagtgctgggggtttgatttgtttttgatttgctttttaacgtgtgtattccaggaggttttatggggaaagaatgatttaacaaacagaaaaaaaaaaaataggtagcagttaaaataagcttggtcaatatggtatgataggatcccattcaaaataactctttaaggctgggctcagtggctcacacttgtaatcctaacactttaggaggccaaggcagggagatggcttgaatccaagggttcgaaaccagcctaggcaacatggcgaaacctcgtttctacaaaaaattagccgggtgtggtggttcacacctgtagtcccaactacttagaaggctgaggtgggaggatcacctaagctcaggaggtcgaggctgtcgtgagccaagatcatgccactgtactgcagcctgggtgacagagtaagactctgtttcagaaaacaaaaagcaaaataactcttttataataagagtactagtcactttgctagatattttgcgtacaatatatcatttcatcctcacaacaacctttgaagaataggaagagacttattaaatataaggtaacttagcctcaaaagagttaagtaacttgcccagggttacatagcttataagtgatggagctagaattttaatcctggtcttattctaaagacctaataaccaggcttctaatttcttataattctttcttgtgtccccactttacttgcaaaaaaactggagacacttgtaaacagtttccctaagcaccaaaaaatacatctgtagcagaaatcacctggggaatctttcagtctgtggatgtcagagctccaccccagaagaagaatctccagagaggggtcttggaaatcattttttgttggctttgttgttctgttgtttcttttagctcccttacttagtaggcaaatatcttagtattttttaaataaagtagatatagcttgaaaaagggggcagttgataaattaaggaggcaacagttttgaatttctacatagcatttttttctaattatatgtaatttacactaataaaaactagtttaagaatagtataaaatgttaggttgaacaatatgaaattgctcataattgaccattttttacctataaaaatggcaattttatatttcactgtgtttatgtttctcagtttttcccccagggatatgtttctgttagtgcagccataccatttaagtttttattctaaaatttaacttttgtcatttcttgttccagtgattgcagtaatagcggccaccctcttccccctttggccagcagaaatgagagtaggtgtttattacctcagtgtgggtgcaggctgttttgtagccagtattcttctccttgctgttggtaagtattgttattataaaattgacctcaagaaggttggtattgagcagttggactgtaatttggagcttcagtaaagcttaagaaaaattaatggaggtaaatcaagaaatatatggtactactttctgagtcaaatctcaaaactcaggcttggtaagatgtgttctgtctgcagaaaaaggatttaatacatctttaaaaaaattttttaataagattattttttattgacagatcataattgtatacatttatggggtacaatgtgatgttttggtgtatgtgtacaatgtggaatgtttaaatcaagctaattaacataattagcatattgatcacctttcttgcctatcatttattgtgagacatttgaaatttacttattttgaaatataccatacattattatatcttaatctgcaaatagatgtgctttaaaaattagttatggcagaggcgtttaatatttttgcagtggtagatcatttattagacataatactttcagtaaaacattttttaattttgacttagaacaaatgcaacatctaaataatctatgcatatatttaataaatgattctaaacaattgatttgccattttgggaaaaatcaataattttcacccaagtaccaaaatactagatgcaataaggagttaatgttttaaaaatcaaataggaaaacataagtaaatgaattttccgcatttctggatgattggggtctttcatagattatttgtttagaggcagggtcttgctctgtcacccaagctgaagtgcagtggtgagatcatagctcactgcagccttgaattcctgggcttaagcaatcctcctgcctcagcctcccaagtagctaggagtactggtgcatttcatcatgcctggctttttgtgggggagatagggtatcactctgcccaggctagtctcgaactcctgacctcaggtgatctgccctccttggcctcccaaagtgttgggattacaggcgtgaaccaccacgcccagcctccttcctctgatttggtaacctctggcagcagaaaaatcccctgctggttttgcatggaacacgggcacatttgtaggccaagaaacaatatctaagcctgtttgaatttagtgtcagtgtaatacctgcatcaagaaggaaaagtcataaactttgatctgacattagacataataaaattggtgctttttgcctttcaaattcctgaaatttagaaactccttggaaatttttagcaaaggtttagctccactgaatagaattattctacttgcttatttttaaattaaaccagtgttcacaatagtttatggttattatgtagttttgctgtttaaaatattgtttcttcagtagtctctttaaataaattttcattgtaaatatgctgtggatttaaatatgcattatgaaccaaatagtcttctgaattataccaggaaacaaacccaacattttattttgattctcttagaaaatgcaattccaaatatactttcaaataattagatatttcttttatattattctttgaagtctttatatatattatgtatatcgcatataatatatatcatgtatattatatatgaatatatatgatatatagatatatgatatatcataatattatatatcatatatatcatataatatatatcatatgatatgtcatatatattatatgatatctcatatttatatgaaatatatttttatatatattcattttttggagacagggtcttgctctgttgcccagggtaaagtaccatggcagaatcatagctcactgtaccctcaaactcctgggctcaagcagccctcccaccttagcctcctgaatagctgggactataggagcatgttgccatgcctagctaatttttttttttaaagtcagggtcttgaaatattatgtattggtcacaattatatctggtgtttctttgaatatgcattattaataatgccatttaaaataaaacctttggcagttttctaaaatctgtcgcttttagcataggaatgttattatagtacatgtcacagcttccccataattcttcccttttcactctcggtaatctagtgccacatagcgaaaaactgtaaaacatgaacattttgccataccatttgtatgtgataagaaattaggttagtgccatttctatattgctttttctttggtttgatacaagatttcatattatgaatcatctgtcttacaatcctgtaaaacctatcattgcatcataattggagaaaaaaatgtacagcctccttaaattcattatctctgtttatcagtggaatttattcttaaatcataattttaagcatatttaccttttccgtttataccacgaaagattctaatgtgtacaggagtctttcagaatatttatattcttgtgaaaataaaaattgctatttttaaaagtcaagacagctataacgattttcttccatttatacaaagcaaaataatggaagacacatagattagcttatttcaggctttatatgaaaacagtgacagaattgtctaaagaaaacaaaaaccaaaactcctgtcataattgattagtctgtaacattcacataatcatcatgaccttttaaaaaacaggaaaaaatcactcagctctacataattggtaaattcagagaaaactaaatattggggtttgtgataactcattactacaaattttaaaattcaaattccatttttctacagttttttcataatacagtgttataaaagagtaaaccttatgtatttaagtgatcttgctttcattaacattgtatttttcctaatattgagaggattggtctttaagcaaaaattacatagtttacctaactaataaaacaaaaaggtcaggttcagtgactcacaactgcgatcccaactactcgggaggctgaggtgagaggatcacataaagccaggagtttaagactggcctggacaacatagcaagaacctgtctatcaaagtaggtagataggtagagagagagggaggatagatagagagagagagattagataaataaatgatagatatagacctgtaatccctgcactttgggagtttgagcccaggagttcaagaccagactgggcaacttggcaagaccccatctctacaaaaaatacaaaaattagcggagcatggtggcacgtacctgctacttggaggctgaggtgggaggattgcttgagcccaggaggttgaggctgcagcgagtcatgattgtgccactgcactccagcctgggtgacagagcaagaccttgtcctcaataaataaataagaaaacaaggattaaaagatggaaactttctaatactggggttccttatccagggctaatttatcctttaggcatagtaaacgtgtgccttggaccaagatacatataggggtccacagaaatattttcatttttatttcttttaaatcagaagtagtaatgtatatacatgtatgtaatagcaaacctatacagtattttattcgtgtttatacagatgtacagaaaatatagtcataaatgtatagaaaatataatatttaatagtttttgtggagtaagtgccttacaaaggcaaaagggcctagggccttgggaagtatgatgcagccctgcttttccttcttaaaggcttccttcctaaacacctttcatctctttattttattcttttcctacaccatgatcttatgaatacttaaattcccaactgattgctatgtgtattgaagcataatatcacaaagtacataaatcagaagtgtatatccatgtaagtgtacacccagatggaaaaaagaagtaatttttttcagtgacattattgcattgtgacctcaagttcagagcaacattctgtgcccctagaataccgtgatagctgctaaactagtcaggaattttttgttttcaggcatgcagtggtgtaattatagctcactgcagcctcgagctcctgggctcaagtgatcctcccaagtagcttggattagaggtttagccaccacgcccagcactaatcaggatttaaatattaatatttaaggtgtatgaaatgtgcagataataaaactgttttcccagctttttattaacaaatactcccttctgaggcagtgtttgaattactcaattagagaaatttttctccccacagctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaatagtgtgttaagtgctacggcagcaaattgctacatgtgctggatatctcttgttttcccctccagctccactctgctcttgcccacaaagctgacccgaatggaccacagcagtgggctcctatgcctcctggcttctgagtgggtttggccaaggagtgtcctggccagagatcagaggatggtagggtgcctattctcggctcttctcctggggttggggggctgccttagcagccaaaggtcacttctcccaaactccttccctgctttccaggttgccagtccctgcactcttcctttctggccaaggatgatgtcagttctgctgctactagcctggagttgcagaagctactgtgcttcctctttgggtagcctatacctatacttatctcctcataatatcttcatgtaaagaaccatctgtttcttattggaatcaagaccaataccaaggagaaattcctagggaacaaaaattccaatgaggaattgacctctttgtcagatccttatcaccaaacattagaaaagatctcataactttatacagcatgttgtaagcattttgataactaaaatcctgttctagtgaatgtcatgcagataactacacaaggagattaatttaaatttgccttctttggcaagcccttaaaccaatggctaaagcagttagttgtgagtttctgagtaggtcccaatgcgtttatttcatttgtccaacctagcacagagatcctttgatactttaattgcatggcttttccaatcagacgaaatttcagtctgagagaggacatattttctgaggtttatagttttaggattgtccaaaaggcctatgatctcttcttagcatgacagaaagagggaaagataagttaaatttcaagggggtcatatcatcacactttggtcttatttcattttcaatgatttcctagatcactttaacttttttgtgtcatggactcctcagaataatgggttttttttgtttgtttgtttgtttgagatggagtctcactctgtcacccaggctggagtgcagtggcgaaatctcagctcactgcaacctccgcctcctgaggttcaagtgatcctcctgcctcagcctcccaagtagctgggattacaggcacatgccaccacacccagctaatttttgtattttttagtagagacagggtttcaccgtgttggcgagactgatcttgaactcctgacatcaggtgatccacctgcctcggcctcccaaagtgctgggattacaggcatgagccaccatgcctggccagaataatgtttttaaatgcagaaaaggaaatgcatggggttacaagggaaacgaattacactgaagtgtaagctaccaaataatttatgatgtggtagttataggtgtgcatttaatagccagatctacgagtggatgtaataactgctatgatgttgaagtagcataaaacatatattagatatctgcaacaactgtgatgtaacatgaaaatacctgatttctgttgacaaagttactgctagtacaactgtggattgttgtctgcactcgtcattgaaggaaatactaaattttagttttaggctagtgaaattaaagttaatttttcccatccaagttcatgtatcttctgaattctatccgtgaatcccttagaggtctgtgaattgtaggttaagaacccctgccctagctaatcagatccaccaatgtttcaaataggactataacttattcaaaggccaatgatacttcgcataattcaattttaatattattcacatttcatgtcacaaatttagtaagttacatgtgttatgtgatgttttgttttgatagattatatcttactcctaaataaaaagtcaagatttttgtagcaa

SEQ ID NO: 358 - DNA, 63986 bp, Homo sapiens
agcgcgcatgctcgcggctcggcgctgaaattcaaatttgaacggctgcagaggccgagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggaggtgagtgagtttgcgggtgcagccagccatgacccaccgctctaggcccccacccaccttcctctgtcaacctctgggcgaacccccaccgggcggagggcgcgtgtgtgcgcgcgtgcgcagtgtgtgcgggccggggtcgccgcggctgcggcctgctgtggttggtgggttcctctgagattttgttgtttcggtcctacagataaaactcagggaggaaggctttgagtctgtcctaaaaggctgttgcgagaggtctttcagcccccgtttttaccatgtccctctgcagtcctggcgcagcaagagtgaggcgcaggcctgcggaacgggtcctgctggaagcagctggaatgccctgcagggcggggtccggggccggtgactcagtgcggctgccgccgggaaaggcagtaggatgtgtgatttgcggagttcacgcagcccgcaggggagatgctaatgaaatgacagcaaaacgttaaaataagcaggtgctagaaaccactgcattcgttcataaaaagccagtagttccttgagatcccattgttcagctaactaacgaagaagttcatacccgggactgaccattttaattgaaacaatgcaagtgtaccgagcaaaactatcagctcacgattttagagcaaagaaataaacttttcggtgtttctggggcatatcattacagtacttatttcatcttttgttcctttgagattgcatatgggttacatggttattgtgtcgatttctctagttttagcttttgtggagaatgtgcgttgtcacattcaggagtgttttgttgccagttgtccactctcttttattccaggacagttcctctttctttaggctgttgtgcaaatttcaaactgttagtttttgagtgttgcaaagtggacctaaaactgtttacactgattcaaaaacttaaatgctgtgaagagtggtaattctttcggggagatgtaattataattctataagttatgtatgagatattaattacagatttcagcaattagagtttacttatattcaagcatgacataatctatttttctgtttcaaattcttaatcatcttgggacaaatacatcaatttttttcaccttccttaaaggttctaatagaaaaatctagagcctatttttgtattagccttaaaatagggctggtcatgcaccaagtatctttcacttacactgaggtcgaaaagcgtgtatttattttatctaaactagaatacgattccttaaaacattagccctatgtgtcttcctaagtaacagacaggaacaaagcatttttaagttggctgaaaattgcacttcattttacttaaaaatgtcattctgaaggtagtacaaatctcaactgaaagaaactttacctgtttagatcgttttaggatgtgctcagaaatatgtatggtttatattatgaaaagttagatcacttgcagttggaaaaacagcttagacgtcttttccttaataggtaatgaatgaactacttgaattgattccaactcttgggtgcttaattatagcattcataacatttgcacagtgaaatgagctactggtacagttgtctatcaactgaaagtcagtataaaatgactctctcaaccagggtttcctctcagaaccatggtacacaggaaaattgagagactattttctcaattctcccaaggataattcaatgccaccctacaaacataggaaataagtctatcatattaacgccagcgtattagggcttaattattttggtaactccagttgagaaaggttacaatcatggtaaactctcttttcctcaaacaagactgttctgcattggtcttcctccctgtggtcgctgatactgttctggcactctttttttttttaagacggagtctcgcagtgtcgcccaggtgacaaaaccataaactcactactcataacgtcaagagtttgaagctctactcacaggtgatagtcatcccagtacaagaatactacaaagaaacccagagtgaagtgtaccaatccagaactttctttataaaaaccttaaaagagaaaaagctataattaaaatacttcacagaagcatattttattgtagacgctttagatccttttatgtctgcaggctgcatataaataagtatgcaaataaacatgccactaccatttttagtggaatttctcttattttccagaattaaatgaagttccctggggaagagctgctagagcatattgaaaataataagaagttaatttatattgagtctactgtgttaaagaaggcaaggaaattagtaaaatctcctagaaaaatttgtcagagatgactttggggtgtatgtggcaaaagttgttcagggactataagcttcagttacctgagattcatacatgtgggctatcctacttcttgaatatgttattgcagtggtttttttttttttttaatgcctacactgtttgagaaaggtgtgatatttcaaggaatataccttgtatttaaaagagttttaaaattcctgatatactattataaggaacggctacttacatttattgagctattgagtttatatatttaagatatataatttcttttaatttaataacctttggtgtttatagctttacttcacagattagggatctttttttgtgtatctatttaatttttttttaatctgggaatttttgaatctaatgtaagcaatagaacattcatatacgtttgaatgacaaaatcacattcttttgttgtgacctactgctcatggtaactgaagctgtactgactcacaaatgttctaactgaccagaatggaatgtgggcatgtccacgaatgaatataattaggctagtgttgtatctgggaagtgagagatatagcaattgaaaaattacaaatttattaatttagaaaggagacattatttcttttttcttttttcgtttttttttttgagtcagagtctcgttctcgcccagactggagctcaatggtgcgatcttggctcggtgtcacttctgcctcccaggttcaagtgattcacctgcctcagcctcccaagtagctgggactacaggcatgcaccaccataactggctaatttttgtatttttagtagagatggggtttcaccgtgtttgccaagctggtctcaaattcctagcctcaagtgatccgcctgccttggcctcccaaagtgctggaattacaagcatgagccactgtgcccagcagagactttcttataaaggcttacagcctacagtgtggccatcctgacaggctgggaaacatatttaatagcttcgggcagagactggaaacaggcacttcaagagaggagaagctggaacagggatttatgcctaaagggttagccaggtatacatattcaacaggttataggcagagctatgagtatttacaaaggggtcctgatgggtgggtactgaacaaacgtgcagttacatgcatcccatgttcactttgggatgaagacttaacgtggaaatacattacagttgggccctatatgtcaaaaggtgaggtggggacatgaaggcattcaagtgagcagcctctgtaaactggccagaatcagttcatggttggtggtcttcttactgagatagatttattgaaatcaatctcttgtccaattaaagctgtagctgtagcttgtggagcaggagggttagtcagtgtctgatggaagatgagctgcaattgttttaatatttattgcttatctcaaggtcagtgcttgttcagctactagagtaaaagaaaaactttggcagttagaagatagtttattttttaagtgtagggagtttgtgacttaacccttgcctggcatggccttaggtcctagttatttgtttacagacagggtctcactctgttacccaggctggagtgcagtagcgatcacagctcactgcagccttgaactcctgggctgaagtaatccttttgcttcagccaccccaccccccaggtagctgggactacagatgtgccccaccatgcctggctaacttttgtatgttttgcagagacaggatcttgctttgttgcctaggcttgatcctgtttataatttgatatcttattgctacaaagagtcttctgtcagtcttatgatctctatttaacattaatgctcatcagttattgtgtttaaacagcaaaaggaggggtataacaaggtgcatgcggcctcctgttccatcatggctgagaactcggtttttaaggtttctctggggtccccttcatcaagaggggatctgttcagttggttgggaggattagtattttatttttagttctcatattgtatcatggggggaaattatcggacatatatggatttgtgaaacaatatgcttattcttgaatttgttgaaggacttttatttagcgggtgaaggtcttgtattttggaagccatttggttcataaattattttttcagtgattagagcatttcaatttagtgtcacttttttcaatgaactttaaattagaaatcattcttaagaagagtagagagtgtgccttctttcaaatttagctcatatttcttttacatactcagatttttaaaaaattgttactgtattttaaggaattaaaaagagtcaaatggaatttaatttttcagcctgcactaactactgtatctgagtatgcaaggcagtaataataatctgcatacctcctttagttgtgtgcatttgaaagaaaatgaattgttttacagggtcttgtgtttgagctttactaaaattgacttaaaaataggaacatcagttgatttggagtagaaaggagtattcatgactttatggaatggctaagatttcaatttaaaaccattttattatatgttaatatttagttaaataaaacataagattattttgtttttctttcctcttaggaagtgttttatgttttcaaaggactaatatgttatttatctcttgctgcttaccaccaccccagattttagtggctctattagttttgctgctgtaacaagttatcacaaatttagtggcctaaaataacatattcattattttacagttctttagagacagggtctcactctgaaatctgaaatggattttactgtgttaaaatcaacatgtcagtggaattgtgtttcttctggaggctgtaggggagaatctgtttcctaacttttcttgtttctaaaggccatctgtatttcttggcttgtcctgttcccccatcttcaaagccaaaaatcacattactctgacctctgcttccatggtcatattttccctgactctgatcttcctgcctctgtgttttccatcataaggacctttgtgattatgttgggcctgaccagataattcaggattatctccatctaaagattcttaatcacatcagtaaagtctcttttgctctgtaaggcaacatattcagaggtttagggtattaggacaaaaaatctttgagggaccattattttgcctaccatagtggcttaaaacaatactcttatttctcatgattcagtgggtcaacaatttgtattgtgctcagccgggctgttcttctgcttgtctctgcagtggtcatgcaggaatcttcagtgatctggcagattatctggagctggatggtctaaggtggccttattcatatgtttggtagttgatactgaccatcacctgggccatgtgtctcctctagtagacttaacctgggcatgttcacttagtggcagagagagagagagaccccaaactgtaaaatctcttgatgcctaaaagtctcacaatatcacttgtaccatattttattggtcaaagcagatcacaaggccagcccagattcaagggtgaagaaatagattctgtcttttgatgaaagcagaaaaaatttgtggccgttaaaaatcttatataactaactttacatattttattccttctgtaatattcctgtaatagttatgacattggggtactcatttagtgaatcttgacataattgcttaggatttcacttttgaaatgtgtttaactgtcatcctgtatggcaattggtgattttagaagatactgcaattttatgaacctttgattaaacttgtgttttaacactgatatatttatttatgtagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaaggtaaaagactttgtggggaaaaataacatttactttttttttcttttgaaggagacaagccccaaacatttcattagcatatagaagaaccaagctctttgggagacaaatgtaacagcctctgggggaaataacagccttctattctatttcagagttattatattaggcctagaacctatagggttggaacggtttcttctaaaaaatattttaaattaattgattgaactttattttcttcattctgaagttatccttaaaacctcaagggaagaaaaataaaggagtagggtaacatttatacttacagtagtgtgtagtttttttatcccaggggtggcagaacagctggccactgagtttgggtggtgtctccggtaccagcaaggcaatggaaggcacactgcccatgcttgacatttaatgaacccttttcactctctatttgctgaaccaactctctaaagtttaggttgttaatctccagaagtggtggaattaaacacaagcacacacacacatacacacaaacaaaaactcacctgtagtcttactctttcctcaatcctaggattgattcccagccagcatcagacagcctccttagtcttttcctggagtgtagaatagtctggagataataatcttccttagtacgactgtaaaatactgtaatacaactgtaaaataaaatatagaaaaaattacagagggcaaaaccaatgtttttttaaaaaaaaagaaagcagagaagtgtacatggggctagctcagttattttggaagctaatcatagaacaagaattagttttcatacgtttatccattttgaagggagagtgaaggaaatacattacatattatatggtattcagccaggaaaataggggcctgaccctagtccaggatcttcgttttcactgtgagatgggtttgtactattgagtgctatgtatttgaaaccagtgttacctaaacttctttaggtagaagttcaaaactacatttcgatgtttaggtagaagttcacatttactgttttagataattgtaaactagaagaattctgtatttccagatggtattgcatgttaaagcaggaacactttcaaaaattattagatgtgttcatagaaaatagatcgataagtgagttataaaacattagaaagtttcaaaaataaaaaaaggaaaagaaaagaaaaaagagccaagtgtagtggctcacgcctgtaatcccaacactttgagagactgaggtgggcagattgcttgagctcagaagttggagaccaccttgggcaacatagcaaaaccctgtctctacaaaaaatacaaaaattagctgggcatggtggcacatctgtagtgccagctacacaggaggctgaggtgggaggatcgcttgagcccaggaagttgaggctacagtgagctgagattgcaccactgcattccatcctgggtgacagagtgaggccctatctcaaaaaaagaaaaaaagagacataaaagtggagtggggaaaaaatagattagaaagtttcatgatgtatatttacttaggttgatgtcaacgaggcaatcatgatttatccctgatactactttggtcactgccagaacatttgtttaggcagttgatgaaactgacctcatatgaaatgtaccttctttgaaaatattaattttccaggagatatattgaaactcatagttagaaataatatgccttatggttctgatagattttttttttttaattttagggctttttcagttattttataggtgttcatagaagcttgaaatatgaaatgttaaatatttgtactggtgaatttgtttggtattgaccagataattcagtcactttttctgtctcctgtcgtaatcctaaacctcaagccaattgcccttctaaccatgcttattagttattttccatgaaagaatgtttcaaaaacagaaaacctggtttctacacttggctcagctgtgtgactttaggcgggcaactgaatttctctaggcttgatttttcttatctgaagatgaggtgattaggctgtataatccttaaaatctgttagaatgctttcttattctgtgtgtatgcactttttatttactattgtcttaacactatataaagtgttatgcatatattttgaaaatatgatttaaatatctttatttttatttttccataagttattggggtagaggtggtatttggttacatgagtaagttcttcagtggtgatttgtgagattttggtgcacacatcacccgagcagtatacactgcaccatatttgtagtcttttatccctcgccccccttccgctcttccccccaagtccccagagtccattgcatccttcttatgcctttccatccccacagcttagctctaaatatcttttcattaaggtttttataatataaattgtgtctgcttgaaaagatctttcatatcagatttctaagttgctgaaagagaatggggttttacatacttctggttgtaactaaaatcatttaaaagaatagggaggggtgatgttttattaatttgttgagtatctaccctcaagtttttcatgtgagaaattacaaatttgaatgtcttttttcatcgtttttaatgtagagaaatcttgtacaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacaggtatgaattgtatagatggtatggcccatacatctgttccaataagattcagtttggtatgttgaacattttatcagttaactcatgaaaaataaatgcttttgttttatctatatgttgagtatcctttgcttgcatatggtttgtctaccagtagtataagttggttatgtttagactgaagtagatcacgatgtggttcttggactagttcatagaaacctgatcttataactgtattaccttaatatctgcaatgaaaaacacttgagaacaaactatacgtgttgttagcattgctgaccctcagctccatgttaaagaaatcctatttcatggattcaaaaattaaataaacttgagggactaaggtatgcaatgctgttcagtaggggagaaataaaatgtcaaaaaacataaattgagcagctgcaaagtatattattacacacagtgctagaaatgaatgaagtggcttgatccttacctttcatgagcctataatcggaaggggaacctgagaagtaaagcaacagttatgcaacagggttatttatggtatgatcaatttcacttatcgcctgccttgttacaaaaaaaaaaagctttgagatgacttataaaaatatctgtattttgaaaccagaaaaatgaagtcaaggtgaagagaaaatacgggaagggaaaacaaagaagtgaaaagtaaagtcattttattaaatgcagactgtaaagtcttccttttgctagaggcctatgcgaagacatgaaacagttatcagttacatgactaacaagctaaaagcagaaccatctttggcactaagacttgcaatttggcagtaagagctgagagaactttctttcatgtgtccttaaatatgactttgtgggagccgataaacctataaggtttcttaaggcaggcagatgtcctggctccaagctcagtaaaagcatttcttttttcttttctttttttttgagacagagtctcactctgttacccagtctggagtgcagcagcacagtcttggctcattgcgacttccgcctctcaggttcaagcgattctcatgcctcagcctcccaagtagctgggatgacaggtgtgtgccaccatgcccagctaattttttttgtatcttttggtagagatggagttgcaccatgttggccaggctggtctcgaactcctgacctcaagtgatcacccgccttggcctcccaagtgttaggattacagtaatgagccaccgcatccagcagtagaagcatttctaaagtgagctagcatagtgcaggtagaccccacggtgcttgcagacagctcagtggctactgggcctcacccaaggaagcattccttaggtggttctcagcctggctgattgtatcagaatcacatagaccataggattagaatttcagaaatgtggtggagctcaaagatgtgcttttgtcttattttttttaaagctctttaggtaattctgatgcatagccagaattgagatcaagtgatctgaagaatggggcttggatggttgacagatattttagactggattaaaccagatggactacatatatttcaggcagtcttccatacatatcagttcttttaactgaaatgttgataagaattaggcagcagagagtttaagattatgttttctggaagtgatgataataatctcaagagcaaacagtatgtaaaatgctaggtattgcaaatattttttattctaatataaatttttttattctaatagcgtttaattcttataatcttgagatatataccacttttatcttcattttatagaagaaggaaactgggttcatagaggctaataaacctgtccacagttagccagctcaaattcaaatcccaatggtttgactttagagctcttaactcctgtgacctgcctgatgatttttttgtttttgtttttttgagacagagtctcactgtgctgcccaggctggagtgcagtggcgcaatctcggctcactgcaacctccgcctcccaggttcaagcagttctcctgcctcagcctcccgagtggctgggattacaggcacatgccatcacacccagctaatttttgtatttttagtagagatgaggtttcaccatgttgtccaagctggtcttgaactcctgacctcaggtgatccgcctgccgcggcctcccaaagtgctgggattatagacgtgagccacctcggcaggccacctgatgttttttggcacatagcatagtctatggtgtcaattaatacctatttattttagcagtggtgaggtaagaggtaggactcgactccagatgcgggacttggacactggacaagatagagaaataacaacaacaacaaacaaataaattaaaaaaaaattgaggactagctaaaacagggcctgggggaagcagctttccagtgacatgcccaccagtgtgccatgtcaattcatcattgccatggcaacacccaggagttaccacccctttccatggcaatgacccaaaagttactatcccttccctagatatttctacataagctgccccttaatgtgcatgcaattaagagtaggtataaatatgattgtaaaactgccctgaactgctactctctgcctatggagtagccctgctctgcacagggaatcaacagagctgtaacattgcctcttcaataaagctatttttttttttttttttgaggtggagtcttgctgtgtttcccaggctggagtgcagtggcacaatcttggcccactgcaacttctgccttccaggttcaagcaattctcctgcctcagcctcctgagtagcagggattacaggcacacgccaccacacccagctaattttttgtatttttagtagagacaagatttcaccatgttggccaggctggtctcaaactcctgacctcaggtgatccacccgcctcggcctcccaaaatactgggattacaggtgtgagccaccgtgtcctgcctgcacctaggttataatactagccttctaactggtcttcctgcttcagacctctgccctgtccagtccctcctcaattttcacaccagcgcgatttttctaaaacacttgcctgcttctgctttaaactctcccaggacctccccatcacctcctgattaaattccaatctggacctgctctttttcaaacgtatctctctattttgacacattcagaatggaaaaaaaatgtaactcttgcttttctactgcttgctttaaacaccagaataggatctacttatacacacactctgctcatgttacttacctctgctttctatacatttttgtttttctgactagattatctccattctctgaagccagttgtccttcagagtccagcttaaggagtctctccctcctccagaaaagcctccctgaccaccactttacctgcaataccctttatatacttctgttattttccctagaataaacactgtcctatcagcagatgacagttttattgtcatattttaggaatgggcttaataagacctctagctcttgtaactatactctgtggtgcatgcctgtaatcccagctacttgggaggctgaggcaggagaatgtcttgaacccgggaggcggaggttgcagtgagccgagatcgcgccattacattccagcctgggcaacaagagcgaaactctttctcaaaaaatataatataatataatataatctaggtgcaaagagtgaaggcctgtggaaatgaagaggagaagctggatttgagagatacaggagacaaactctaagacctaacgactggatggtggagggagaagggaggaagaggtcagattcctggcctcagtgactgggtagttagtgatgtcttttcctaagatgaggaggaatatgttcggggcaatttcaacttcacatatgttatttgggatatctgtgggagagccaaatggaggtatttggtagttgcaagactgtgaaggataagccaggaaggatagtagagaatgatgtcacaaatagaaagggagtgatatattttagagatgtcaagaaatacaaagcctgcaaagtgtgtactggcatctagtgacaatggcaaaaccaacttcagggcagtggtataggcagaaggtcagttgagtgagttaagtggtgcgtgaatattgtgcagggaaagaggggcggtagttaaagaggatgtatatcaatgaggggatgtttattttttttgagacagggccttgcctcattgctcaggctggagtgcagtggtaatgctctcagctcgctgcaacctcctccacctcccaggctctagcgatcctcccacctcagtgacccgagtagctgggactataggcgcatcaccaagcccagctaagttttgcattttttgtagatgttgcatttttcgtaggttttgccgtgttgcccaggttggtcttgaagtcctgagctcaagcaatccacccgccttggcctcccaaagtggtgggattacaggcatgagcccaccgctccttgccgggatgtttgtttgtttgtttgtttatgagagggagtcttgctctgtcaccgaggctggagtgcagtggcacgatctcggctcactgcaacctccgcctcctgggttcaagctattcccctgcctcagcctcccgaatagctgagtttgcaggcgcccgtcaccgtgcccggctaatctttgtattttagtagagacagggtttcaccatgtcacttaggctggtctcgaactcctgacctcaaatgatctgcctgcctcggcctcccaaagtgctgggattacaggcacgggccctttgcaccttgccagtatgtttatttctaaggtgagagagacttgagcatccagtagtctccccacttatccgctgggtatatgttccacgaccaccagtggatgtctgaaacctcagacagtaccgaacccaattgccatcattcacaccatctttctgtgcatcttccacctggaaatgtaatgccttttccatcttaactaagcacttacacacactgtggccataactttcatagtttgaggtacgacagcaaaactccatgaatttcttttatcttcctcacaatttcatggaagaagattcatttttaccatagatcttagcaacctcagcgtattattttctttccttatttagttgagaactttcaccttttgacttcaagaaagcactttatggcttctcttaggcatatctgaattgccagcaccactgctactgctcttgtgctttggggacatcattagggcaaataaaggctacttgaacacaagcactgcatactccagtagtcgatctgataaccaagacggctataaagtgattatggggcgggtggcatatacagtgtggatatgctggacaaagattcatatcctggtcagatggtgcaagattcataatgctactcagaacggtgtgcagtttaaaaccatatatgaattgtttatttctggaattttccatgtaatatttttagacaacagttgactgctgataaggaaactgggaaagtgaaactgaagatagggcgtgggctactgtatggtcatataccacatattgacgttttgatcagtggtggactgcatatacaatggtagtctcattataatgtatttttactgtactttttctatatttagatgtttgcttaccattgtgttacagttgcctgcaatattcagtagagtaacatgctgtacaggtttttagcctaggagcaacaggttttaccacatatcctaactatatagtaggctacaccatttttgtggatgtgtgctctgtgatatacagatgtacacataacaaaatcacctcatgatgcatttctcagaatgtatccccattgttaaacaactcatgactgtgcttatgtgcagacaagagtttgtagagaaggagagggcttatttcgagcaagatccctgagaaggttttggaggggcagaattgaaaattcagcagaagtagaagctttggacaggagggattcctctttccttgattgaatttgtggagtaggaagtgctatgaaccttggcttccctatatacatgccctagggaaggcctagaatcttcgtcagttaaatatcactatttgggatttctctccaaatgaagtaactatgcagaaaaacatttggttgtttttgatttgatctaaccctatgctatccaatacagaagacactagccatatgtggatgtttaagttaattaaaatgaaataacatgtagtttattagctgctctagccacatttcaagtgctcattagtcacaagtggctaatggttactgtattgaacaatcaaacattctgttgtacagcaatggtctaatccatttttaaaacaaaaagtttctgtgagatacataatcttaaattgtgcaatgttatatataccaccattaattcattctaaaaatataacctatcttattcatgatccattgaaaaatggaaaaaatagatctaatagtttttttttaatttcggatttaatatcatttgatttaaaaagatattgtcaaatttaaataacttggaagtttcatgcatgctagaacttttcactggttcttaaacctattaatctcatttaaaaattcagcatagagtgatcctggtattatacgtaagcattactcttaaacatggtttttaactcttttctgaaaacattttcagatgacattcctgaaagctcactcttctcaccaatgccatcagaggaaaaggctgcttcccctcccagacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtggtaagtcagtatcattttggtctttggaagccttttcttttttcgttatgagtggtataatacatctgtgtgtatgtgcaggtggatgggtggatatatgttttataatagatgcatagtgagtttatatgtatttgtaagatatcggtttcttagaaagtgaaaatcgttaagttgggtacccatcccaagatcaattagcagttgacagctgaagttatactaatttgatgcaaatccagagtctataatggaatgatagagcctcttcttagtcattaaggagagcactgaaaattaagtcctctgttataatgctttaaatatatatatgagaaatttatataaatttatcaaatatttctgaaaagatatataacaaaatagtagctatagttgcctccaggaaggcaaattgccaaacagggtgtgatactttcactgtatatccttttgaaatgtttgaaacttttactttgtgcatgtgttacctcaacagttttcaaaaaacaatcttaaataaaaaggaaaaataatttcgtgtttctgaccattgtcttttagtgtagagctaggctttagaattagacctgcattgaatcccagctgtactacataattagaagtttggctttggacaaggtgcttaatattgcagggctttatttttctatgtgtaaaataggaaaaaaaggttatttggagggctaaataagagtcataaagcacttagcatagtacctggctatgtataagtagttaatctattaactatgaagtacatgatactattttgttaaatttttattgacttaattaaaatgtaatttggtctaatatagttaaaaatttgataaaggtactagtgcaataatatgaataaaactttttttttaaataaagagtgatcatactgctaatacttcattacccatgagtatattatgcagactaacccacatattatgatttaaatcatagcattttttaagttggttttttttcccaaatctttcaaatttgtttgatctattagagagcaaaatcatttcattttcataaatcttacataaaggctatcaagtaaataggacttgaattgttttgttataggactatttttagatattgtgaatgttgtttaccctaagtgttttcatgtttcagaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggttacgtatttataaaaaatttagttattgctgattatattcaggatatctattctcagcattttaaatattcaattgtgaatggtacagcaatgatttgccagggccaatgcctgaatgttccaaatgagacctcagctttagttgattcaatgaatatttattaacgtagactagcctacttactggttaaaggacttaatatgttacattttaacagtttaaacatgctttttccaggatgatcatgctagattttttttctatattttttgattcagacaaagcatgtttaactggaaatcacattttaggggcataatggagaaacattcttgtagccaagtgtgcagagcagtgcttctcaatcttgagtatgaaggcacctctaatagcagagggaagtgaatgtgcatgcaaatgactccacttctaattttatttatttactaaattgataaatgatagaaatttttgaaaaaattgctgtttattgataaataatagatgtatatatttcgggagtacatttgataacttaatacatttatataattcgtaaagatcaaatcagtgtaacgaggatatccatcaccttaaatacttgtctttatgctagaaacatttgaattcttctcttgtagctattttgaagtatacaatagattattgtaaactatagtcaccctactgatctatcaaacactgggtcttttttcttctgccaaactgtatatttgtactcattaatcaacctctcttcatcccccagttatatttatctgtgtgtatattgtgtgtgagcatttacatataaaacaaaatttcttaccatcgtaaactgatactccaggaaatgccatatttatcttgtggtgatttataccttctggcacacttccacgtactgttaattgagaaacacaggactaaaatatatggtaattgagtttattctgaactgtattcattttcattggaaagacttttaattctaaggtttaactttttgaaaatacaacctctgcagaaactatagttcatcataaaggggcagtaaacagaaatgagagtggggaagcggttatggggtaggtagaaatctgcaatttccagttgagccagaatgagaattggaaacaatagcaagatccccagatggaataggactagttagtcccaattttctaaagacttaagcttagataagaggcattctttttaattgttcttggctactggatatacccagaatcacatttccagggtttcagagatatttattttagatacttcattgtattcttaatggactctagtttggaatatggcctgaagtagtaataagtgataggtgaagtcctcaaattatggccgtggctcaaattctgccctttgcttgtttttgcaaataaagttttattggagcacagccacacccatttacttacatattctctgtggttgctttcattctgtaatgcagagcagaatagttgtgacagaggccatatggcccacaaagctcaaaatatttagtgcctggccctttataggaaaatatatgctaatctttgatatagataagcctatttttttataatacaaccttagaatcctcttaatgggagtgatataggcccaatttgccctactttaaatttacttcatactatttcaatgagtgctgtggggttttttgttttgttttgtttgctgttttttgtttttgagacagggtctcactttgtcacccaggatggagtgcagtgagtggcatgatctcagcttactgcagcctcgacctcccagattcaagagatcctcctgcctcagcccaccaagtagctgggactataggcatgccactacaagtggttaattttagtattttttatagagatgggattcctccatgttgcccgggctggtctcgaactcctgagctcaagagatccacccgcctcggccacccagagtactagggttacaggtgtgagccactgcaccccgctgaatactattttaagacactgtaaagtcaaggtgtccttttgataaaatgaataattcctaattttccttctgaaggaaaaaaaggcaaaattcctttattttcacgttaggcttcctaaaagcagggtaaaataaattgactatagatatatgtaagttgttggaagttaccatggccagcacacttcgtgatgaaggtagatttattaatatacatacagtcaatttctaattatttaaattctggttgttcagtttgagagttttctaagccctactgccctctcctcattctaccttttcaaaatttttttttttttttaaataactaaattctatgagtaggttttagggcatgtacttaaatagaatagtaaactttttaaaattttgaagtatttttatagtctactttgtgaatgaatattcctgatagaatcaaagcattttgaagctgtaatgtagtttagaactttttccatagaaatcgtaataattttttattttgaatagcctccaaaaatgtgtgtgttttctgtaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggtatggtgtactgcatttaacattattcatcacatggtctctgcatagaacctagaaatcaaaatgggttctgatgccagtctttttgactgagataagtagcatcttggttttctgtatcactaatttcagacaagattgggcacattcagggtggtatggccgtagacagtatcactcatctcaaattagaaatattgtcctgaattccatgtgtattatgaactttttaaactgaaaactgtttaaactttttaaacagtttaaaactgcaaacaaggaaaattttagtagtgtttggatgttaaacatgctaccggctcttgtgtaaaatacagcttttgatgggtttaggaacgtcaaaaagaactagcatgtcttcgtggccgatttgacaagggcaatatatggagtgcagaaaaaggcggaaactcaaaaagcaaacaactagaaaccaaacaggtaatgtaaacaagaaatataaaaacgaacttggtccccaaatagttgggatctaatttgtagttctgtattggcaaataattctttacacatttttcttttccaattaactctgtcacttttcgtttataaatcccttaaatgtgtgtaccaactcttgcttttcttgtgatatttttctatttcagtggaactcttcaccatattcattgatgaccttaaaatcaaattttacaaaaattattttcatcattcatttgatttcagagtctacttaatattccacttagatggtggttctaaaatatttcgagagtctacttttctcaatgatgactgtatacctttccccagataccatgtctttagactatctgggatcctttcagtcaccacatacctcccacattgctctttattccggtcaaagttcattaatcagccttcaacaaaatctctacaatgtaagctgtgttctgtttaatttacatgtctacaaagtactgtgttaggatatgtttttaagctaatagaattatatttacagtggggactaatagaaagtaaaataacagtaaatttaatcagtattctttgagaaagatctacttgattgatttgttttttatcagttcacttgcttaacaaatcacatttcccagagttctgatctcaacctttttttctcagttgctctggaacatctcttccctgtccacatacctagattccgataatcactgaaatgctgatgatgctcagctccgttgtgctgatatctctcctgagctctaggtgtggttggctagcaaagcctgctatgctttgctgtagtatcttccccttgtagtctctgtcttctcttgttggtttgctctataccttgtcatctaaaacaatctggaagttcttccttgacttcttcctcttgtttactgtgtcttcccttctgcttgcccctagcacacatatgcataaacacacacgtgcagtgataagttttctaaatctgtcacccacctgcctcgtcttccatattttcctctgctattaccgaagttactgctgtagctttgtactgaacatcctgcttctagtctcgctaccctccagtccaccttatcagttgctgccagagaaatatatatatatatatatatattttttttttttttttttgacatggagtttcactcttattgcccaggctggagtgcaatggcacgatcttggcttactgcaacctccacctcccggcttcaagcgattctcctgcctcagcctcctaagtagctgggattacaggcatgcgccaccacacttggctaattttgtatttttagtagagatggagtttctccatgttggtcaggctggtctcgaactcgtgacctcaggtgatccgcccgcctcagcctctcaaagtgcagggattacaggtgtgagccaccacacccagccgagaaatatttttaaaagacgcatattcatgtattcacttgcttaaaatcttgaagtgctcctcatagtcatcatcagaaaaaatgcgtaaactgcttggcttgacatatagaatgattcctcacctggctcctccccactgctcctccacaggtatgcttcagtcctgccatgcaggctatttgcagtttctcaaatatacccatgtttttatatctctctgcctttgccttctgttctctgccaggaatatttccctggtgagctcctacttcattaagaataggtcaaactttaatcccctctaggaattcttccttttctcaaagtgtcccactttttttcacccatgtcatcctgtgtatacctcaactagaatatttatcttcctgtgaatgttgtaagtttgcattccaccactgcctatgggagtcttctccacctctgtgtccttagtgcctggctcagactaggggctcaacaaacttgtatttgaaggaagaaatgcgtttgctgatccttcccatcagcatataacaagctattatctgccatctgaaaaaaaaaacaactcttgcaacccattcccctccttttctttgcctccatgtcatgcagactcttctacaagttattcctacttgctgctttcaggtttcccccttctctttagaattctatctgcttaagctttgccaccactccttccacgactcagtatcctaatcacgtttgtcagtgatcttcacctactaatcaattttcagttgattagtagcatttgacattgtcgatcactcttctgttgggagcgccttctttacttggttgccagtgtatcatattctcatggctttctgccagtgtctctagaaagtatagagcagggttcttaaactattttgtactaaataattcccaataaacctgtgaaattcctcccagaaagttgcacatatgcatgtaaacaaaattctgaacacagtaacagtgcagagcactcatctgtggtctccacagactaagcagccaaagagctaggaggaaaatgtagttgaaggcagtgtctttaaagtcaaggggctcggcgtggtggctcccgcctgtaatcccagcactttaggagactgaggcaggtggatcacttgaagtcaggagtttgagaccaacctggccaacatggtgaaaccctatctgtactaaaaatacaaaaaaaattagccaggcctggtggcgggtgcctgtaatctcagctactcaggaggctgaggcgggagaatctcttgaacctgggagtcggaggttgcagtgagccgagatcgcaccactgcactccagtctgggcaatggagtgagactccgtctcaaaaaaaaaaaaggaaataaagtcaagggaagaaagaaaactttcgagaaggaaggcatggttggtattgttacgtttcaaatgtgggttaagccaaatctactgggttttgaagcaagaagtttgctgtaacgtggcaagagcagtgttagtgaagaggtgagggtggcgtgcaggtggtgctgtgtcgaggagggaacgggcaagaggagcagagccagtgagtgcaggcatttcttagtttggtcctaatggaggtgataaaggaggtagtggctagaagagatgaagaaaagtatgatttgtatgtgttttgtcctttctgagacctaagtcaatttgtgtgatgggataaggggtgataattgatgggatgaggtgagaatggatgaactccgcacagtgaagggaacagaactgatgaggacaatctcctgtgtgacgaaaaggaaggaggaaagtagcatgtaggggtgatggtagtcttagagttaggatagcaaaaactgatggactttcttctgaaagctcctgttttattcatccttaggaaagggaaggtgacaggggaaatactgtatggaggaaagaagagagagctgactcagacataggaagaatagggggtagtattgaggcttagatgagatatgagaccgtagattttatagtggaaccatttgatcgtttactttgctttttgtgtttttaaaaaatttttatgtattttttaatccactcatctgcatgctaattacattgtttttacacaaccaaagctgcttctaacttgagagacaataaagtctggaactagacctggaacaagagtacctgggtttgtatactggctctgccagtcactaactgtgtgcaagatacttaacttttttgtgtctcagttctctcatctgtaaaatggagatactagtacctaacatagagggttattgagaagattaggtgaggcaatagatataaggtgcttagaaaggtggctggcacatattgagctctgtataagtattagctgcctttattttactcttatttgattatttctactatgacttcattcataaagtcttcttttatttctttgctgaaataatctgtacaacaatataaagtctttaaacatacaaaatagtgaatgttcctcttaaataaccttgctaatgaataaaaagactcagacgagggaatgttttcttctcttctcttctttccttaccttctgatctgttttgtccttgttttctcttgctcttaccctccgggtaactgataattaaatggaatcctgatgtgtaggagctgtcaccagatgttataggtgtgggttgagataagtgacataggggtgggtgtttttccctttgtgtggctttcactttgtttttttattgttattttattttattttattttattttattctaccaaatacccagacttcaaggagaggctttcactttgattggcttatctaaaactgagccctgatatgaattttcattctttcttgccacctcctctccaaaaaaatttttacatactgagaattaccaagaatgtgaactagcactgagggtttgtcgtgttctgaacaaggctgggcctattcacatacactatctctttggttctaaggaaacttatacagaataatatttaataataatcttgtttcatttaataacatagaaagataaaatatatagttttgagaaataaaatttacttttcattcgctttttgcaggaaactcactgtcagagcactcccctcaaaaaacaccaaggtgtttcaaaaactcagtcacttccagtaacagaaaaggtgaccgaaaaccagataccagccaaaaattctagtacagaacctaaaggtcagtgtttccagattgttcatggttagtatgtagaaactcaaatgatgtttgtgtgttgattttgtattctgtaactttgctggatttgtttgttctaacgttttttggggggaatctttagggttttctttcttttttcacttttctttgagatggattcttgccctgttgcccatgctggagtgcaatggtgtgatctcttggctcactgcaaccctcacctcccgggttcaaacgattttcctgcctcagcctcccgagtagctgggattacaggcgcctgccaccatgcccagctaatttttgtatttttagtagagatggggtttcaccatgttggccaagctgttctcaaactcctgacctcgtgatctgcttgccttggcctcccaaagtactgggattacaggggtcagccactgcgcccagcccagggttttctacatgtaagatcctgtgatctgtgaatagagataattttactccttttctaattcaggtgccttttattttcttatataattgctctggctaggactttcaatgctgtgttgaatagaagtcattaaaacaggcatctttgtcttgttcctcatcttaaaggaaaagcttttaatccttcactgttgagtgtaatgttagctgagggcttttcatatatggcctttgttacgttgtgtaccttccttctattcctagtttttgagtaattttattggcactttgtttttaaagtaaaaaacaaattgcagagtagtggtatgtatggtatgatcacaaaacaaaacaaaatgatatgtaaatatgcacaccttgggggaaactggaaaaacaaacaataacctggtaatattgctgtcccatttctctctcggtgggggaaaagttaatgcatttatgcctagtgttccattattggaacgctaagcttatgggagttacttatgtcctcctgctcaaggttgtcaccaagaactgatttttcacaaaataaatttgcaacctccagcataaatgggttaagagaggacaggtgttcagggaggggtgtttctatacatttctgggtttggatattttaaaacgaatacatagttttataatcagaaaaaaaaaacacacacaagattccataattagaaaattataggttcttatatatattaatatggtctttcttaaacatttttaggtttcactgaatgcgaaatgacgaaatctagccctttgaaaataacattgtttttagaagaggacaaatccttaaaagtaacatcagacccaaaggttgagcagaaaattggttggtttttattctttatttattattaactttgcacatactataggaaataatatattgatagaagcacatattcaaattgagagtatctctgctttttaaattaaatcagaatacactgtagcttctaccaagatgtggtactgttaacagttactgctagctcacaggcacctgtgaaagtgtggttaagaccctcactgactttgacagggataggaaagttgctgccctcccacgctctgtactggtagaggggtgtttcagggaaaaactctctgggattatgttttcctctgttttcataccaccacaacaatcatcaacacagaagacttttgtgaccagttcaattcaattcaattctgacactagctacatggaagtagtgtcagatcccacaggttggggactcagtccccaagactgcctcctctccttcagataccagttgcaagtgcaagtccaggcctctcaaacttcctttttttttttttttttttttttgagacagtctcactctgtcgcccagactagagtgcagtggcacgatcttggctcactgcaacctccacctcccaggttcaagcgattcttctgcctcagcctcctgagtagctgggactacaggcgctgcccccacacccagctaatttttgtatttttagtagagagggggtttcaccatattggccaggctggtctggaactcctgacctcgtgatctgcctgccttggcctcccaaagtgctgggattacaggcgtgagccaccatacctggcccagggctctcaaacttctaaccgaccagcttcaagctgaggtttctgtgaccccctctttagcttggattaattggctcacagaactctgggaaatacttacgtttactgctttattttaaaggatatgggtgaggtatacggaaaggggcatggagcttccattgccttccctggggcgccaccctccaggaacctccacgtgttcagttatccagaagctccctgaacccagttctcttgggtttcagtggaagcttcataaagtcagcattccctcccccagggtatgaggctggatcctctctggtgaggggtgaggtgggtgtgggggtcgtcttaagaaccacaatgagaaagataggagaagattagagtcctgccgtggggcaggtgaaaggatggcaggagagttctgtttcctgtgaggcctaatgcacccaacattataacgaaagacagtaactagggatacagcagttatgagctaggaactgtggacgaaaaccagtatatatcataataccacaaggtgttagcagcccctgaaggttattatcgaaccctgccctaagtgacattaatattttcctattattgactgctgtgtgaaagggtagctctcaacgatagaaaaagtcatttgagagaatattttttgaaagtctgaagtctttggctattattctacatttgagttcttaatgcttttacttaaacccaaggtattgaatcagttttgatagacccaatattcatttctttttctttttcttttttcttttttttttttgtctcagacagagtttcactcttgtcccccaggctagagcgcaatggcacaatctgggctcactgcaacctctgcctcctgggttcaagtgattctcctgcctcagcctcctgagtagctgggattacaggcacctatcaccacgcctggctaattttttttgtatttttagtagagactgggctttgccatgttggccagacttgtcttgaactcctgacctcagttgatctgcccaccttggcctcccaaagtgctgggattaccaatattcatttcttagaaagtgttattgaagctgaagattttcttggtttcatttattagtagtattttcttatttttctttttaggaggtgcttttttttaaggcattttttcctatttagtaagaatatgaatattaaattttctttgttatgcctttaattcttaaatatctgagtcacagtgtccacctattgaaatatttttcagaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagaggtaagaaaaggctaactaaacaggcccaggacataagtaaactaagtagtattcgtatctcccctttcttttgttgacagatggacatttggctcagtagccaagggaattttgcagacctgttgtctgttctcttaaaagaaaccttaaaactcttgagtggtttccttttgaccttagatgaaatccaaagagtaacatggcttaaaaggccaggcatttgggctcagcttttgactctgccatttgctgactgtttattggtcaggttatttaagctctctatgccaccatttcctcttatgttaaacgaggttattaataatacctatatagtggagttgatgtgaacattgttgtattagtatatcggtagttagctccaaacacatgtaactaacatttagttacagctaactgctgttattagctttcaccctcaattgaataactgcagctctggggattgattcaactagaattttttttttgaagtataagtttcagctgtctttgtagttttatttattcttttatgtgttaggaacttagtttgctttgtttttatgatgaatcaatcagcttactggatttttttcttaatattaatggagaattcattgattttcacagaataaaatgaattatcatttaggatcaatgttaatatctgatgcgttttcccacagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacaggtaagaacatttctggaaggcattcactcactaagggtcatggtttagattgacataagtcgtgttataatttgtaattataatgttattaataactcatctgtataaaagtttggaataacttttgttagcctctctttcaccaaatgagagttccattctgttgtgaaatgttctgctgacatgttcaatatcagtgtcaaattctgctgatatgttcaataaaggatagtgctcagtgtgttgctggatttctaatagagtgtaacttacctcttgaagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggtatgtacttttgtggaaaggggctttggaatgtttcttgcactaggctgtgagctctgtgaggacaaagggcccagccttacttatctctgaaccctgagtggccagaatagtgtctgatgcatagaagctcagtaaatcacatttgaattcagtttatttttggaaaggtactctttttgaaaacttggaaactcatttgatattgctgaaatatttatttttaaacaagtttttcataaatatccttaaagtataactattaattggataatgatgtagtgggaaatttgttatgctcttcaaggttttttcatgctaaggaagctttttttttttgagacagcattttgctctttgttgcccaagttagattgtaatggcgcaatcttggctgactgcaacctctgcctcccgggttcaagcaattctcctgcctcagcctcccaagtagctgagattacaggcatgcaccaccacacctggctaatttttatatttttagtagagatggggtttcactatgttggtcaggctagtctcaaactcttgaactcaggtgacccacccacctcagcctcccaaagtgctaggattacaggcatgagccaccatgcctggcttttaaaaaaaatattttaattataaaaaaaaatagagatggagtctcactatgttttctaggctgatctcacactcctgggctcaaatgattcttgtgccttggactcccaaagtgctgggattacgggtgtgagccaccatgcctggccctaaggaagcatattaaaaaaaaacagtgtaattgtaatttaaataaaatgaatcagatactttctaaatttctacgttgttggatgtaaccccaattttaactttaataagtatgaattggaagttttttcataaggaataatatttatagcttaattattgtaacatgctaaatgtttttggtgcatagtcgagaaacttgagcagtgaaactaacattttgactttcatctggaaattctagaaactatccaatcaagttagttagaattaaaatttaaagtgaaaatgatgatttaaaatgtgtatattttttctcctctcattggttttcctaggaactcaataacgaaataaatatgcaacagacagtgatctatcaagctagccaggctcttaactgctgtgttgatgaagaacatggaaaagggtccctagaagaagctgaagcagaaagacttcttctaattgcaagtaagtgtgatgcacctgaaagagttccaacaaatttctaaccagggaaaactcattttgatatttagaaatctttaagtttagagaaagggcttttcctagtcatctgttccagtggatctattttttgttcttgtttttataaggtttaagaactctatgtaaaacaaattgtagtttgcatgaaaggtagaagcaaccgaaaggcatttgaagaaatgcagttgtgcagattgaatgaatgaatggatgaatgaatgaatctctatatatacacatgtacacatacattctctctctctctctctctctctcccttccttcccttatcaataaatagctaaaacaacttctgtgaattttgctgtgtgcgtatatgtggtgatgatggggcattttggggtggacagatgataccacacatgaaaactagccgaaagttgatgtattaaattataaggacttggtaaatgagcaaccaaggttttccccaaccacctaccatgttttataaagatagtgttactgatttcgtcttcgctgttacgtacagtttccatatcagtacacttttttgaatttgctctcattagaaacagttacgattttaatatttggaatattgcgttgttttacatagctgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccaggtatggtggtgatttttctagattgtgtgttaaattatgaacctcacctagattgaattgtacagaatagaaacaagtaaatcatgcataacaatgcaaagtttgtatctttggcctttaggtccttttattgagatataataaaaataagaaaacttcagatatatatagggataccaatctacacaataatggacattgctcttactgaaagtttgaatataaagttttattaaatgttggatatggtttttaaagttccttttaaaattttatttgtgtggaacacaaatttttttgtgtgtgttctggaataccaaagaaataaaggaatactgaactgatttatacacaatttattttaaaaaatttctttttgaggggaaggagggctagacataggtgagaagcaaatttcaggcatagggaaagtaaatggaggttgtgaaaggtttgagcacttttgtaggaataaggtaatttaggttctaattcttgatgttatctgattttgatggggtgtgggcagaaatttattggtaatttagtatgcgtctggaggtacgtggttattaatgacaaatggtgaagaaatagtttatgtttttattatcatttatctctgagtaacttttatagaaatacagtattttaatttcagttttgaaataacaaaccataatttacccttttgagatatgtactattagttaagaattaagggtcactaggtaaaattcaaaatcagcagaaattgagaaatgtggagtgaaattatttcaatttacataacagggagagaccttgatgatgcttatttcaggattatactgcctacttaagtcttatttagctttttgtgtctggaaagttgattttagtaattttaaaaataaattgtatataaatcagttcaatattcctttatttctttggtattccagaatgctgattagctaaatctgattttgcttgtgcttactatgtaatatgattacttcttacagatgcagcaaattactattacttaattatactaaaagcaggagctgaaaatatggtagccacaccattagcaagtacttcaaactctcttaacggtgatgctctgacattcactactacatttactctgtaagtaaatcaggcttttgatgattcgaatgcatttttctttttgtagagttgatacagtctaaagcattcaggtggcatttataatctttgaaacgccttatgcacattctttttatattgacaaataacccatctttcaatttgttgctttaactcatatgtttctatccttccttttgttgaatagcaccttttttccacatgactgtaggtattacatattttgaaatgatatatacattaaacctggaccatagatttttaacatatgccttaaatctcataatgtacttaacattcagtcttaatgaaaatacgtttatatttagtgaaacatttatttttaaataagagtcaaagtgcagtttgaaaaataattactacttttattattgaagattgtgagttgtaaaacacggaggaaaatattttggacttgcattatagggaaaaaatagacttcttaacaatttttattgactttaaagtcatagtggattcctttacttagagtcttgtaagagtatttgtagcatcatttttaatggtgtgattgaggttttctctcaaggttttacttaatgctttatttttccaggcaagatgtatccaatgactttgaaataaatattgaagtttacagcttggtaagctgataaagccttctaaaataatgaagagtatatttttcttaacaatatcagattataaattaattatgctttgggtttgtgcgtaggtgcaaaagaaagatccctcaggccttgataagaagaaaaaaacatccaagtccaaggtgagaattaaagaaacccagtaaaaatattttcatcagaagtaatagatatcatcataccagttttaatttatgtacaacttttaatgattaggaagtttttggatcagtttcatgttccaatttgtagttactatgttaaataggtatgaatactgaaaataaactgtgagtgatcatgattgtcagtataagttcctgatacactcgggctagataattctattttctctacatttacttggcaacttttataactgcttaaaacttttctcaagacttttccctgagccctcttctctctgtgttctctataccagtacttaataattatgtggtcactttgcaggcataaggttgctttccagccttcccagtctgtgttcttttcttaagtcatcattttaaaaactttttttttttagctctaacaaaaaaggactaacagtataagaaagccttaatcagggactcaagtgtaatgttttcatatttaagaattaattactcaaggactcatgtgtaatgtattcatatttaagaactcattctttttttttttttttttttgagacggagtctcgctctgttgcccagactggagtgcagtggcgtgatctcagcccactgcaacctccacctcccaggttcaagcgattctcctgcctcagcctcctgtgaagctgggactacaggtgtgtgccaccacatctgactaattttttgtatttttagcagagagggggtttcaccatgttagcaagggtggtctcaatctcttgacctcatgatccgcccgcctcagcctcccaaagtgatgggattacaggcgtgagccactgctcccggctaagaattaattattttctatgtaggaatttctcaaggttggatagttttactttctgagacataatgtttaataagaaatatatatagtaagctatcttttcttttaggctattactccaaagcgactcctcacatctataaccacagtaagtagaatttttgagaaattgagcttccttgagaaatcttcatcttacccatacagttttaaattggttaaccatttctgaaccttgagcactgtggaaaattttaacatgtactaatggggggatatccctgtaatttatgtaggaaaagtgttttctgaaatgtatttcttattgtgttaaaagagatgagtgattcatatttaaatctttgtattaaataagggaaataacttatgtttcttcttcacacctttttttttttttttagaaaagcaacattcattcttcaggtgagtgtatcttgaactatttgaaactttagaataaggtaaggaattaagcacttgcatatttacatatatataggccatcttgatttgtgaatgtttaccttgatctcctttggaataatattttctatgtgagtttcttagtaacaggattactggccagagtaggatgcagtttggttgcacctttgttaggtaccaccatagaggcaccagtcatcatgttattcagctctagcagcaggtggcattactctttacttcaacttctattgttctatagatttgttttgtgctttccatactgcagattttacttcttttagctttactgatcataactggcgttgtatcatgtcagaaatgcatctttctagttcactgggaactggaatgctgttaagccaggaaaggccttctttagaatgactttaggcctatctttttccaaaaggaattaggatggagctggtttcactcacttcctttaggctattggtctctttcttctctgtggtgcaagagagttactaagagacctgtacagagatagtttctgctgctgattttgtcaccctgcattataactagcactgaagtcttttccatgttttttatcgggaagttgctttttatgcatacatttttaggtctatatctttaaaaacacatccatcccaattattaaggagtgcttgtacctctttcattaggaaataagttgatttttccccccacatttaaagatgaaggaaaatgaggcagtttttttttctctgtggcagcttaattttcttctactgggatggggtgaggaattgttacttatacttaacaaaagtcattctgaactaaacttaatttcctcgttcttcacagtcatggccagtccaggaggtcttagtgctgtgcgaaccagcaacttcgcccttgttggatcttacacattatcattgtcttcagtaggaaatactaagtttgttctggacaaggtaatccaactttatttctaagggtgtggtgttttttttttaatcttagaaaaattagctcaatggaaatgccacaatgcttttaggtatttgaaatcttcgactgaaaacatatgttcttagaattgcacatttttgctaggtatgagtgtacctaaatgtttttttttttttttgtcttggaagtatgtctcccttttaatagttagaacttcagtggatgcttgcttattctaagtatcacttctgactaaagaagtattacttcctgcatttagatgttaagtttataattttaaaacataatatcttgcctatttccatttctttgtggttttttttgtttttttgtttttttgtttttgagacagggtctcactctgtcacctaggttggagtgcatggctcactgaagcctcagcctcgcgggctcccaccttagccttccaagtagctgggactacaggcacgtgatgccacgcctggctaatttttactattgttttgtagagatggggtttcatcgtgttggctaggctggtctcgaactcctgggctctggccatctgtctgccttggcctcccaaagtgctgggattataggtgtgagccaccttgcccggccagcctatttgaacctatattttgaaatgaacaatattttatgaatttagttttgacaagacagtgaaaggtagattaacctcttagaaaagtacttacgaatctaagagatttccttctcatacttccctttcatattagaagcttcaaaaatcagatctgtgttaacatcactattgagtctttttttcaccaagactattttaaggagtaagacaactagaggcaaattttatttcttgggttgacttctatataatacagtgataatttatattatcatgtgagatttctgtagtgcgaatatagagatgaagaagtgtaaaaattagaagccctggtttctagtatttacccttagtgatttactctttaacattgagcaaagtcacctcatctctctagggtcttgttttccagtacagaaatattagtttagcctgaaacaatctaaaattctatgaaatgctttcttttagttgatggacaaaaagcagactgtatttgaagttttgattactattaatgcatgaatgtgttttaacaagttaattttaaaaatttttgtaactttttatttagtaattcagctactttaaccagttgagtgatcctgggtctttttttctctgtctcttattttgtctgttttagataaattatgatgtaagagagcgagagctactgggctatttgttccaggaaaaggttgccattattttctttgcttgaaattaatgagcttaaaaatcaatccttaatttttgatctacatatatttgttttactaactatctttttgtttactttgaataattaaggacattatgtacattattctatcatgagactcttatagatgggtgtctttttctccactctcaatactttaaaaccttctttgaaagttttctattttttcaatgcatgtttggtgtttgggtctttttccatattctttcttctctcttatagttcattataatcctatattcacatcaatattgatttttctaggtacaattagaataccaattagtaactatatttaaaactaaaaattattcaatatttttgacctgtatactggaagagctattggtgatgttttaaataaaagcagattttttttttttttttttttgagacggagttttgctctgtcacccaggctggagtgcagtggcgtgatcgtggctcactgcaacctctgcctcctgggttcaagcgattctcctgcctcagcgtcccaagtagctgggactacaggtgcatgcaaccacatctggctagtttttgtatttttagtagaggcagggtttcaccatattggccaggctggtctcgtgctcctgacctcaagtgatcagccctccttggcctcccaaagtgctgggattacaggtgtgaacactgtgcctggccaaaagtagaaaatttttatggtcttaattggctaataggtatattgctagatagatgaccctttgcttgttaattttgaaattataatacatttagcactgaaattatactgaatataataatatattttggaagactttttaaagttttttttttgttttgagatagagtctcactctgtcacccaagctggagtgcagtggcacgatctcggctcactacagcctccatctcccaggttcaagcaattctcatgcctcagcctcctgagtagctgggattacaggcgtgcaccaccatgcccagataatttttgtatttttagtagagacagggtttcaccatgttacccaggctagtcttgaactcccaacctcaggcgatctgctcgccttggtctcacaaagtgctgggattacaggagtgagccactgcgcccatctaaagatttttaatatttttgtaaaggtcagttacaaacattctcttggttaaagagatgctaattaacaaaatgctggatggtattttttattttattttaaattcttaaaataggatttgcaaattagataaccataagaattgggattttacgaactgtgttttttactcagtattgtcacatagccagtttctacatatgtaagagatttcattaatctctaaaatgaaagagatttcaatgacatatcttaaatatagactgttcttttaaaaactttttttggctgccattttgaatcaaaatgtcacatttacaaattaaaattaaattatattcccattcacttaactcctttgaatttataacttaaatagccaaccacatgattgagtgcaaaatcaaaccactcagtttaatttgttgtgtcttttactcttgagactccttctcagtcagatacagtacgatttagaagtaaaatctggaacaaattttgtgcttttctgagtgaggaggggaagcaaatatttgttccaattgcctgggtttgatgtaggagaatatctaaaatagttaagtttgaatggtcttgaagttggtgggaaaaatttaaggccttctacactcatgtaataatcctatttaattgtcactgaaagagtatacatgtctttcctgccttgtcagatactgtcagtacaacgcagtcttggtttattttactggtgccttgaccagtaatacaacaatcacagaggttatctgtgaggtccttccagagtggaatttctgttgaggttaatccagttggtttgctctgcggatttaggacaccactgtcagtggatttccattttatttgaggctattcagatctgatttaaagcctggcatcctggaatttaaattacaaatcttagtgagtcagactttcaaaccctttctttgaatagggaatccaaaacagtcatagttttattatactattatagataaagggagaaggatgtcccaaagttcctcttctgacttaaaggaacctcataggtatttataccttttaggaaatagaaatgtcaatttaaatattattagagcaaacaattttgaagtaaaacaaccaattaggattatacagttttgggattgaagaaaatggttaggcattctggtatgccctgaactatccagtttatacctgttggccttgtgtaattattaatggtgcccctttcaccctcaaaaatatcccagcatataacacattacacagtctccctggttgtaggttatattttacagctcttaacataatctttgaagtgtggatgtcttaaaagactcctttgttaaacacaaaacagaataggatcatacattttcacacaagtctccctccacactcaactagggggaggggtagtaaacttgacgtttttgtgaatattttcaatttacttctttatcaggacaagcttctaaccaaaaatattgtctacttttcctcagctacagagtaagagggcacattttcttctcattgttctgatttttgttatcagtagcatgctctgtgctaaacaatggaattctgttaaataccattgagaggaaagagcctaaggaacttaaaactcactgtaaggaaaagcaaaaagggaatttttacaaaataggatgatgaggcatatgatgttttggttctgcattgtggatcggtttcaaatttgggcagttggaggttcatctcatgaaattagtctactgaaatttatactttttgtcttagaattccccctttaagttatctttgctatgttagagggtcaaatcattggaaactaattatactaaaaactcaaatttagacttaactaagattaatccagttgggatgccattctttttccctgggcaatagaaatgacagacacttccatcttcctttctatcttgactcagaagtcaatgttactttagatatctgtctatctatctatctatcatatatatatgtgtgtatatatgtgtgtgtttgtgtgtgtgtgtgtgtgtgtgtgtgtgtgtgtgtgtatatatatatatatatataatatatatatatatattaccattttattcttgatttcagggacaaatcattgatggaaccaatccaggccttgtataaccaaaagactagcagttggcgtttatcttttcccttcaaggcttgggtgttagcagctttatagataagggcagttctgatcataaacccacttacctttacacaaaacaggagttagcctatcccttctgccttaaattctggttctcacttccttgctaataaatgtcccttgtggctttcttttttcccccccagaatagggcacttttatctgaattaaaaatttgttcaggttgggcactgtagctcatacctacaatcccaacactttgggaggccaaagtgggaggatcgtttaaagccagaagttcaataccagcctgagcaacatagatgatgaaaacagttttttttcatcaaagaataaaaaaatattagctgggtgtggtggtacacacctgtagccctagctattcagaaggctgagatgggggaattgcttgagcccagaagttcagaagttcaaggctgcagtgagctatgatcacgccactgcacttcagcctgagtgacagagtgagaccttgttttggaaaacaataacaaaaaacaaacttgttcaggcagatatcctttttcttcactgattttcttaatggtgtctgggaactcatctcctgtctcatttggtagaagctgcttcttctgttgtatcttgacatttttaaagcctctttctaaaattatcaaaccatcctttgctggcattaaatattcaagttgaagatccttcaccttcctttaatcctatattagagtctataggtgtgtctttcttatagcaatcctgcactcacataaaaactgtattttcaatataagatcaaaatgtatttcacaaaaaatgcatctttatatttgtttacatttctcctgactgaatggtgccatgtacagtctgtgtaagttatagaaaacgtttgccaactcgtagtctaccattttgttatttgttttctatttgtttcgtctgttctttactgctttgttttccctttcctgccttcttctggattaattgagtattttggtaatcctttttaatctcctcttttggattttttagctatacttacctgtttttgtttttgttttttaaggcgttggtaggaaataatgtatgcatccttaccttattaaagtctattttgaaatactgttacactgcttcatgtaacttacaatatgaacctcacaacagtatagttcattttcccatcccagtatattttacttctttgttataaaccacacaatgcactgttgttactttttctttaatcagtttttttcttttttaagagatggggtcttgctatgttttccaggctggccgtgaactcctgggctcaagccatccacctgccttgcctcccaaaatgctggggttacagttgtgaactactgtgcccagcctcttgaatcaatttttaaaagaaacttttatatttttataaactggtccttatatttaccatttctggtgttcttccttcttgtagattgagaattccatctgaagtcattgtcctgtcaagaagaactgtctttattatttcttgtaatatagttctgctggaaatgaaatctctaggttttgtttgtccagaaatatttttatattgccttaatttctgaaggatattgtcactgggactgctaaattgacaggtttttatcttttcaattctttaaagttgttaatttattgtttatggctttaattgtttctaataagaagtcagccagccatcattcttttctgtttttttattttgcatttttaacggtttgattttaatgtgcctacgtgtagttttctttgtatttatcctgtttggtttcactgagctttatgatctgtaattagttgttttataagtcttagcaaatactcagccattgtctcttaaagttatttcttctgccctgctctctcctttctgaaactccagttaatgtagactattgactatttttctacaggtctgtgacattctttttggttttcatttaattctttttttctttgtgcttcatttttgatggtttctatttatcagttcttcaagttcacctgtttttttcttgatgtgatctaggctttgaagcctagccaatgcatttttaaattcagacttttttttagttctgaaattttcatttggattttttttatggtttcaatttctctgctgaagttctccattttctcactaatttttctccatcttttcatctaaatattttaatgttgtataaatgtttttgttttctaattctaacgtttagatcatctgtggatctgctattgacaggatttttttccccttgataagctccgtgttttcctactttttcacatgtcttgtaattttttaactgtaggccagatattatattataaaagaacagtagagactgaaataggtaataccttgttcttttgtctttcagacagtatagattagggactggtctcttatgtaatcagaaacagctgaaattaggctatggatagatttggttcaagttttgttttaaatgctttgagaatggtttcaggccccacttttgagcagaactttgagatctaagtactgcacgtctacaagatttctctctgctttttagacatgtcttcaaccatcacttctcagcaaaattcctgttggggagaattggcaggtagggagagctagctctgcctctgcttcttgagatgcctgtctacctcagcctgggctcaaccattgaaggctcaactggtttctccttttccctgcaaaatttgttgcttatggcaaggttgctcctctgctaagttgctaagaatattttcttacatgtttaggttccttttctttaaaaatacttctttttggccaggcacagtggctcatgcctgtaatcccagcactttgggaggccgaggcggctggatcacttgaggtcaggagctcaagacctgcctggtcaacatgatgaaaccccatctctattaaaaatacaaaaattagccaggtgtagtggtgcatgcctgtaaccccaggattacaggagaggctgaggcacgagaattgcttgaacctgggaggcggaggttgcagtgagccaagattgtgccactgcagcctgggtaacagaatgagactctgtctcaaaaacaaaacaaaacaaaacacttgtttttgttgtgtaaatggacatgcatgaaaaatcacctatagcaacagaaagcgtatcattggtttcctggagatgggaatacatggaggcaggattatgggagggagctttagagggtgatggaaatgttcattattatgattgtggtcaaggtttcatgggttataatatacatatatcaaaattcatcaaaccctacactttaaatatgttcaatttattgtactcaatatagttgtaaaaagattatgttcagttaattatagacaccttaagtgtagcattcagtgagttttaacaaatgaatacacctatataaccaaaacctagtcaagataagggacatttccatcactcccatctagtcaatcccagccactacaggcaaccattcttctcatctctgttttcaccctagattcgttttgcttgttcttgagcttcatttattgtttttattttttatttttatcttttaaaaaagaaaatagagatggtggggggggggtctcagtatgttgcccaggctggtcttgaactcctgggctcaagcgatcctcttgcctcagcctctcaaagttcagggattacacatgtgagccgccatacctgggcttgaacttcatttaagtggaatcaaagaatgtgtactcttttgaatctaatttcttttgctcagcgtgatgtttttaagatttatccatggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacctgggaggcggagcttgcagtgagccgagatcgcgccactgcactccagcctgggcgacagagcgagactccgtctcaaaaaaaaaaaaaaaaaaaaaaaaaaaaaagatttatccatgctgctgtttatgttagtagttcattgttttcaaaaaataatgtattgaaatgaaattcatgtaaccaaagtaacaattttaaggtaaactattcagtggcatttagtacattcacaatgttgttcaaaatacctctgtctaattcgaaatatttttatgtctctaaaagtaaaaagtcttactcattaagcagtctttgcccatcttccctcccccgagcccctgacaaccatcaatctgcatttggtttctatggacatatctattctgtatatttcatataaatgggatcatcatacaatatgtaactttttatgtctggcttatttcccttagtgtaatgtttcggaagtacatccatgatgtagcatgtattagaacttcatttctttttatggctgaataatattctattatatgtatatacagcatttcatttatctgttcattcattgatagatatttgggctgtttccgcattttgcctattgtgaatagagctgctttgaacatgtgtgtgcatgatttgagtacctgttttcagttcttttgtacgtatacataggatatacataggagcagaattgtgggatcatgtgataattatttttaggaactgctaaactctttttcaaagcatctagaccatttgatatttctaccattaatgtgggttcccattttcctacatcttttccattgtttattttctgttcgttttatttttaaattataaccatcctagtgggtgtgaagtggttcctcattgtaggtttgatttgaacttccctaatgactgttgatgttaaatgtcttttcatgtgctcattggaagacaaaatgtgtatctttgaagaaatgtctattcaagtcctttgccaaattttcagtttggtttgtctgagttgttttagttgggttgtctttttgttactgagttgtaagagttttctttgtatattctggatattatcagatatataattgacaaatatttcaaaccattccatagactgtcttttcactttcttgataaagtgctttgatgtgcaaaggtctataattttttttattatggtaaataatacatggtatttatcttttgaagaaatttttaagtatacagtgaattattgtgaactataagcattatgttatatagcagatctatagaattttcttcattttgcatgactgaaattctgtactcgtggaactgcagctcctcatattctcctccccactccctggcagccaccactgtagtttctgcttctatgaggttggctactttaaagatttcatatgttgcttttcagccttttggataaggtcaaatgtagatacttcatgataagtggagtcgtgtagtgtttgtctttctctgactagcttatttcatttagcataatgtcctcaaagtttgttcatgttgtagcatatgacaggatctcctttttctatgctaaagaatttttcattgtatgtatgtaccgcatttttttggcctcttcatttattgatgggcacttagattatttccatctcttagctattgtgaataatgctgcaatgaacgtgagagtgcagatagcacttcaagaacccatttcaatccttttgataaatacctggaagtgggattgctgggttatatggtagttttattttttcattttttttttgtggaacctctgtagtaatgaaaggtttttaattctggtgaagtctaatttatctattttttcctcatgttgcttgtgcctttggtatcatatctgaaaatccattgctaaatccatgatcacaaagctttacctctatgttttctttctaagagttttattttattttattttattttaaaaatttttttttgagagtttcactcttgctgcccaggctggagtgcaatggcacaatcttggcacactgcaacctctgcctctgtgttcaagtgattctcctgcctcagcctcccgagtagctgggattacaggcatgtgccaccatgctggctaatttttgtatttttagtacagatgggatttcaccatgttgaaggtgaaatcccttcaaggccaggctgatcttgaactcctaacctcaggtgattcacccgcctcagcctcccaaagtgctgggattacaggcgtgagccaccgcgcccagcctttctaagagttttataattttagctctcatacttaggatattatccatttgggtttaatttttataaatggtatgaggtgaaggtccaccatcactcttggtgggtgtggatatctaattttctctgcaccattttttgaaaaggctgctcttccgctttaaatggtcttggcatccttggcaaaaatcagttggccataagatgtatggctttatgtctggtctctcaattccatttcttttgtccatatgtctgttcttatgccagcaccacactggtgtttttgattttgtttctttgagacaaggttttggtcttttgcccaggccagagtgcagtggcatgatcatagctcactgcaaccttaaacttttggactcaagtgatcctcctgcctcagccttccaagtagctggtactacagacatctgccaccacacctggctaattttttcatgtttaatagagacgaggtctcgctatgttacccaggctggtcatgagctcctgggttcgagtgatcctcactccttggccttccaaagttctgggattacaggcgtgaactaccatgtccagccagcccacactgctttgattaccaaagttttgcgttacgttttgaaattgggaaatatgattccttcaactttgttcttaattttcaagattgatttggttgtttggggtctcttgcaattacatatgaattcaaggactggcttttccatatctgcagtttattgttctttattgctgggtggtattgtgtggtgtgaatttacaggttggtttatcagtctcttattgagtatattctcctgttgatggagaatagataaacccaaatattgtcgtctgttttctttctcacattaacttgagacttagggcttttggttttgtcaagctttaccttaaatgaatttattcttcaaaagtatttgttggtaaggaaccaatggctttttggccatgtcttttatactccaactttagaaaatgctctgttttcaagttgtaatagtctctgttcatgatttatacatgatttatcaagaaaaatcacactttgaacctgttttgcaaataatttacctgttttctttgcaggtcccctttttatcttctttggaaggtcatatttatttaaaaataaaatgtcaagtgaattccagtgttgaagaaagaggttttctagtaagtaacatcacttagtctttaacttccttttttccattttgtgaaatacagacttgtttcccataggaatgaaatcctttgtgattaagtaataagttggttcagtaaagatttgttttatgtcctttatatgccaatcactgtgctgccattggaatgtaaaagaccacaaaaaataattcctctgctcatgagtttttagtttagaagagagaaatacaaacgaacagacaagcacaatataatactctaataggagaaaacagggtgcatcggtgtcaattggtgggacaccaggtcttgactgtgtgtggggtgggataaagggaactgctgagagaagtaatttctaaactgagtaagttaatctgagagaaagatgagaagtgctccagatagggggagaatgtacagtggcttgaagggcccttctttgtcactcctacccaaagaaaagaagaatgacacatgcagacagtggaaggtatttcaggatagctagagcttagagtttgagggcatgcatgtgattggtgggtggggaatgaggaggaaagtgtggttaggggaaatggggcaagagttcaagggccttttaaagaatttggactttatcctagagtcagcgagttactcttacaggattttaagcagaggaaattatccaacttgggattgagaaaatcattctgaccaatgtggaaagcagattggagaatgacaacccgaagaagactagtcagttcccaccaatgtgggaaattttaatgagttaagttttacgtgatttgaattttagatgcctggaaacatgtgtgaaagttctgggtttggagctcaagacagacatttagtagaggtaaagatgtggatatctgcagcatggggaagcccagggcaagtgagggaagcagagccaactcactggaggagtgccagcattgaaaggacggatggaaggagggaagcctcagaggagactgcagggagagaaacggagaatctagcatcatggttgtcaatagaagagaacattgaaaggagggagtggttgagttagatcagattctgttaggactgttggacttattattgggtgatcattctggcgcaggtgagggcagatgctagactgcaaatgggtccagagtgagtgggagatgaggaatgagcacaggagcttggaaactcttggaaacactttggcagtgaaggagtaaggagagaagagtgttgtgcttgcagaggtatgtagggtgaaaggaggattttgtcaacattttgttaagatgggagagacgtaagcggctttaaatgtagatgggtagcttctaatagggccaaagagattgaagatagaggccatggaggacctgatctagggcttatggggtaattcatagagcaaggtcatgagaatgggaagaattaagcccaagccacaattcacaggatttatttgatacagaatttacagttttctcattatcagaggaggaaagtatgtgtgtagaatgcatagaagattgtgagtatggtacaagaagtagagaaaatccacttgctttggtgttctctgtgaagcaagaacttgaatgatgcaagggatgttacaagtcagtttgtaactgctgtcaaaggttcagaaagaagagctagatattaaggaaagcccggtggtctaagtaactgtagccaacttcccaaggattgggaattgctacttattaacagtattttttccttccttattaggttttatcacatataaatccagcaggtggcactagatagtcttggaagagtgtaaatttctgacttgaaggcagtatttgcctaatgaccttttcttttcatgtaaacatttttatattttattgttgatgcctttagcaatggataggctctgttaagatagctggtccatttgcatataacgtctcacctaattagttttttagatgggctcttaacgagcttgttagatctcttcaagtttactctgtcttgaatcctgtagcccattcttctcacattcacacttacaaaaatgtagtaagaaagagctctggattccccgacataacttctgtcctctgcctaaacattgcattttaattgcctctaccccctataaaaaattagaggtagtaatggaaatgtaagctcctcagctcagcttcctttcctgatgtgccagggctgccctggaggagggcgactccaaccaaagagacaggtaagtggttctgacagggtgccgggctagctctgcctccactgaggagcagcaagaggcaggcgctctggattggcagccagaaggttcaatttttgtggtctgtgtgatgtcacttaatttccttggccctctgtttcctcagctatagaaatgaaaaggccgtccttttcttattcctctctgattatagtatgatgtcataatagctggtgttaatcttgtttatcaaaagttaccttgtctgtttattacctttatgatgtaaaaggtgaacgttaacacaggagggagctggtgagtgatttgtgttaactttcatgcttgagattgaaataacgacattcctttctttcttccttggggagctgtaagcagtgttgcctagaaaaaggctgctttgggaggaaaatggaaggattaggggaggaggaaaaaggtgaggcaggagagcatatggttggagcaagccaattaatctgaggtgtcaatctagcttggtaacatttgctcccacacgtcatggccagaaattagactcttgattcaagccaccttttgggaaatttacataaaacagtgaattgagaagagtgtatatcctattgtcatagggttggagtaaggactagttgagataatttaaaaatacttagaggagtagttgagataatttaaagatatgcttagaatggttcctcacagcaacaaccaagtaatactagtttattcttagcttctcaacaatcagagaagtaaagttggaatatgaaggtaatctaaaatcaaacgcaaagatgcctttggatcatctgtatcagagggcagcacagcagccctcactgactgtttttatagtctttgattggaacataggctgatctgcttacttagcatctgtgactgcttctgtgccacagcagctgagctgagtagctgtggcagggaccgtatggcccaaagtctaaaatatttactctctggcccttatagaaaaggtttccctgatctacagcattgttatgtttttaccttgctttgttctttaacacagaagttcccagatgaatgttgttttttttaatttttatttatttatatttttatatatttttttgagacggagtctcactctgtcacccaggctggaatgcagtgacgtgatcttggctcactgtaagctccatctcccgggttcacgccattctcctgcctcagcctcctgagtagctgagactacagatgctcaccgccacgcctggctaatttttgtatttttagtagagatgggatttcactgtgttagccaggacggtctcgatctcctgacctcgtgatccgcccgcctcggcctcccaaagtgctgggattacaggtgtgagccactgcgcctggcctttttgtttgttgtttttttttttaaattaaaagtgagggcttctatatagattagggctctgttatgactataactaaaaaatagtgggggaaaaactcttagcttctacttaccctgtttaagtggaagtgcttccgtggaacaaaaccagatgttattagttgcctattctggagccctgtttctatccagcactactgccttgcctacctttagcatatagctagcatccctaaggacaaacgcctgatggcagggaggcaccacttcaagcgtgtctcacggcccagcagtgggcttggagttttgatgtttatcatggttattgaccaaggcttatgatcataagttaactcttttctaatcctgttagaaaacttgatctcctgaataaagattaaatgccagtcttgcatattaagataggtttaacttaatatgttatcattaattttttaaaatatataaggtatggtaattttgtattattaattctccaacacttgaggcatttctgttgtttaaggagcatttgattagggacactatactttttaaaagtcttaaagtaggtagaggtatttaatttagggttgatatctgaatgtttttaaatgcttgtagatgatgttgaagtaaatttctgatatgaataatcagtgatttttattattaagataaaagacatgataaaaaaacatacaaataggttttgagatatgaaatatgtcaacatactacagttagtgtacagaatcagcatttcattgttaggacattttcctcaactttctaaagccagcatttcaactgacttttccagaccatatttgaagatgttagtggttttggtgcctggcatcgaagatggtgtgttctttctggaaactgtatatcttattggacttatccagatgatgagaaacgcaaggtaatttatatagtactgtttagtggtgaaagccctgattgactttcgtgtagtgttcatgcaaatgttccctctggcccccatcactcacccaaattaataaccctttttgtgtactcactaagccattaaaaatgttcttgttggccaggcgcagtggcttacgcctataatcccagcactttgggaggccaaggcgggcagatcacctgaggtcaggagttcgagaccagcctggccaacatggcgaaatcctgtctctgctaaaaatacaaaaattagctgggtgtggtggcaggtgcctgtaatcccagctactcaggaggctgaggcaggagaatctcttggatccaggagaccaaggttgcagtgagccgagatcacgccacggcactccagcctgagcgacagagcaagactccatctcaaaaaaaaaaaaaaaatgtttttgttgtaggtgtgtgtgtgtgtgtgtgataatcctttaaaatttttatatcctatccattccctatgatttgaccactcttaaaataccttaacatgtatatttttccttcttttctactggatgtttaattatattttttgttgacatttgaagttggaaatgttttaaatttaattttttatcttgttagttagggtaaaacagtaatggaaacccacccacaggaacagtggtttgtattttgtttctaaaatttaataataggattttgtgtaatatatcatgtttttaaagaagttaatatcattgcccaagtaacattatttattatccccaaactggaaaatagaaataagcagaattaaaaaggaaaatcatccataatagacatagctattgttcatattttggttagatatgttttcaaacttttaaaatgtataatatataataattattcatttatgaatctttttaaaaggaaaagcatgctttttataatctgattttttacttgataaaatattctaacatctttcagcatcagtaaagataagtctaatgctgtgttggatagctatgtgtgttacactgtagtcattacaattattaatattttaaaaatttgtgaaatgtttgagacatccaaaagggcgtaaaataatttcatcaacctctgtgttattattccagttgaagctccccatgtaattctctctcccgcagagataacttctaccctaaaattgtttattgttcccatgcacttatttaaatttttattatacagattgaatatcccttattcataatccttgggatttagaggcgtttcagatttgggattctttttttttttttttttttttttttttcagattttggaatatttgcattatacgtgccaattaattatctcctaatccaaaaattcaaaatctgagatgctccaatgagcatttcctttgagcatcatgttgactctcaaaaagttttggattttggagcatttcagatttcaagattttcagattttggatgtttaacctgtacatgtatataaacaatatatgttgctgcaattgcatgtttttaaacattatacagataataacatattgtatgtattattctgcaacttgccttttttgggtcagtatggtttgtgaaatttgtctggggtggtatgtgtagctttagattgtcccctcttctctgtatagtatacttttgtaagagcacattacaatttatccattctcctgtttagagacccttagattatttctaaattgttgtatacagacaatgctgctgtgattcactttcttctcattttgttttggtttgtaccttttacagcccacatgcaggaagatttagtttcttgtacacatggatgagagttcttttttgaatgttacctagtagcagaattgctgggttgtagggtttgcacatctacaacttgattttgtcaaatgagtctcaaaagtggttgtacgattttccattcccaccaggagtatttgaaagttctcagcttttcatattcccaccaatacatcatatgtcagccttttaaacttccatcagtatgatagatgtgaaatatactcttatttaaaaaaattttgtatcttcttgattactagactaagtatcttttctaagcataagagtgtgtatggccatttatattttctctcgtatgaactgattgtctctatattattcattttaatattttttgatgcattgcaattatatttccctagtcttaggcctggcgtatcttttaatttatctttatagtgtcttttcatgcacagacttttctaatgttaaggtaatcagacctgctagtctattgctttgtgctttttagggtctaatttaagaaactatccttatcctggagtcaaagatttcttttatacctctttctaaagttatagagttttatacttcacatttaatttccctagaattgattttttttttcatctgaataaccaattgggccagcatcattgaatggtttgttctttccccactgtgttaggccattcttgcattgctatgaagaaatacccaagactgggtaatttttaaattggctcctgattctgcaggctgtactggaagcatgatgctggcatctgcttagcttctggggaggcctcagggcgcttttactcacagcaaaagatgaagtgggagcaggtacatcacatggtaaaagcaggagcgagcgagcgagcaagtgagcaaggggaggtgccaaacatttttaaacaatcagttcatgcgagaactcattcactattgtgaggacagcaccaaggggatttcttgagaaatccgcctgcatgatccagtcacctcccagtaggccccacctccaacactggggattacaattcaacatgagatctgggtgaagacaaatatcaaaactgtatcattcactgatccacaatgccatttctcatgtgtatcaagatgtcattatatgtgtaggtttatttttaggctcacggttctgtttcctttggtctgtttccctatcccaatctcaatgaccgtagctttaaaataaatcttaatgtctgctaaggccagtctcctaacttatggagtaatgtatagtagttcccccttatccttagtggacgcgttccaagaccgccagtgaatgcatgaaaccatagataagtaccagacccacttgccatcagtcataacacgtttctgttgatgtcttacacccacaaatttaatgccttttgtattttaattaagcacttaccatttactgtggtggtaacttttgcagttggagatgtgacaacgaaactagcatgaatttctttttctttcctcacaatttcatggatagaagatttattcttactgtagatcttgacaacctcagcatacgattttttttctctccttattaagttgaagactttcaccttttcacttaaaggaagcactttatggtttgtctttgcatatctactcttgcactttggggaccttattaagtcagataggggctacttgaacacaagcactgcatactacagcagttgatctttttttttttttttttttttttctgagacggagtctcgctctgtcgcccaggctggagtgcagtcgcgggatctcggctcactgcaagcaccgcctcccgggttcacgccattctcctgccttagcctcccgagtagctgggactacaggtgcccgccaccattcccggctaattttttgtatttttttagtagagacggggtttcaccgtgttagccaggatggtcttgatctcagttgatcctataactcagaacgctactaagtgactactgagcaggtagcaggtaaggcgtggatacgctggacaaagggaggatccacatgccaggtgcgatggcaggagattacatcatgctgcttagaatggcatgcagtttaaaacttacgaatagtttgtttctagaatttttcttttaatatttttcaactatggtggactgtgggtaattgaagctatggaaagtgaaaccatggataagtggggggctactgtatgactattcttggtccttgctttttccatacactgctgcacacacacacaccccctgccatcacctcatggaaatatatatacatatatgtttcacttttttcttttctttttttttgagacagggtctcgctctgttgcccaggctggagtgcagtggcacgatctcggctcactgcaacctttgcctcctgggctcaagcgattctctgcctcagcctcccgagtagctgggactacaggcaagcgccaccacgcacggctagtttttgtattttcagtagagatggggtttcaccatgttggccaggctggtctcaaactactgagctcaaaggtatccgcctgcctccacctcctgaagtgttgatattacaggcatgagtcactgcacccagccctgttttgcattttacagttgaaaatgttcaaatgtacacaaagcaaaaatagtataatgaactttcagcttaattaattattcgttttcaggtttcatttatctccccacaacacacatgcatttttgttttgttttgttgctttgctagggtgttttaaagcaaataccagaatttatattctgtcatttctaggttgcaggtcttaagtgttggcaaatgccccaagggaagtcagggtttcagactagcttactattcttcattctcccttgctcattgattttggcctttgaaggatttttctactttcttgtcaatttaattatctagcatttggcggcttatataatgggaggattttcagactatttaatgtatcatatttgctggaaacaataccatgatttatttaaatagtcccctattactgtcattgaatttgtttggaattttttgctattatgaaaaaacagtgactacacatattagaatctgtgtgtgcatatttatatatttgcttcggataaatttaggtgaaactgtaggatcagaaaatgctcattgttaatggtttttgattactgttatcaggttgcctacgagtaatagatcatattatactttcaccagtgatgcataagaaactgtattactcactccctaaccaatcaacagaggttgttactgttttttccagacttagccaatctaaggttttaaattggtatgttctatttttatttttaaaaattctaatagagttgacacacttattggctgttggctcatgtgtgcctatatgtgtttcttttcccattttcaggaccatttggtctcgtgaatgttttcctccactttgactcgtatcataggaattcatggctgccaacaatccagggcagttgtctgcccttatctttcatagatatataaagaaatatttacacatgaaatccaatgtctaggtttccttttatagaaaggggagaagtgggtaagttgtagataaaaggcacttgagtgtgtttctcattgttatagctggttttggtacctggggctcattatactgttgtttgtattttttatttgaagttcaccataataaagagctttataggatagttggcaagagctaccagttgatatttttgggttttatttttatgtctagctaggaacaataataaatgttaaatatgtttctctaagcccagtgtaactaaattttaacttttaaataatagctttttaatatttaatttgtaccaacttaaatgctgcttaatgcttactgacttaaatagtcttattttctactaatttctcttaatttgtttttaaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagtatgtattggcctataaatatttctatcaactaagcaattgattgcccactatgtacttaccactatgagaaatatcacagatggtccttgacgttgaaaagggcacagccttagtgagaaaacaaaacacacacaaagcagtaagtgaaccatctataataactaaattaatgtagttaaggaaagtataatactcaggttgtatcttagctaatgttttccagtatgctcacagtggaggcattttcatggcagttagataataatctttgggttaagtttaaagatttcatgcgtagttgaggagtcaagcattattcaaagagactttacacatcccttccttccattcccagaataccctcgtgtaatcagatgactcacagaaacaatctcattctattctgcaaatttctggatggagattaacagaataaaacttttgggagtgccccttttttaattaaccctgatctcaagtgtaagatacgaaggcttattgctaggattctaagataggtttctttgcttggatgcctaagagaagcttgaagaccaacttcagtgtacagagttgtcattagggacaaaagttagaatttgataagatgtttggtaattaggctgttgctggatattgcagatggggggagattggtaggactagctttatgagtttctaatgtgaaaatattagaaagctacagccaggagacacaatactaaaatagaacaaagttgcccagagactgccgatttgttttaaaatagctagatagaggactcatttgatggaaatttttgatgtctagattacttccagatttattcattttaactcaattatttcaggggccttctatgcagtggtggaatcagacagggcaggacaggcaaaatggatttctaatcattttgtttgatagcgacgtgtccatggtcacggtcagtggaggaaccaaccaaagtgcagtatccaaatagttcctgaccacagcggcccacttcagccattttgaatatcacttacatttttttgtataaccttattttttactggttgcgtaaactctcttagacttctccgtagaccttcccctgtgataaaaatagcagattacatgttgctttaattactctgtacctcatgtacttgtagtctttctcactataaaattataacttggatgggtacccttcgcccaagcatatgagagtagtacattctcaattcagtcttggctgagtcttcagctttgcttggtgacctaaaatttattttacttttttgatggtgagaatataaacattctgcagttctgcattctcctttgcctcactgatgtgtttccttacggggccttgggccttttggacttaggccttttacttgaatttaatgtacctcattttcatttctactaactaagcttgttgtcaatgctaaagatttttcttctgatctctactgcatacttcaaaatagagactacacattgaaaccagaatgttttatcacatggggaggcagtagttacagtggagctttgaagtcaacggacttaagtttaaatcctgactcatcaaatgtaaccatggcaggtcacttaactttgctggccctctgaaatcttttgtgtcaaaaaggaaaaataacctccacagtgactagagattttttttatttttattagcctcttgaaccagaataggttcacagagacttcagacaacagagatgaatgagtaaacacacttagcacagtttccagtacatggaatgagcttaacaagtggtggctattataagtgcagtattttcttcattgactaccagaaggtggtaaacttcacttattcatgtttacaccatttctagtaccaatggggagaacttaaaaagttgtagaatgagtgcaatataaaaacctaatggctggctgttctctggaagcatgttctggctatgaggtagggaatccccccttccttactctggcctgccccatcaactagttatttagtcaacttgtagctaaatatggatgaaaggaaaatattcctaatatggacagagaggttaggatagacaaagtcttaggatcttttgatagtttattttaaaatcatgttctactaatatagtaggacaaatctaatgggacacagtgcaaactaatattacctgtagagccaggtgaaggtccatgggtctgtgattgcagcttttggagaacctgactctgaaggttatattgggagtgcccatattcagggagtgcctataatcaggccttaggtgctcttgcagagaagttgcccacactcagtgggtgtcctataccatcaggttacccaggccgcacactacctgtataaaacacctgttggaaacaccatcctttaccaagtgtaattagtgtaagttagcatcaattaaccaaactggggataattttcctctgttttatttggagatgcacctcactaagtggctgtggattagcatccataaaaggtggttaaaggtaattcatttactggtttatttagtcatttttttccctagcaagagtacatgggggtatggaatggagggagaagaattctgacctctttggttgtttgttcctgtaggaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaaggaa

SEQ ID NO: 359 - DNA, 188047 bp, Homo sapiens
aaggggagggggaggagcggcgaaagcggaagccatgttggagtttcaccccgagcgaggggctgcgagggttctcctctccttgtgggtgtgaccaggttcggcgcggcggcgggccgcggggggcggggacgattggccgcttgtcgtcgtccgcagcggcgtgaggggagcggcggcggcggcggcggccgcagcgtggagccgggtgattgtgaccgccgggggagccgggagccggccgcggcgccctctctccgtgtggccccctgagcggcccccctcccctgcccgggagggaggcggggggcacctggggcccgccatgaaccccggcttcgatttgtcccgccggaacccgcaggaggacttcgagctgattcagcgcatcggcagcggcacctacggcgacgtctacaaggtaaaggcaggggccgcgcgccgccgaggccgtgggatcccgacccgcagccaagcctgggcgtccgagcccttgccgcctgtcctcgggagacgctggcgccagggagcagtcggggaggaggagctgcggacgccaagggctctgctgccttggtgaacaaagggccgaatgtttaaccccgagacctccccagcccttacctgagcccccccggtggacatgatttttgccacctcccttcttgcgcgcatttccagggaagggcagaacgagagcaggccacactgctcatccatagtgcagagaaggtctgggcgtttgttgcgttggcagggtcagcgcgacgaaccggacagcaggggtctggtgttgtcaaacctgcctgcttcacgccaacctggggtcgtccgctctaggttgggagctgctgcccaccaggcctcggtggtagttattatactatgctgagcgacctccatcttccatcgacagctctcagcctttagcgccttattcatccccctgtcagtttcttttaattttccagagtaatgacttttttttttttttggaaagagcaactttgttttctctaagtcgaattggactgcgatgccatttaaacttgttttttaaaaagtgacttgaatacttagggaaggtactggtttgacaaggttagaattcaaagtccagtagcggtacagcattcctgttgtagagggaccacttctaaatgtgggaagataaatcactcttccctggccaactcaactcttggcctcacagttactgccaagaagagaggaggttgttgccaaatgtggcagcagtcttgatttagttgtgtatcttcttactggtaactgaagttgaactcctccagtttcacataacacctgaggatgcacaaagaaacttaattttgcattggaaagttcagtcttaactttattttgcccatgtttaagcaggtttttactcttcagtgtaatgcctgtggtaacttacatatttaatacagtgcagccagtgttctgctttagtctgattttctggatgatctacttttcaccatcgtggatctcatcacttttcctactatgcaatatagatatattgagcccacctacaatgtatgagatacttggcaagtaagcactttgggttgtagcagtaaacgatagacttggttccaaatcttcctaagtgtttctatttttttggacaaggacagtattaaatagccatttaaataattattgccgtttaattttgtgatgcagaaaagagtattaggatcagggttatgagagcatgtaataggaggacctgatcctgtttagggtatcagacgctcatcgcctttcagctgagatctcagagatgattaggcgttgcttagggtactggggagaggggattacgccagataggggagcatgatatgtgaaggctctgaggcccgatgtgaaagaaggcctgtatagcctgagcagccagagcgggagggtggccctagatcttgcaggcctcttagttctcattaggagatcggacttgtttaggacaatggggaactattgcaggcttttaagcagaggagtgacattagatttaggtttttaaaagagctccctactacagcatgaagagtggaatggagcagttgggaggccactgtgatagtctaggtaagaataatggtgttaaggaatatggtgatgactgtgaaagtagaagtggatggatgcaagtcacttatgactggttgggggagttcgcttatattgcgatgaaaagttaactaaaactcgatgaatgtatacgttttaggtggcagggtatacagtgaatttttttacaggactaattggctgtgtacttgctatattaaaaagaacagttagtagttaagccacatgattaaaaagcaaaaaaaaattagggcctgtaatttcctaagtgtaatagaggtatactaagttggttaatcttgtcattcgtttaaaataatgataatactagctgatgtttatggaatgcttgttacttgccaggcactataagatttttctaattaatcctaacagcaaccctgtgagataggtgctattgttaactccattttgcagttgaataaactgaggcacaaggagattaacttgccaaagttggtaggtggcaaagccaaaatttgaaccaattagggactgtattcttaaccaattggcagtgctgcctctctaaagataggagatgggcagataatgtattacatttccagtggagaaactgaggcacacatttagtttagcatttgagttgtagccacactctgagtcagtgtagatctttaagtagtagttggaatacctaattcctgctgtgccacaaggtctcactgtttatgtagtctgccaagtggatatcagataatagatgcttggtccctgcctgccagactcttccaataccagtgaccaaagcagagaaacttcatgtggttcttgacatcatgtacccctgcctgccaaactcttgtttatgtttttgtctataatcaagtttattctataaagttacatttttttgttatttgttttgctgttttagttttttcttatttatacaaattaattgtgctagagagaagtacattttgttttcaaaagccaatatatataatttgttccttaatttgtcagcatttacgtgctaaaaatggaatgattggattaaataaataagagatccgattatagtcattcttggaaggttggtggagatttttattttgaaaatgttttcctactcaatgtaataacatatttattgtacttaaggtggcgtggtttagttccaaagcactgaacaaggatgtggacaatctgggatttattagctatgtgaccttgtgaaatcaacctctcagagctgttttgttgtggagatattattaccatcatatgcccttcttcttttggtattgactaaatgactcaaattttacttagtaagtaagttatctttatttttttcaggccaatgcatatatacattttatctgcactgtctaaagtcgtatcttgtaagtgtcgtgtaactctgcaggctttatctgtcatgaagtgcctgcagcttgggttacctagggacctaggagctggcaactgaagctctttagttgggcctcaggaggcccatggagtgctctgaaattaataggcttaatgttgtatgtatttgtgtttttctgtggagatgggttatagcattcattgcattcttaaagagcttcatgatccaaaaaaatgaaaaaatgatccataggtttgccattcaaaaaagttttcttggagaaattaggtagttataatagatcataatatgattttcacatgcattgtgccatcttttgtcaggcagttttccagtttaatttttattattcctaccctttaagtcttgatgtccttatgtttttctagattttttgctagaaagaagcaggagatagtaaagctggagatgggataaggcaaaagaagttttgaaagaatagtctcaatatggtttctgaggaagtatcttacctagtcttatggttttagtctggtccctgtgaatgattcctagcctgtgtatccaagactggatacacaaagactccaggctgtaagccttagagtcatctttagtgacttctggactgggcttcttaggcattagctaaattctgtacacaggcattttccaaagtgtggttggggtgcttcaggaaaagccataccatgagtaggttaaagactgagaagtcctatggtaaagaaacctggtaaactttgcttaacctagcaaactccaaacttacttgactattagattctttttctctgtaatacatattgcttgtccttagtactagtgttttgtagaacatgctttggaaacgttgatattgattttttttcacctttgtgtgtttggaagccattccctctgaagcacgggctgccgtgttgttaagcttccaggtaggattcacatcgtagtctgtgtaaatagatttaaagtgtctgtgaaagctggcaggaaaaaaggtgaggattgggcagtaaaataaggaaaccaatttatatgcatttagataattacgtgttagtttatttgtaattatgcatctttcaaggtgttctatttaatatcatcatagactaattcttccattataatcagcatttgtgagaacctttctggaaaactcaattcttaaacctaacggataaggaatatgaagaccttaagcatttagaaaagaacatttgaaggaagctcaaacattgttatttggagttatgctcacttctatttacttccatttaggatagactctaatagactctagagagaccagaagaaatggccctaaacttcagaaagatcatttgaagttgaataaggtagaatttcccatcatcagttgctatttgagatgaaaagtgacaatgaaacaggtagcgaggtaatttttctagagtgtttgaaaaacaaacaggttttctgactttgatgcagatctgattacctaaaggaagtacttacctccagcctttgatctgtatatgtatttattggtgaaacgtatctaatgcatcattttgtattaagaatgaatagtaagttctctcatgagagtacattgaacagccatcatacattgaacagctgtaatatgagaggaaatgtgttatgaactgtgagtagagtagcagaaatgacaaggcttggtacttggtatttacaggaacataaaatgtgtacctgctattagctgtcatagtttgagatcagaaccttttggtttcctcatttatatcatattaaatctcttgctggctgagagactctctagatactccataattgcacaaccgacctctgtagcacagcatagtgatttgagaacagggttctggagccaggctgcctagtttcaccacccactagctttgtccttaggccaattacttaatccctctctgtgtgtctcagtttcctcagctgtaaaatggagatgcttagaaaagtgcttgggacagtacctgacacaaaaaagtgtggtcattgttaattgctgttagtgtctagaagtatttattattatgtatttctcctcctactgtccttctaaccaactgcattcctcatgctttgcctcagggtttttagcttgctgtctctgcctaaaatccacccctccccaccaatatctgtttggcttgcttcttcgtttaaagtctcagctcaaatgtcatcttttaatgagcctgctcctttccaccctacaaaaaacagcacttctcccaccactttcagggatacagttcagggatggatccaggttttacgggacctgaagttgatgcagttttggggaccctcattaagaaaacaaaactagaattaaaaaaggtatgaaagtgaatctttagaatgagaaaagatatcccaacaaaatactgtaaccttaggtccctttcttctgagacttccttaggcatttaatcacaaatgctcacaaaaaaatgctttctgatgactccctggctccctgtctccacctggaatactctacatgtcccagcaactctcagcactcatagaggaccatgcaagtgaaggggcctgaactttaagttttgttagcttcacaaaaaattcagttggactctttacttaatttttaattatggcatgtatcaccacatgtttatttgtttatagcctgtctcttcccactagagtataaatccaggaaactggtgattttgctttgttcattgctgtatccccagagcctagaagagtagctgacccatattaggttcttaataaatatttatggaatgaataaatgaaccaacacgagaggaacaaaccatggctacatgagtttagaggaaggagatcattatttctgactgggagaaatcacagcaggccttgcagaggaggtggcattgggcttgacttagagttctggcaatagtgggtacagaatgagttaaatgtaatgggttattattaggtcttaaatctaatcagtagggttaatgtatctttggcatattaagcaatgttcataattgttatatgcatatgaagatactccgtcattttgaactaaatacccctagtgactgactagtgaatacagcagtaggctatcacatatgacttttattttgttttttttaaaatacgattaaattgggcttttaggaagaggactttgttcaccaatacaaaaaaaaccttcgattcaagagatgaaatcatgtttcttttttaatttttatttattttttcataccacctttatatgtacaaaaatcatatttcttttctgctttaggttttttttagtctttttttgttctggaagatgccacatttctgagttctaactgccttgacctgattataggtttggtttcctaatgtaataatgtactgcctaccttagcccttaaactctatagaataattttagatttgaccataaatttacatatgttgaaataagacacttattttgtttgtttaagctcttagaaatttgagattgtaaaaattctttctgtataaaggatcatctaccttaccttgctcaaagaatctcctcttcatcgcctgtatgctaacctacatacaccatgatagtaaggcctccccagccatgtggaactgtgagtcaattaaacctctttcctttataaattacccagtcttgtgtatgtctttattagcagcatgagaacagattaatacatgccccttcccagccagtcataaataccacccacccacaattattgttctcctttcggtcaccatgaaagctcttttagaactttgtataaatgaatcatgagtgaattgcctcagcacttttgatgaaaatcagttgacagtacacatgtgagtatatctggactcttgttcttttgagctgtatgtctatactttcaccaatacctcagtgtcttgtttactgtagctttatcaaaagtcttgaaattaggcagagtgggtcctccaattctgttctaccttttcaaaatggttttatctattctaggtcctttgcttttccatacaaatttttgaatcagcttttcaagttaaatataaaagcctactggaattttgtcttaactttaaattttgagatacataattctaaattcattgcaaaaagaggaaaagaggtctcatgtacccaacacccaccttcccccagtggtgatatctttacatacctatagtgcattatcaaaacgaggaaattagttggcacaatacagttaactaagctttagtcagatttcaccagtttttgtatgcattcattttttatatctttgtatataattttgtgatattttatatacacagcctgctgggattgtgtgggatctgtcactcagttagtggagaattgagatcttaaaaacattgagtcttctgatctatgaatatgatatacctttacatttatttagatgatctttatctcatcaatatgttgctttattttaattaattaatgttatccctggcttttcctactaatattgcagtgaaacataattgtggaaaacttctccaggattgcgtagtaattataatgtgagccatattttcagttttcattaaaattctcattgtactagtagtttctgacttcctttggcttagtcttgttcatttttaaccctgagcatatggactcctttttttttttttttttttttttttgagacggagtctcgctctgtcgcccaggctggagtgcagtggcgctatttcgggtcgctgcaacctccgcctcctgggttcaagcaattctgcctcagcctcccgagtagctgggattataggcatgtgccaccatgctgggctaatttttgtattcttagtagagacgggatttcaccatgttggccaggctggtctcgaactcttgacctcgtgatccacccgcctcagcctcccaaggtgctgggattacaggtgtgagccactgcacccggcccatggactccttttaataaaaattgacaaaaatgaaagggaaacaggcaaaatgactatttaaaaagatatccattttttctatgtatccaaagattttttttttgaggcagagttttgctctttctcttgttgcccaggttggagtgcgatggcatgatctcagctcactgcaacctctgccttccgggttcaagcacttctcctgcctcagcctcccgagtagctgggattacaggcacccgtcaccacgcccagctaattttttgtattattttagtagagatggagtttcgccatgttggccaggctggtctcgaactcctgacctcaggtgatcacctgcctcagcctcccaaagtgctgggattacaggcgtgagccactgtgccggccccaaagattataacaaataccttataaaacttggtttacttttatatatgagatgtgtgtgtttctgtgtattttgcaaaactcacagcttttgagcttattaaaggaaaatacacttaaagtttacttcatccttaagtgaaaaataacactgctaggttgtttaggagatcctaaagaaaattcttaccctgaggaacttaaaccctgatataaggaaacaaaatctgcatgtatggaacatctaaggaacatgcctaaggcactattttaacaattagaagaaaacaataaaactatataaatactgtaggaattttaatttaagggaaaaataagttgacttcctgaaagagtgaatcttgacctgggacttgaagaaaaattgtatttgcgattgtggagaactgtgaagtcataccaaaagagtaaatatgggttaaaaatactgctgtagaacctaagtgggcaaagaagtaataagacaactattctaaggagacatattgggaaatgtggtagataatgtttcacatatataagatacagataaatgaatgccagttgaagaatttagaactcacttgacctacaatgtagtatttttcaaattcattagggccactcttttctctaacgtgcttgggtagctatttagatggtattcaataagttttatttcttccctttcatctctattgatttagaagttaaaagattttacttttatgcttttggtggttaccgttaaatttgcaacttgtgtaattagtctgaagttaactgatctttctctgttctctttctggtcagtatgtggattttagaaggcttaatttcattcactaccttactgttttgtgttgtctcttactttggttctactgttcttaaatgtcccagtttagtttttattattgttttatacagacagtgcttctttacatttacgtgtaggagttttcaatttctttgctcactgtttcttcttggccttatattccttcattctgggttcagatttctttaatcttgaagctgtatttggtaggattttttttctttcttttaacttttctttttaagtgaggaactgtataaggtaaactcagtcttcctcctccccctcctcattgtctttattttgtctttacttttaaatcatagtttagtggggtatagaactctaaattaacggttgtttttttctcagcactttgaagatcttttgttgtcttctggttacctgttgtgctgtggagaagtctgttgtcaatataattattgttgcttttagctaatcttactttttctttcctccctgtttgacttttaagatttttttctttgattctggtgtgtacagtttcacagtgttatgtgtggattttaataaaaatatttactgtttttctttaatctgaagagtagcgtatttcctcagtcctggaaaattgtaaactgcaatatctttgatacctttcttcccctatctctttcttgtttctctttagagctcgtgttgtattctttaactttgttatagttctccatgacttctcatgatttttctctttattctgtgtcatgtattatggttcttatctttattatctttaattatgtctgtctaatctgctgtttgaaactttcattttttaaaaaaagtttgctttttaaaaaataatttcaattcacaggataattgcaaagaatgagagaataataaaaataaaataactctcatacatcctttccaagattcaccgatggctaatactttaccacatttattctctgtatatatacatattttttttttctgaaccatttgagagtaagttgcagacatcaaactcctttacccataaatactttgatgtgtattctcaaaatgaaagacatttacttaaactgcaataaattatcaaaatcaggaaatttaaatattaagacaatactattatttgatctacagaccttattgaaatttcaggagtcccagtaatgtctattatagcattttccccccaactccagaaatccaggagaatcatatgctatttttagtttctaagactcttcagtctcttaacctagaagagtttttcagcctttgtcttttagacaccaacatttttgagtagtacgcatcatttattttgtagaatgcccctcatttgtttaaattcatgttacacattttttgacggaaatttatagtgatgtgtatcctcagtgaatcgtatcaggaagaacatgatgttgattagtccccttattaatgttgattttgattatttggttaaggtgggtgtgccaagtttcttcactatcagattatctcttccttttctaattaataagtaaattatggggagatactttgagactatataatattttgttcctcatcaaacctgtacccactaattttaatatccaagttgatttctacttgaattattactataatggttcccaaataatgattttctaactccgttaatttcttctacatgtattggttgacattctactgtgaagaactatttttgtttatttattttttggctcatggattcttcttttattcattgggttttgattcatcacttttattttgatgctcaaacaatttcagatttggccagttggattttatcttagctaggactgccgtaacaacataccacagaccaggtggcttaaatgacagaaattaattttctcacagttctggaggctagacattcaagatcaagatgccaggtttctagtgatgctctctttctggcttgtagatggccttcttacagagagagagggcatactttctggtgtctcttctcataagggcacttatcccatcctgaggccttccctacctcaggaactcatctaaacccagttatctccaaaaagccccatctccagatgctgccacattgagggttaggtcttcaacatgtggattttagagggacacagttcagtccgtagcagattgcattgctttttacattttattaattatattcctagatatgtgttattctttttcaagtctttgtattcttgttgcatacttaattgttcttagtgctttcggattagtctataatttcaaattttgggggatttcatcttgcagtttgttgctttgttttatgctgactcatgcctgtgaatttctatgttaattttgaattcatctactttttttctgtaagaatctttgtggtttaaattgacagctgagtggaggggctgggggggtggtggggagtgggtgggagactgtggctgtccttccaaaacagttttgcttttgtttcttccagtaacctcatgagtctttttggtcttggatttttattttaatttctcagtttgggattccccacatcttatagataatacaaacttgaaccccaaatcaaaagagcaatgactcttggatttgaattcttggaggactgtttttcttctacccaaacacagactttgttgttatcctcttgtgcttgtaggtaacttttttttttttttttttttttttgagtcaggttataactctgtcacccaggctggtgtgcactggcacaatcaaggctcactgcagcctcaacctcctgggctcaagtgattctctcacctcagcttcccaaggtagctgggactacaggtgtccaccaccttgcccacctaatatttgtattttttgtatagacaaggtctcactatgttgccttggctggtatcaaactcctgggctcaggcaatcctcccacctcaacctcctaaagtgctgggattacaggcttgagccactgcgcctggcctaacccttttttaaaaaaactgtttttgctttactgaaggcacagtcccttccagagtcctagcattattcgggggtctccgttccaatgtgctgttttgagtgggcccacgactgttcacctgtactcagatggttttaaaatccccaagcacctagattgcagagatccactagacttccttcctccatcccctcccaccttgattctaattcccctcccccctgttggtggaaatctcaattctggttttccactttccatcttaattcagtgtgatacatttgttaaaattgatgaaccaggccgggcgcgatggctcacgcctgtaatcccagcactttgggaggccgaggcgggtggatcacctgaggtcaggagttcgagaccagcctggccaacatggtgaaaccctgtctctacgaaaaatataaaaattagctgggtgtggtggcacacatctgtaatcccagctactcaggaggctgaggcaggagaatcgcttgaacctgggaggcggaggttgcagtgagctgagatcgtgccactgcactccagcctgggcagcagagcgagactccgtctcaaaaaaaaaaattgatgaaccaatactgatacattattattatgttaattaaagttcatagtttacatacattaggcatcactctgtgttgcacattttctgtgcttttgacaaatgtttccatcagtatagtatcatacagaatagtttcactgccttaaaaattccattttctatctattcatcttccattctcctctgcccaactccaggcagccactgatctttttactgtctctatagttttgtcttttccagaatgtcatataattggaatcatacaatatgtagccttttcagactgtcttctttcccttagcaatatgcatttaagtttcttccataactttttgtggctcaatacctcattttttaaaaattactgaataatatctcattgtatgtttataccacagtttattcattcacctattgaagaacatcttggttgtttgcaggttttggcaattatgaataaagcagctataaatatccatgtgtaggtttttatatggacataaattttcagctcatttgggcaaataccaaagagtgtgattgctggattgtgtggtaagactgcttttagctctataagaaactgccaaaatgcctcccaaagtgactgtagcactttgcatttctaacagcaatgaatgagagttcctgttgctccacatccccaccagcatttggtggtgtagtgttttgaattttggctattctaataggtgtgtagtgctaccgcattgttttaatttgctgtccctaatggtatatgatgttggtcatcttttcctatgcatatttgctatctgtatatattttttggtaaggtgtctgttaagattttttccctttttaaaataggatttttttttattgttgaatttaaagagttctttgtatattttggatacatgtcctctatcagatatatgttatgcagtattttttcccagtgtgtggcttgtcttttcattctcttaacaatgtcttttgcagagcagaagtttttaattttaatgatgtccagcttatcagttttttctttcatgagtcatgcctttggtgttgtatctaaaaactcaatgctagaccatggtcacttagattttcttgtatgttatcttctagaagttttatgttttgcattttacatttatgtctgtgatccattttgaggtaatttttgtaaaagatgtgaggtccatgtctagatttttatattttattttattttgttttgcacgtcaatgtacagttgttccagtactatttgttgaaaagaccgtccttttcccattggatcacctttgcttctttgtgaaagattagttgaatatatttgtgtgggtctgtttctggactcttgtgttaatttgctatagcttctattagaaagtaccacagactaggtggcttatacagtggaaatttattttctcagttctggaggctagaagtctgagatcaaggtctcaatagatttggttcttctgaggcctcactctttggcttatagttggctgttttctcctggtgtctatacatggtctttcctctgtttccaaacatgaggagtttgggattgtaatttggagtcagatatatagcagagaactaggggagataaggactgggagaagactattgagtctagttaggagggtataattgctgttcagaaagagtagttggtaaagcatcctaattagaaatgattgagaaggcaggaggaaatggtgacattgtctgtggtctcttttcaaggagtttgatcatgctgctttcttctagtaccatagcatttctatcttagtgtttttctcaggagtatttattgagcacccatgctgagctgtgtaccatggctgacagaggatgaacagaatgtaatccctcttctcaagttggtggcagactagatacgggaatagtatggagtaattatagcgttaagtaatatggggtattttgtgattaagtattatgtaattcccaataaaagttcagaagatcagaaaaattgcagcccatggccaaataaaggctttttagaagagatagaatgaaagtttggctttaatgtgttgtttagatttaaatggataaagtggaagggcactgtagttgaggtgaaaatcgaagaatgaagtcctggtagggggaggaataagcaagaagagatcatgcaggaaacgggccaaactacatcaaatgatttgtattggagaataatagagaacattagatattaataacaatagttataatcatagcagatgccatttatagagtatatactatgtactaggccttattttatttaagtgctttataggtattctcattttaattctcttcacaaccttacgaggtaggtattgttatttccattttacagatacagaaactgagacacaaaaagaaaggtcaagaataggcccaggtcaggtgcagtggctcacctctggaataccagcactttgggaggcccatgtgggtggatcgcttgaaaccaggaattcaagaccagggtgggcaacatggcaaaaccctgtctctacaaaaaaaaaaaaaaaaaaaaaaatgcccaagtcaataaatctagtaagtagtaagtggtgaaaccaggattgaattcaggcagtcttacttccagaacccatgccttgtagtcactgtgttgttctgtagagaggtaggtgagaccagaatatgtcttgagaaactgtctccaggttataaattaaatgtgatagaaataagggaagcaatttgaggtgtttgatgaaccgaagagtagatagtgagctacttgatggcagggaccacttcttagtcctgtgagagatggatgtggtggagagtggacagttaatcctcagtctgatatttcagattatgtggaagatggtgtaccagttaggagtgaatggaaatgatatgaattagattaatgacaggggaaactgggggcatagatgacctggagagatgggaaagttgagtgaagcaagatgtggagttagattttggacagattgattgaggtgtaatgtctatagactagcagatttgaaggaacccgtagggaaatatcgtcaagagggatagtggacacctgagaataagaattcttcaatgatgggagtgtcaaggaaagagacatcttttgcttgagttttcaaaggaataatagctcttaacttcttcctcacttttaatatttgagaaattcatggcggccgggcatgatgtctcatgcttgtaattccaacacttcaggatgctgaggtgggaggattgcttgaggccaggagttcgagaccagcctggacaacatagctagacctcatctcttaaaaaaaaaaaaaagccaggcatggtggcacatgcctgtagtcctagctacttgggaggctgaagcaggaacatcacttgagcccaggagttcaaggctgctgtaagctatgattgcagtactgcactccagcctaggcaacacagtgagactgtctctaaacaaaaaacaaaattaaaaaaaatatggaattcatgattcatgacttcagttttacctttgaatagtgacatttgagcaaataaatgaaataaaatataaaacacctattctgtaagtgcacgtgtatatggaagttatggtctttagttttaagtattataagttactaaatatttcccagttgaaataagttaagaataatggagtaaataagagtagtgaaagattgattacccatgattgtttagcgtttgctttcaacacctgtgtgtccttaaaagccctttttggattcttgtattcctttcagtgcctcagaggaataggtgacttagaatctctctctgaccctaggccagggggttcatactcctcttcctccatttcattctcaggaggtgacacagtggaaagaagagaccattgaaagtgctgagtgataggaaagtcagatgggatatgtcattactaaacctttttcatctttccgtttccataccttgcttttgcctgtccccatcctgtgctccaccatcttctatcccgtcagtaaaaccacaaactccaaatcttcaaaaagcattgagcagagaatataaagccttttgcagaaacagtccacacacagttatgtttagtttttgaatgccattcagcttgaagaagttagtcatttttatttcataatcattgtgttgatatttttcttctggggtctcttatttctggttagtgctgtgatgttaattcaccaatactactaggatctgctaatcatagaagatgtttttatttggaatgttgagattttatttcctccagtaaactgtgttcacatgaggtttgacaaactttttttctttcaaaaaccaaaattggaggtttctgttaattactgggcggagctgctatttttatagtaggtctgtattgtttgtgttgagtttctttagctgtttctatcgcgctatgatgcaatatttgaattaaaatgtagagaatatttctataaggtaatactgcttttatagaaaataatataaaaaggtgaaatttaaataaactgctttataagattttagacaatgtatttttaaaatataatttaacttattttggtgggctttagaagaaaaatctgtaaactaaacttattttgtctggcagtaaagggatctagtttttttttaacactattgtttgcagaaagtattcacttattaatacatgataaaattagttgttttggatgagaaatacctttttgttaaacttatctttttaagttcatactatttaaaacattatttaaaatatttcacttactatataagatttttaaaaaataaactttattttagaatatttttggatttacaaaaagtcacaaagactcctaacccagtttcgttttttgttaacatgttaccatggtacatttggcacaactgaggaccagtatcagaacatgactgttaactaagctccaccgtctatttggatttcactagtttttctctaatgcctctttctgtctcaggattccatccaggataccatattctagttactatgtccccttaagcagaattttctggtgtgtgacagcttcacagacgttttgataactttgatagttttaaggagtgctggtcaatgttttgtagagtgtttctaaatttaaggttttttgtttttttttttctcatggttagattgcggttatagattctagggagaatgaagtatgtatgctgttgacataatttatcactggcaatattaactttgatcaccggcagtgttaactttgatcaccggcaatgttaactttgatcacctggctttttagttaaccaggtttctgcactgtaaaactacttttccccacttttccattttgttctgtttggaagcaagtcactaaacacagcgccacactcaagaggtaagaagttaaacttcacctctttgaggaagggagtagcttcgtaaattacttgaaattcttctgtagggatttatgtctttgtcctcatttatgtatttattcagttattttatattagtatggatgtatggatatttattttatactttgggttatgatccagtactacatgatttattttgttgcccagattgctccaacttagccattgggagctctttcaggctctttcctgtgtcccattcataggtccccatcatttgttttttttttttttttgagacggagtcttgttctgttaccaggctggagtgcagtggtgcagtctctgctcactgcaaccttctgcctcctgggttcaagcaattctcctgcctcagcctcctgagtacgtgggactacaggcacgcgccaccacatccagctaatttttctatttttttagtggagatagggtttcaccatgttggccaggatggtctttgtctcttgacctcataatctgcccacctcggcctcccaaagtgctcagattacaggtgtgagccactgcacccagccatcattttgtttttaatgcttactttctggcactgcaagatgctttaggctcatcttgtatttctctgccctagcctgataagcagacatttttccaaggagccctggttccttctgttagagaatggtgttagataccaagatctgggctctgagtatgtttgctgttggcgtgtcattgattctaggatttctcttagtagatgaagctaggaaatacgtgtatatattgctaaaccacgtatacatacatatctataattattttagtatctctctgtctgtatctgttttaagctaaactgatatctcttgatctaatctagcatcacatggtttgttctggccttcccccattgtttatctgtagtttcctaatccagtagtaagaaacctggctttcgggcgggtgcggtggctcacgcctgtaatcccagcactttgggagacggagggggtggatcacaaggtcaggagatcaagaccatcctggctaacacggtgaaaccacgtctctactaaaaatacaaaaaattagccgggcgtggtgacaggcgcctgtagtcccagctattcaggaggctgaggccggagaatggcgtgaatccgggaggaggagcttgcagtgagccgagattgtgccactgccctccagcctgggcgacagggcaagactctgtctcacacacaaaaaaaaaaaaaaaagaaaagaaacctggctttcactgcctggtatccatttatgaatttgctcaatctcagtatatctgtatagctttttagaaattttcacaactctgttacaagttgacaagccaaacagttctcgtatttttaagttactcatttactctttgaaataataataattatacaccacttactatgtgctaagcattattctgtgaacttttacatgtaagaaccgattttagtcttaatccatgctatgttgtaggaactttaattatctctattttacaaatgaaaatagaggggcccagagagcttttgtagtttttttcccaaggctccacagctagtaaatggcagagccagcagttgaacccagtttgcctccagactccatacattcggctatactgccaaaaatagatgtgtgaaaacattgtagtgttgattatcatttttaaaaatattcttttttatgctaaggaagaagagggttcagtgatctcagaaaaatccccaaagtacccttctggatatgagaggggacagtggttagaaaagagtaaatttctttaaatagtcaaacttgcagaaatggaactgtatactcactaaaggaaaataatgcttgctttcttctggttgaagagattgtgtctgtgaggaaaatagttcatgcttttaaaaatcttctggaataaaacatggccagcttttttttctgccctccttaaaccaatccatgatgattgccagattattttttccttctggtagaagcatgtggttctcaccctcttcacatatgtctcttgcacagaggggaaaggagtgggtcagaattgcagttagcaaaggcgttttattggctgccgatcaagtcaagaaccaaattagttgaaggaatttctttattaacatgccagaaacatcttatctatttggttttaccagagcctgtttagcatttggtttcattggtaagctcatgtagaaggcttagttattctgaagttttgttttcaaacaggacagccctcccaactccaccctcccagcatctgactgaaaatttttgacagtttaattgagatataattcatataccatacaatttaccatataattgaatgagttacccagttagtatgacttaaatttgagtcctaaaatcagaaacaagatagtgatagagggaatttattcttccaaatgttatttttatatatatatatatatatatatatttttttttttttttttttttttttttttgagacagagccttgctctctcgcccagactggagtgcaatggtgcgatctcgactcactgcaacctccacctcctaggttcaaacaattctccttcctcagcctcccaagtagctgggattacaggctcccaccaccatgcctggctaatattttgtatttttggtagagatggggtttcaccacgttggccaggctggtctcgaactcctgacctcaggtgatccacccacctcggccttccaaagtgctgtgattataggcgtgagccaccgtgcctggcctataattatttttatattaagtaccattaatgaacaccaaaagtgactattaatgcctgacattaatttataaggattggagagacataaataccacaggaacttgataaagtggcacagtgtgattgatcctcattgaagtaatacgtacggttatcttttcaccataatttcactttcctttcttttaattgactgtctcctttttcccactcaaatttaagggcatttaattccgtaagtctgtttctaagtaataattaaattgaaactagattgtacttacttacttgtgcaccaataagtgcaaaaggattttgcactgagaattcccattattttagtgcagaacttgtcaaattttcctttgttgcttaaacaaagtcatatcagtaagcataaaacatctgaaggaaattttaatacttctgatgcttgttcagttgtagtacatacttttaaaatgaagcccattcatttggaactgtttttgagagctataacatttaaataacatctaggagaagtttggacttttacaagtgtaggctgtcattttgcagaaaagaaaatctggttgtgaaccaaacccaacttagggatttggctcatggaattgcttataacctcttgaacttttcagttctctaaaaaattgttggtgataatatttaagattctctatgaagttggtggtttaattttggataaatgaattcccattttttacataatacttggctttcatacaaggttcaaagtattagattggtacatactcttttttttttttgagttggagtctcactgtgttgcccaggctggagtgcagtggcgtcatctcagctcactgcaacctctgactcccaggttcaagtgattctcctgccccagcaccccccgagtagctgggactacatgcatgtgccaccacgcccagctaattttttgtatttttactagagacggggtttcaccgtgttagccaggatggtctcgatctcctgatgtcgtgatccgcccacctgggcctcccaaagtgctgtgattacaggcgtgagccaccgcacccggcctaggttggtacatactcttaagagaattgaggcatagtaggcagacagagtagaagaaagagatctgcaagcaggtggtagtgggggtggaatgtgggggccatttctcaaaaacattactgaaatgttttctgaagaaaatgtattcttctaaaaaatttgcctaacattattttgtgagctgttttggaattgctactagcctcttaattcccccgcaatagtttgtgaaaactatttaatagaagattttaatgtaaactccaaaattccacctactaactaggatttagtagtaagatacaattttaaggttaagagcaggatttttgttcctgcatctggggtgcagtgatcttcagagaagattggtgcctctctttgcttctcattttggcttttgatggagaggttggtgagtgtttctgttttctagatttggctatttctatagagattaggaacatgttgcttattgtaaagtatcaagacagagaggaacaaaatcaagtttaactatgagagtgctttaaagctgaccatgagaatcatgttctctagcagatattccttgaactactcttcccttgcagtcaccttgaaagattgtaataggaattagcgagtaagtgtgtatgctcttacttaaagatgtagatattgatatgaggaggaaaggaataatgtactttcggaatatatctgaatcgtatattttctgttaagaagcaagaaattaaaagcccctcttgagtgacaaaatgatccaaagcagagcttcacttaagaggttcttagcacctacaaggtggagcctgggcatcttgtatgccaagaactctacaggtagttctgagaagacagttgttaacggactcccctgtctggtgatacagggggcccacctctaccctggtcttgcttctcttacaactttttctgattgtgttcactttctatttagtccgtattcctggactctgcacctctacctttttactttgcatgtacagtcaatggattctcacagttaattgcagtcattgtagtgactggatgtgacccatttttggctgtctttggtttcatatatcttgtgattgtgcttgtttttctcagcaataccagtatctgaccactgactgtacccagtctgtcccctgggctgcactggcatttccagacttctgccttaattgccccctttcctcataatggtggagagacattaaggggaatggtggttctgttcctagctccctcgttaattaggtaaatgtgtgtgattcagttccttaaccacttaggactatagttttctcatctcttgcttaaatcctcttcagtttctgtattattaatagaacttggttactcatgtatttttctctttctgatacaaggaatttagcctgactctctaacttttactgcatgaaagctttgatgaatttctttatactctaggtaaaatggaacatcgagatgtactttctgctcatttctaagacaaaaagcttgacattttataatcctttgttgggtttctcctcgttagtcacttcagtgaggtagacaagttagttgcatgtaatagacaattagaaaatacaagaaatctttaaaaatattgaaatggcaggttactatctaccagatagatactatttggtcagatgaccaagtagttaggaacttagcctcttgattgccagatttgaattttagctgtactagtttttaaggttttttttttaatcttggacatgtaatttaatttctttatgcctcaatttattcatttgtaagacgagaatagttaatgatatttaaattgtgaagtttaaataacaaagcatttaaatcttagtacataacctgtacatagtaagtacttcataaacgttaactactattgcagtagtatttgttcctgttcttcattgtcatgtaaatttagggctattttcatgatcgccgtttaggaaagcccttctgagtgtttctagggttttattttttgtttgtttgtttttattttaatagcttatctcaagtcatattctatcatatcatctaggtatttttgcttttcctcctgcctaggactaatcaatctaattttttttgtttttatttcccttaactggaatgtaagcttcgtgggatcaggggccttctttgtcttattccttgttatatctccagcttctagtgtaatagatggactacaatagaaggtcagtaaatattttgggggacgacattaattgctacagtgagctgttcagcgtatagctgaaaggagatggtggtgactgcagctaggtgtggcgcgatctcctgtagatccaatttggtggtctttttccagggccctgacccgcgctagctgttactgattttgcccctgaaagtatgttctctgacttaattattttggtcttatttggcaaatcattgcagtttaccaaagtgtgttttctggaacatttgatctttaaagtgatcttcctaatgactgtaatattccaattccacagaacacactttgggaaatgcagagttagtgtactactgaaagcctggtttaccctcactcatttcttgccttgtaaaatgatatggtcaggaaagttaaaatgaaataatatatgtgacatactttgtaaactctctagagtgccatgaagcgtgttgtcaagtgtttaagcttccttttattagtcaccatgtagatttagtcaccatgtagatatgtagccattacccttcgaacctcaagccattacgtttagtcactttccctctctgcagatcgtcacatttttttcattgctaacagtcacagttccttagagttattttgttcaattctgacaaacttctgtgctcatgaaagtacttgacagatacttgatgcacttagaactgaatggatgacgaagcctttgccagataaaagcttactggttccatccactttctcaccagtggtcatcagagaaatggatttccagaattgtaacattgtagtttaatcgtctagcaaagacattaagcataagcataaaccatatctttgtgtccctgtacccggcaccatacctggcatgtgattagctctcagtaagtatttaataactaaacaagacactgaaaccatacaccattctttcctcatgctcacatcatgaaatggagtcactgtttagagagggaatgtaaattggtacactcaatctggaatatgtaccacaactttctagtatgatttaagtaggaaaaatgtagggaaaacatctgccttcgtgtcagaagtgagggagtcaaacttactggctttctgtctgtactctgctttaaaattggattttaaataacggttttaactaaaaatagacgccaagaagaaaacatttctctgatgtaaatatccatttcccagtcctcacaggaaattcacttaaacttaaggcatacaattatatggagtatactttgtttttaaaaattactgttgaattactgtcctgtatttaaaaagacatagattctgttcatttatctccagcttaagtaaaaaaaatggcataatgatatcaaaatattttgttcttttaaacagtttctcaaaggtgtatttaatgctaatgtagattatatggtgaagatatgtttctttgaaaagatgacatacaaaaacaattctaggatatcagtagcaaaaactatgacatatgtgcctttgatgtcattgtaccgtatatccttttgtatagctaaaatggctattctgtgcattttggtttaattgctatagtgaaaattacatttttgaagagctagaaaagcttttcaaaacttggaaatgttgttatccttcatattatgaaaagtactagttttagtcttccaccatgcaaagacctttttaaaaatgatcttttaaatattattttcatgataaataatttaccatttgtctgtggaagagaaatactgctttctgcacacacttgtgtatgtgttccaaaatcatgtaataagatttttggctgttagagtgacatgtgactgtaatggttttcagtagagtttgttattataatgtattagcaaagaaccaacatttataaagatagaaagctttacaagaaatgctaagatcttcataatattaccagttgctttgttatgattttattgctctaattttctaggattgtaaaattatgtctaattattgacatgggtacaggatgttgcgtgaatacagggaactccaaattcttgattgtggctatttgtggtatgtcctgccaatctataaagggttcagctgcctcttatgtgtagatgatgcagtggcctgttgctgaactagaaatcagctgttgctttaaatgacagattagcagctccctcctccacaatcccaaactaccatacccagacctaggtgtaagtagaaactaaaaagagattaaccaaagttacttcttcgctgtagtcagaaaaacgtaaaggatattgaaaaagcaaatgttgggcataatcatatgtagcattttatgtttcagtttgtggtaagaagtttttcaaagtaccttaacaatggaaatacctttctgctattttcattccatcattggaattagcacttagaaactatccctttaagtgctattgagtcttcagttattgcttaaccacattgtcctttatctcagtgcctgtgaattagagatctgtctttacatttattatagtactaggtaaataggcatttataccaactgtaacataaacagagattccatgtagaatatggataattatttttagtctatttctgttcacactgttaaattaaccttgtttttgtttattttcaactctgagtatatctcaatatctactatgctttatttttctcttccgatttctgttctctgcatactcaatattttctggagaaatttacaaactggctgaaacatctagtttagctttaagtgatttgttgttgtcgttttgtttttaaatgttgcccaggctggactcaaacttctgggttcaaatgattctcctgcctcagcctctagagtagctgggactataagctggtgccactgcagccagcttccaagtggatcatttattgaagttcagcaatattagagtggatccttgaacaacagagaggttaggggagccagccccccatgtagtggaaaatccatgtataactttttgacttccccaaagcttaaccactaatagtctactgttgaccagaggtcttactgataatataaatagttaattaacgtgtatttcttatatgtattgtgtattatattcttacaatatagtaagctacagaaaaggaaaggcgaagaaatcataaggaagagaaaatatatttactattccttaagtggaagtagatcatcataagtgtctatccttgtcttcatgttgagtaggctgaggaggaagaggaagggttggttttgctgtcagggtggcagaagtgaaaggaaagacagaagaggcaggcacagtataactttacagaaatacattgtaatttctgtctggcttttttgctttttcatttctctaaaaatgtttctatatggtaccaatcctcccactgttagtttcagtgcctgtatcatgggaggatccctgtcataaaagaagtcaaagcagtcttggagaatcaaacccatttgccagattgcctgatgttactttgctttctggcactgcttcttctttgtcttcttcctcatcgtctggcactgctttagaagcactcatctccatcaagttgcttctgttaattcctctggtttggtatctgttagctcttaaatttctctaagatccatatctcgaaacccttcacccacccaaccccccaccaccttttttttttttttgccatatctgcaatctctttcatgatttccttgactgactctcataaatcctgtgaagtcatgtgcaacatctgggcatagttttctccagcaggaattttttgtttcaggcttgatggctttaaaggttttttctgtaacagcaatatatcttcaatgatgaaattcttccagacattcatgacattctctctgttggtgttctcttccattgaattgacagtcccttccctagagtatcgtgtctaatgacccttaaaggtccttatgaccccctgatctagatgctgaattagagatattgtgcttgggtcaagtagactattttgacatcttcagtgttgaactcctgggatctgggtggccaggggcattgtctaatatcaaaggaactttaaaaggcagttccttactgagaaggtacttcctgactttacagacaaagcatggaaggaaccaatccagaaaaagggttttgttatctagatggttttttttattttttgctttttgtttttgttttgtacaaccaaaagactggcagctggtgtttattttttccctttaaggctcaagggttaaaagctttgtagataagagcagtcctgatcataaacttgactgcatctgcacaaaacagtggatggagttagcctatcctttcctgccataaatcctgtgcttgcttctcttctttactaatatcttgtggcatttttttcccaaaatagggcactttcatctgcattaaaaaacctgttcagtgctagacacagtggcctacacctgcactcccagcactttgggaggccgagatgggagggtcacgtgagcccaggaatttgagaccagcctgggcaacatagtgagaccccatgtctataaaaaataagagcattagctgtatgtggtggcatgcacctgtggtctcagtttccatctcaggaggctgagatgagaggatcactttagcccaggaggttgaggctgcagtgatccaaggtcatgccacagcacttcagcctgggcaatagagtgagatcctgtctctcgctctataaaaaacaaaacaaaaataacaaaaacaaacaaacaaacctgtttaggcagataacctttctcctgaatgattttcttaatggtgtctgggagctcctctgctgcctcttggttggcagtagctgtttcttctgttttcttgacgtttttaagccaaaccacttcttcagattatcaaaccattctccaactggcattcttcaactttaaatccttttttttttttttcctttaagttgttaatagaagtggtgagagcagacattcttcccttgttcctgctcttaggaagatactatttaggctttcaccatttcctttgatgttagctttaggtctttttcatatgctatttgctatattggcacagttctctttatttcctgtttgctgagtttgtatcaggaacagattttagattttatttacttttttattctgtggagatgaccaatttttgttcatttttggtctgttaatacagtgaattatactgattgatttttctaatactaaaccttgtattcttaggataaataccacttgatcatgatgtattatcccttctaacattgtatttgatttgctaaaattttaagaattttttatgttcatgaggtatatttgtctgtagttttcttgtaacatctgtgtcttgttatcagaataatgctagcctcaattgagaagtattcttttcttttagtttttctacttaagagtagtttacataccgcaattacagtgttgtaatattctgtttttctgtgtactgttaccagtgagttttataccttcagatgatttcttgttgctgattagcatcctttttttttctgattgaagtactccctttagcatttcttgtaggacaggtctggtgttaatgaaatctgtcagtttttgtttgtctgggaaagtcttgatttctacttcatgtctgagggatatttttgctgaatatactattctagggcaaaagttctttttccttcctcactttatgcctttcccctctatcctggcctgtaaggctcccactgaaaagtctgctgtcagatgtattagatctccagtgtatattttcctttctcttgctgcttaaagagtcttttctttatccttgacctttgggagtttggagtattcaatgtcttgaggtagtcttctttgggttaaatctgctggtgttttataaccttcttgtacttggatattaatatctttctctaggtttaggaagttctctgcttatccctttgaatacactttctacccctgtctctttctctacctcctttttaaggccaataagtcttggatttgtcctttggaggcttttttctagatcttgcagatgtgcttgtttttttaattctttttttgtctcctctgttttcaaatagcgtgtcttcaagctaactcattctttcttctgcttgatcagttttgctattaagagactccaatgtgctcttcagtatgtctgttgcatttttcaactgcagaatttctgcttgattctatttaattatttcagtgtctttgttaaatttatctgataggattctgaattccttctctgagttatcttgaattttttttagtttcctcaacacagctattttgaattctctttctaaaagatcacatatcttggtttctccaggattggcccctggtgtcttttttattttgttttattttttgagatagggtctcactctgtcacccaggctggagtgcagtggcatgatctcggctcactgtaacctctacctcctaggcttaggtaggtgatcctcccacctcagcctcccacgtagatgggaccacaggtgcacaccactgcagctggctaatgtttgtattttttgtagacacggcatttcaacacgttgcccaagctggtcttgaattcctgggctcaagtagtcttcctgtctcagcctctcaaagtgttgggattactggtgtgagcatcgtgcccagccttggtgtcttatttagtttgtttgatgaggtcatgtttccttggatggtcttgatgcttatggatgtttgttcatgtctgggcattgaagagttaggtatttcttgtagtctttctagtctgggcttgtttgtatttgtctttcttgggaaggccttgcagatattcaaaaggacttggattttgtaatctaagccatacctgcagtaaaggacaacccaatcccagtaacactgtagttctagtagacttgtagaggtacgtccttggtggtcttcaataagatccaaaagaattccctgtatcataggcagtctcttattctcttcctttactttttcctaaagaaacatcatttctctctctgttctgagctgcctggagctgggggaggggtgacacaaggtcctctgttgccacccgtaccaggactgtgctgggtcagaccagaagccagcacagcactgggtcttgcccaaggcccgctgtgacccctacctggttactgcctatgtttgctcaagaccctaggtatctgtaatcagcagatggtgaagccaaccaggcttgtgtccttcccttcaggttgaggagttcctctagaccccaggtgggtccagagatgccatctgggagccagggactggagttagaaacctcagaaatcggctgggtgtggtggctcaagcctgtaatcccagcactttgggaggccaaggcgggcggatcccctgaggttgggagttcgagaccagcctgaccaacatggagaaaccccgtctctgctaaaagtataaaattagccaggtgtggtcgtgcaagcctataatcccagctactcaggaagctgaggcaggagaatcgcttgaacccagaaggcagaggttgtggtcagccgagatcgtgccgttgcactccagcctgggcaataagagcaaaactccacctcaaaaaaaaaaaaaaaaaaaaagaaagaaagaagaaaaaaaaaagaaacctcagaaatcttcctggtgttttattttactgtggctgagctggtactcaaaccatgaagcgtggtctttcccagtccttcctcccctttccacaggcagaggagcctcacgcattggccaccaccactacaggcccatggggagtactgtcaggctaccgctgatgttcacttaagacctgagggttcttcagtcagcttgtggtgagtgctgccagacctaggactcaccattcagggcagtgggctcctttctgccccagtgcaggtccagaaatgctgtccaagagccaaggcctagaatcagggactccaagagtccacttggtgctctaccccactgtggctgagctggtacctaaggtgaaagaccaagtcccctttactcttctctctgcttttctcaagcaggagtctttcactgtagctaccacaactgggcatgcgctggttttcacttgaagccagcacatgtcagagtttcacccaggactcacagcatactacctgggttttgctgctggttattcagggcccaagggctctttagtcagcagatactggatcctgcctgaactgggttcttcccttcaaggcagctggttcctttctggcccagggtgtgtctagaatattatctgggagctagggcctggaatgggtgcttcacgatcctaactggtcttatatcctagtgtggctgagctggtatccaagatgcaggttagagtcctcttcactcttccttctctcctcaagcagaagacagggatcttttttagagtcactagctggggttaggggaggggtggcacaagcactcccttagctgccctggctggtgtcataatagcttgcatgccccccaagtccactggctccaagccccactcagccctacgactttgcctaagagttgcagtccttgtggcctagactgcctttcaggtttattgagggctgcagagtacttcatcccatggtggggaggcttgccagaactcaagttctgactgttgggacaggcacttcccttctggctagggctgatctaaatactccctccatggtcgggtgtcagctgagttcaatgcaaagtctcacaatcactgtgctttccatccctcaagcacacacattctctgcgccacactgccactgtgggtggatgggggacgttggcaattcaagattgcctttccttcagtgcctctttcagtgatatcttcagtgcctctttcagacatcttcagtgcctctttcagtgatatgaagttaaaaccaggtactttgagtgcacacctgagttttggttcttataaaggtgcttttttgtgtgtagatagttgctaaatttggtgttcctgctgggtgtcagtgggtggagtcctgttcggccctcttgctctgcccctatcttgagaagtattcttttcatttttctgaaagagtttctgtaaaatattttcttccttctgtgtttggtggaatttatcagcaaagccatctgggtttggaggctttattattgggcattttaaactatagattgagtttcttttagaaatatagggctatttagtttatttctttaatgagatttggtagtttgtgtctttcaaagaatgtattcatttcatccaagttgaaatttaatggcataaaattatttataatattttctcattatccttttaatatgtgtacaatctgtagtgatgtcatgtctctacttcccaacattggtaaatttgtgtcttctcccttttttttttctttcttttttctttttggcctgtctttttttctgattggtttggctagaagtttatcttcttagaggtaacagagccttaattttattgatttttctcaaagacccaatttttggtttaatggatttttctgtattgtttttattttctatttaattgaggtacactctgatcttattttctttcttctgcttacttgaggttcattggccatttgctttactttagtttcttaaggaggaagctgaagtcactgatttcctgtttcctttctttttttccttttacgagcatttgttgctgtgtttcttttagctgtgtatcacaaattttgatatatttctctttataagcaatttgattatgatatgtcttaatgtagctttctgctcatttctcttgctgggagttcatgaaggttcttggaggtgtaggtttatggttttcttcaaaactggaaaaaatttggcaattaatcaaaaaaattttgctctttacctgtttcttagtctacttgaagttatcccacaactaactgatgctctctgttcattttttccagacagagaaaagactgtagtttctattaccgttttcttcaagttcactaatcttttctggtgtctgatctgctcttattctatccattgtagtttaatctcagttattttagttttcatgtattaatatgatttgggtttttttcgtagtccgtgtttctatttaactggcttagtcttcacttcttgcacatatgtaatgtagttatcatagctagtttaatgtttctactaattctgtttttgaatctgttttattgatttttcttcttaccttataggttgtattttcttacttttttacatgattattaatttctattgtatttcagacattgtgaattctactttgtgccctggatatttttgtattcctgttagtattctagggcttttttctgtggtgcagtgaaattacttcagaaacagattcttgtatttatttgttttttctgagacagggtcacactcctgtcatccaggccggagtgcagtattgccatcttggctcactgtagcctcaacctctcctgctcaagcgaaatgcccacctaagctccccaagcagctgagactacaggcacgggccaccatgcctggctttttttttgtattttcttgtagagatgggtttcgccgtgtcacccaggctggtctcaaactcctcagctcaagcgctccacttgcctgggcctcccaaagtgctaggattacaggcatgaaccacagcgcctggccttgcaggtattatttcgaagctcagttaggtgggaacagagcagctggtagcctacagctaattttccccaatactaagacagtattcttctgagtattctacctggtgtctcttaaattatgaagttttccagtctggccgatgagagcatgaactattcccaacccttagaaatctttggtaattgttctctctcttcctttctggtgactctgctctaggccttgtgtgtttcctcacaaggatatggggattggtattgagctgaaattttgagatgaagatgggacacccccctccccttcctgtctgtatagttgtctctgttttggtactctgtcctacgaattctagctttcttcattttcctgtattcttagcttcatcatctcaacttagggtgaccatcaggctccatctgggttcccttgccctgcactgaggcctggaaactgtctctagaatataagccgggacaattgtaaaactctgtaggattttatttttcttttttaaggaatcactgtagcacactacagtgattcttgtatttatttgttttttctgagacagggtcacactcctgtctcagaactaaccgatatttcatgtctaaagactaagtgttatatgttttgttcatttttaaagcttttcttttaggtgaaagggtatagctgctttctgctactgtattttggccatatacctttcttttggaagctgaaaattactgtattactcattagttaaagaggaaattacagtgaaaattatacaatatctattttgatgaaaaacaattaaagctatagatataaataaagcaggacttccagtcataatttataataataaattcacttattaaaaaataaaaaataaaatgattagatatgaacaccaaggaattaaaaaaagagcagagtaaactcataggcactggaaatgtaaataataaggaggaacaggaactaaatgaaggggaagaaagagaggggggaacaataaaacctaagctcaacatttgacaagatatgtaaaaaagaaaaacctggtaagaacacccaagaaataaaagagaaggcataaatattatttgttaattattgttgcaaatataaagagcatacctactaatttagcagtactttaaaatattatgagcaacttatgctaataaatgtgaaagcttcgatgcaaggatggtagagtcaagactggagactgtagtattccagagaagagattatggtggcctgaactctagggcactagtaatagaaacagagaagttaaaaacatacaacagacatttataattctgtgaatggagggatggggagggttaaggtgttgggttatagcgttctcccttgggcagttgcgagatgttgggtggtatcactacacctaaagtatagcagggtttttggggggattaatttgaggtacatggatgtcggtagcattgtctagttggttatatgggtctgagctttgagcttactgaagtctggggaaattgtcttataaacttaccaacttgtttttctttttgtgagcatgcctttaaatgtttccagaaatataaaatatcctctttttaaaccacattaaaccctcccccatataaatattatgtacctggctagatcttagttagatatgagaacaaagatcctacttacagcagtctcttgtaataaacactaaaatgtatgcttgtaacaggagcccttaactttttggcatagtttctgtgtaagaactcagatttctctgagtgatatggctgtgacttagattctgattctctaaaagtcattgccaggcttgtctgaccctgctgctaggtagctaggcagtcttcactaaaatatcgcctcaaatccttgcatttaactacttaagttcctaaaatacttgaaaatcagctgtactcatttatgtgactgaggtgctacatgtagacttttgtcttcctcttggcttgaacaaaactccaggtcacctcaaagatggaaatgagatggttcccatgtgtttttattttgttaaagagatgtgatgtatattggaaatggcctttcctctgaggctttcattctttgactggattgaaggctgctgcgcactaccttaagcctaccagttttagcataatcctagcctgacctgcactgaactggctgttattaaaaaccttgtctgtgtcatctgaagtattcactgcctgtcacaagtggtactcttcttgcaggcttcttagtgacatataaattacaactatagcttgaacaaggtaaacaatgtggctttttgttacatagtacaacatacgttttcaaagcatagtacgttctttagttttaattgatagattgggaatttcgtgtgagcaggttgataagtgtgattgcatttctgatgtttatgtttcacagaattcttttttttttttttttttttaacgagacagagtcttgctttgtctcaggctggagtgcaatggcatgatctcagctcactgcagcttccacctcctgggttcaagcgattctcctgcctcagcctcccgagtagctggagctataggtgtgcaccaccacacctggctaattttcatattttttggtagtgacagggtttcgccatgttggccaggctggtcttgaactcttgacctcaagtgatccacccacctcagcctcccaaagtgctgggattataggcatgagccaatgcctggccaattattatcatcatcattattattattattattattattattattattttaattattcctgaaaccatcaaaggaaaggcttacaccatggcttagtaaatttttggggccaaatattaaccatgccaccaatttcttatctttttatttcaaatttaatttataattttaataaagaatgcgtttatttacgtttcaaaatgcaaagtgctattttaaaaagtatcccctgagaagtcttgtttcccacccatccccatctgtcccttctccttagttcattttatgtattactaactgtatttttattaatttttgttaatttctgtttattcctttagactttatgcaaaaggctaattcacactaatactttgcaccctggtttctttatttttattccatggagctctctcgttatatcagtcagtatataaagaccttccttatctttttttttctttttttactatatagtattcgtttgttggtatatgctgtagttaattcagccagtccttttgcacttgaatttgttcagtcttttgctattaacaggcaatttcatactgattaagcttgtacatgtgtatttcttatgtatgtaggtttcgtgatggtttcgtttcctagaagggtgtttgctaggtgaaagggtacatgcgtctgtaattttgattgatattattggattccctgtatatatatcttgcattttgcatttcagcagcaatatatgagggtccttggaatgccccccctttccctacagcttgacaagtggttggacttaaatcagattttgccaatctgataagaaacactatctcactgtatattttttgtttgcatttctgttttcagcttatcatatattcaagggccatttgtatttcttttctttttcacatacttgtccattttttcattggattatctcctctgtttctaagaattctttatatgggtgtatttccggactttgtattttgtcccactggtctgtctattcatttgccactcgtatacttttagttcttgaggccatataaagttatattgttagagctgttttctcattgctcttcattttcagagttttcctggcaattactgcttgtttatttttcaataagatctttagaatcagcctttctagttcctggaggaaaaaaattgatacttttattgggtttgtatgaattttaatatcttaagaagagttgatacctttatgatgtttagcctctctaagaatatgattataactttctcttcattcaattctactttcatttctttaaaggtttttgaagttttctttaagtttgcacatttgtgattaagtgaaaatatacaaatatttagttgctattggaaatgaagtctttatttttgctgttgtttgtattataatatgttgtatatatgaagattattgatctttgtatattcttttcataggttactatcttactgaattctcttatgtttgtagtcactaattcttaatattgttttaaagcacattttatggagttggtgagtactatataggatttttttttagtaccaaagtcttggttgagagacattacactatccatttttactggtttagatatgtagcatgatgaacctcagcaagtttaaaaagaatcatttctttattttgacttgaaatttcaagtttttaaattgatgaaaagttgtcatttattgtggcaggggtgatgtgaaatccagccacttattggtatgtgttacaacttagctaagtccagtaatagtcagtacatactactaaatgattcaaaagcaaatggtcttttagatcaagtaatagatctcttaaattgagatgtatttaccttagatagtaagaatgactctttggtctcttataagaggtgaagagagatgctgtttctgggctagtatttttgctaaaatggttttatgaaaaactttcataagttaaaaatttggggctgggcgcggtggctcacgtctgtaatcccagcactttgggaggccgaggcgggcggatcacaaggtcaggagatcgagaccatcctgattaacagggtgaaaccccgtctgtactaaaaatacgaaaaattagccgggcgtagtggcgggcgcctgtagtcccagctacttgggaggctgaggcaggagaatggcgtgaacccaggaggcggagcttgcaatgagccaagccattgcactccagcctgggcgacaaagtgagactctgcttaaaaaaaaaaaaaaaaaaaattgggggcttgaagttaaagcacattgtcttgagtaaaagatattggtagaagttcagaaatgtaaactgaattgtcttttatcttattttacctaagtggactatggaatattaagctattggtatacaaatacttgtaggccgggtgcagtggctcacctataatcccaacacttcatgaggtcgaggtgggaggatcacttgaggtcaggagtttgagaccagcctgagcaacatcgtgagaccccatttctacattaaaaaatttaaaaattagccaggtgtggtggtgcatgcctgtagttccaactgctccggagtccgaggcaggaagattgtttgagcccaggagttaagaggctgcagtgagctatgatgatgccactacattccagctggtgcaacagagtgagatcttgtctcaaaacaaacagacaaacaaaaaaccccaaaaaccaaacctgtatttcccttccccttttcctgatattttaatatttaagtatacatatattctacataatgaatactgtatctatcatcctgaactttttaacagctctagtcttttgtatactgaagctttcaggcttcaaataaagcatacatatcaaaatattttgaagagtaattgaaatctcagtttctccccctccttttaactaaacagatggaaagaattatttgatagtgttttccagagccctttataatgtagcatatttgagtgtctgattctttgaataatgagtgtgagaaaattgaaaattgaaatgtagagcgctatagtaggttttagtaaacaaagttttgttatgtcacagtaaatggtaatggataaataggataacaggagtgtcttatatttgggaaattacattcatcccaaaagaacaaaagcagtaagcaggaagacaaattagcttaccctaatagtgagaaagggagctgatagtttagcctcatgaggtcaaattatgtaatttctctattgtataacagaagagtttcagaagcattccattttctttttcagattaaaaagccagcattatcagatagtggaaaagcttattaatacttgctgtgtagcctgaataaaaccattattttaaaaatgtgtgtgtgtgtgtgtgtgtgtgtgtgtgtatgtgtacgtgcatgtaggttgtttggtaaaatccactttttatgtacttgcttagatttgtcagcagcaagctatgttgctaaatttctttggtaatttttatacaacagagccctttgcaggtgggtttattgcacattgcaatattagtacttcattatgtgttggtgttatttcttgagtgggaacaatggcattcatctcttttttttaattaaactggatattagaatgctggaaggttgtttaatttcatcagtgtatatctgaactagtattttatctggtcttaaaaataattgctgtcatagtggaatcattctcttgttccatttttgtttcagatgttaagagttacattgtgattttcctatttctggaagaataattagagtctgatggattcaaattccttctgatgcacaggaaagcccctttccaggccagtctcaagaaactttgggaggaggatatagcactgacaaagggtgatagaaactagttattatcaaagatctagttgctgccaggcgtttttctgtttagtcgtatccttggcatcataaccacattctgcctatcttattccctgaagttgccctcttcgtttctccataatctggtgttacatttctttctcctgtccgtctggccaagctcttttataacttatttgtgaatatgctgttttgatacttggctgactgagtgagctcaggtccgtctctgtggagaggaatggccctcctccactatcaccccttcctttgaggactgttctagacacctctggattaaaagcacaacagaaaacatagctatttattcttggaaataattacctaagcaaaaaataatgtggctcttgtgagtttttgttctggagaaccacaatctagaaaacctgggataaagtagaatttttaaccatttctctccattcccattaaatgaccttagttcaagctgtcctcatttcaggcttgctgtagtgcaacgtgtccttagaagttgttctgcctttccctggctcctcctttatgtttctcccaagattactataatgcaattgaagtaaatatccagcagtaacagaagcaaatgagatgttgttgaagggtattgggaacaggagaaaagtgaaaacagtggtattcatattggccattctctcgtagtaggcagatttttagcaagaggagtaatggtagaaaaatttttataaagcataacaaaagtttctaatattgctaggtgtgctttgtaagagtaatgttcaaagccttgatggagcttagttataaattaatttaatttactttgaaattttatgtcatgagaaagcatatgtatgtcgttctcatttcactgattttaatgaaagatatacaactgacccttgaacaacacaggcttgaacttgaactacacatgtccacatatgcagattttttttaaccaaactcagtatttgtgtaatgtgaaacccatatatatatggctgacttttcatatacacaggttctgcaggggctgctatgggacttgagcaagtgtggattttggtacactcaagggtcctggaaccagtctcctgcatataccaaaggtcaagtgcagatccagccctcaaataataggcacaaattctagaaattggttcattcaccccagatttaaacataagtgatcttaaaaaatgaagtttgttgctcgctttgggagcacatatactaaaattggaatgatacagagaagattagcatgggccctgcgcaaaaaatattttaaaaaattaaaattttaaaaaatgaagtttgctatacatagctttttttaaaaaatggatggattgtaatgacttcaggtaaaaacgggattctgaaatggataggttctaagttttatgactgatacgtttgaaaagtatattctcttgtaaaatggaaattatcttaagtaaaaggcttctaaggagatagattttattgggtagaatatgttgtgtttttataatgtacttaatctggactaccatcagctgtgtaaacattctgtttattttacacatttgccaccagtttgtacatttttgtgtttcattctctacattcacaggtgaagtcctcagtaatttaatgaaaacattttctaatgagctcacttaatcagtttctccaactcaaaacaaattggaggtagggatgctgtacacacagtcagtaagaaataaccactaacagcctgatgagagagaaggagaaaaccaaaatgcctcaaattaagtaagcagaacagtccagatttacttagagaagtggttcttaaccttatggacacctggcttagtcccctttattctgttataatggaatacctgagactgggtaatttataaagatcaaagatttatttggctcacagttttggaggctggaaagtccaagagcatggcgatggcatccagttagggtctttgtactgtgtcatcccatggcagaaagtggaagagtaagggcgaaagatcaagagagcagaagggagccaaactcacttttataaccaactcagtctcaagataaacaacctacttcctcagaaatgacattaattcattttctggccttatgacccaatcaccccacctgccaatactattacattggggattcagtttccaacacataagctttgagggacccattcagaccatagtgacagctaatggagtctgtaaacatttttctcagcaagaagtataaaacatatatcagtttgtattcagtgtcaggaattcttgggctcactgaagcccagccttgggccccaggctaaaaatatgatttagtataggggcaaatagctttatgtgtctaatttaagagcgtcactttgggatgctttatagataatttatataataggcaatattgagttagcagaaaatgttaaattttgtatcacacgcttaataaacatacaatgtttcttttttgaattaaaaaatatgcatttttcacttaacatttatcccattatctggaaaacttagtcttcattccccagggatacgggttagagaagtgatattctgcatttgcattaaataagcttcactgtaattttttttttttttttttttttgagtaggagtgtcgttctgttgccaggctggagtggagtggtgcaatctcagctcactgcaacctccacctcccgggttcaagcgattctcctaccacagcctcccgagtagctgggactacaggcgcgcgctacctaccatgcccagctaatttttgtatttttagtagagatggagtttcaccgtgttggccaggatggtctccatctcttgacctcgtgatctgcctgcctcggcctcccaaagtgctaggattacagatgtgagccaccgcgcctggcccattttcacattttaatcagtgatgtccaggagactttttgtaccagcgagattacgagcatctcctcccaactccatgtgcagaaatgccaggttggtaggttgtgatctgccttggtgggagtgtttacaccacgaaaatgttagaaatcaatgctcattctgccttcattcccccaagctgtttttttaaacatttaccagcacacaactgattttaattactcattcagcaaacatattttgagcacctgttgtcttccaggcactgttcaaggtgccaaggatatagtagtgaatagacagtgtttacttaagtgaatgtatttttctaaatcctaaattttctattaaattggggagcttttaggggtccttagtcaaataatggtgggagatgaagaatcaaacaaaagtaaatggttttctttgccacagaactttcagaatcttttaatgtgctggtgtgcacagttgatctctaggaggagagtatagtatatattctttctttctttctttttttttttttttttttttttgagatggagtcttgctctgtcgctcaggccagagtgcagtggcacaatctcggctcactgcaagctctgccgcctgggttcacgccattctcctgcctcagcctcccgagtagctgagactacaggcacccgccaccacgcccggctaatttttgtgtgttttttttagtagagacggggtttcactgtgttagccaggatggtcttgatctcctgacctcgtgatccgcctgccttggcctcccaaagtgctgggattacaggcttgagccaccgcgcccggcctatagtatgtattatttctaatacttaaccaataactcttttttttccagaatatatttaacatgtttcagaagtactattctgctgctccaggcagtcatattgcagatgttagaaattggtgaataaggtcattactcaagagatgtatgtcggtcagaatatgggcaggatttctgaagacagactttcccatcgtgtttatagggcgattgatttttaggttgtggattgagttactttattgatgttttcctgaactatcctgttgtattttcatttccagtatttttttttttttaatttttatgtaaagcactgctctacttatatgttgttaatcttagaaaagtgctttttcttctgatctccagtttctgatttggggacacttaatgatatacgtacatgaatttctgccaccacttactccctgttgctagactttttctcagccctgggcatcccttcctccagtgcctcttgctgaaatgggagtctcttaaaccccattcatctgccatttcacgcttattagactatggtgtttctcaagtgtgagtgataggctattgattgaatcagtcacttgagtagtattaaaaccataggttcctggggctcacctcagatctgctgattcagagtctgcgtggtgtggaagccaagactctgtgatttaaagcagatctacaagtggtttgtattgagttgtttaatttccatgctgagttgtttaaatttcattttttggtaggtgtataccgtatttctcagtgtaggtgctactggcattttggccaggattatcgtgtggcaatctgaaggcacaacaggactttaaaaatcattgggtcctacctaccaaatactattatcatccccagttattgagacaacccaaaatgtaaatgtccctccacatttccaaacacctcctttccatttttatggggttagtatcctcaattaagaatcactgttatatactactttcattattttagatgttgatcgtaataatttaatatacatacctaacctaagaccccaaattattcactaactctgtccacttcgcaaactgtataaagtcttcagagcaatttaattgtacttccaccttcctatttccatggtattttgctccatatttgagttctagttttttaaaaattgcatagacattattgtttttttacagtcatcaatgtttatctctacccaagattggtagtttatttgatactccttgcatcttaaactttctttctgagccttttttgatcctgaaatacatcctttagaagaatatgttattgcacatcttttggcagtgagcccttggtgtttgttagaaagtgtctttattttgccctattttattgaataatgttttacctgagaatataattctagactgacttaactttttttcagcactgcattttctacagtctttctggctttcttttttctctgaaaagtctaattgttgttcttttgtggataatctgactccttttctctgagtgcttttaaagatcacttctttttctttagtttttttgcagtttcatgtagtgtgtctagatgtggatttcttgtttatttgctctccttgagactgtgtcttctgaatctgaggttttgtcttttacccattctggaaaaatttcagccatggtgtcttgaaatattggttctctcttccttccttgtttaattagatgtatattttcttattctattctttgtgtctcttaatctctcattttctatctcttgctctctttgctgcttcagatctgccattttgtctaattttatgtctgtgtacaccagttaggtttttaatttcgttttttatttctagaaattctattttgttctttttgtcctgtctgccaagtcatttttgttagcctcttgcttctgacccatgtatttatttatttctagtgttaacttttaaaaaatctgtcctatgtatttaataccttcttttatttctttaaacttttaaagcgtacttgattgtaatgttatatatcttttaattcctaaaatttaacttctatggatttgatttggtttttcatagtttttactgctctggtggtttgtttccttttatgcttgataattttgttttaagctcatatctgcctaataatattatgtggtaatttcctggagtatgggttgaagatgtgtttatctacagataatttgtttctccctctgccaggtgccttgtgttaccaccaacccagaaacaacttaaatttatttcttgacttgaggctcctggccctcaaaatcagtgtaaattttaaccctatgctctactggggacagacttgtgattatggatttccagggaagatattttgattctagtgaaggcctgatttgaacaaattgcctgttgtggatagagcccttttccccaacctacctgtgcggtgtgactcttcaagggcattgctggttttatgcagtggtcccaatttcagctttcaccacatctaataaaaatcaaaactgaagtccctagattccaagtttaatctaaggccatggcttgagcttttgtttacagctctgattttattcagtaaatacatttaacagattttttaaagctgtttatactacatctctttgtgccacctgtgaatttatttgcttgtgagttcagtgcacgtaaaagagtgtttgttgtatcttgtctgctatttctagatatttgtaatggaaggatattttatatctagtctaacttatttccaaaagtgaaatcttggaaggtgtttacgcacattggggtctgagcacctttgggctagaaatgctgctgctattgcttctatagtgcaaagttggaattggttacctgatctcttatgctttcccaaactcagtgctactgttaagttttatccatattattagtgtggtctgccagttaccatttagaagtgttattgatatggaacaggtccatttttgaattccaaaattcagaattaaactttgaaatacaaattactgatatgttggaactgtctgtactcttttatcactcacagattattttccatgtctatatccaattattatctgctaagtgcattttttgaaagttaatgatagcctcaatctgtttttaaaatttttttttattaggaccaggtagtcctagaaatgtagatctttaattatctggttttaagaaacaaagagccattcaagttaacttaagaaaagagaggctattgtaaagatacatgatacacggaactggaagcttgtcaggaactcaaggcagcttggagatctgctcttttcttatggtcttgtaattttttctgtccatctgttgggttatttgctctttattgattgtctcttcattgcgtcttttctatttcttcaaaacttcactttatgcccaaagtcctgcatgctgtgacactggcacatagcatggtttcacagtgagttacattgcatggtggtgctatttctcagtatttccagtttcaaacattttagagttgtgctgtctaatgcagttatcactagccacgtgtgacttttaaaatcaaaattgaaattacgtataggatctgtatgctgataactgcaaagcactgatgaaagatatcaatatctaaataaacagagacacctgccagtagtgttcatggattggaagactccacatagtaaatatgtcagttctttccaaattgatctatagatttaatgtacttccaaataaaagtcccaacagcagatttttttttttaaacagacaagctggctcaaatttatatggaaaggcaaaggacctttgttgccaaagcaactttgaaaaagtaaaagttggaggaatcacaaaattattgtgattgtaaatttaaaatttactataaaactacaataatcggccgggcgtggtggtggctcatacctgtcatcccagcactttgggaggccaaggtgggtagatcacttgaggtcaggagttggcgatgagcctggccaacatggcaaaactccatctgtactgaaaatacaaaaattagctaggcgtggtggcacacctgcagtcccacctactcaagaggctgaggcaggagaatcatttgaacccagaaggcagaggttgcagcgagctgagattgtatcactgcactccagcctgggcaacagagtgagactccgtctcaaaaaaaaaaaaagaacaacaaaaaaaattacactaatcaagactgtatagtgtaggtaagagataaacacacaatcactagatcaatatagatcaacatggggtccagaaatagatccacacaaatatagccaattcatttttgacaaaggtggaagtcagttcaatgaaaggaaaattgacttttccacaaatgataagaaagagttggacatatacatgcaaaaaaatgtacctaaacttaaactgtacaccttacacaaaaatgatctcaaaatgtatcatgaaactaaatgtaaaaacataaaacttttagaagaaaacacaggagaaaatatttgtgacctggagttaagcaaaaagatcttggatgtgataccaaaagcacaattcataaaagaaactattgataaattggactttatcaaaaataaaaacttttgctctgtatatttgtttggcaaggctgccataacaaaatgccacagactgggtggcttcaacagtagaaatttattttctcatagttctggaggctggaagtccaaagttaaggtgccagcagggttggtttctcctgaagcttctctccttggcttgcagatggcctccttcttggtgcatcttcacatggccttttcactgtgcatgtatatctctggtatctcttccttttcttaaagggacatcagtcttgttggattagggccaacccatataacttatttaaccttaattacctcttcaaatgcccttcctctgaatatagtcatgttctaaagtgctgggggttgggacttcaacatatgaatttggtagggagcacaattcaattcataaattctgcaaaaaacactgttaacaagaatgaagaataagttacagactggaagaaaacatttggctgggtgcagtggctcatgcctgtaatcccagcactttgggaggccaagacgggtggatcacctgacgtcaggagtttgagaccagcctgaccaacatggtgaaacctcatctctactaaaaatacaaaaaaattagccgggtgtggtggcagttgcttgtaatcttagctacttgggaggctgaggctggagaatcgcttgaacccgggaggcggaggttgcaatgagccaagattgcgccattgcaccctagcctgggcgataagagtgaaacttcgtctcaaaaaaaaaaaaaaattgcaaatcatatatctgacaaaggactcatatatagaatatatatatatatatatatatatatatatatatatatatatgaagaacgctcataactcagtaagaaaataaatattccagttaaaaacatggatgaaagactggaaaacagttcatcaaaggatggcaggtaagcacatgaatagactaagagcatcattagtcatcaaggaaatgcaaactaaaaccaccatgaaatagcatttacctacctattaggatggctgaaataaaaaatacaatgccagctcttggcaaggatgtgaagcaagtggaaccccaccatgcgttgcttctgggaatgaaaaatggtacagtcactctggaaagttgggcaatttcttataaggttaaacatatacctaccatatgatatgacctagtcacactcctgggtatttatctaccctgtatacaaatgtttatagcagctctttccgtatttgccaaaaactgaaaacaacccagatacccttcaactggtaaatggatgaactgtggtaaatccatacagtggaaccctactcagcaataaaaaggaataaactaatgatatatgcaacaacttggtgaaagaagagtctaaagatgttatataatgaatgaatttatatggcattctcaaaaagaaaaactgtagtcatagagaacacgttagtgtttccagggtttagggaggattatgacttccattggagtttttgcagtgatggaactttcttatttcctgatggtggtggtggtggtggttacataatctaatatatgtgttaaaattactagaactgtatctttaaaaatccattttattgtctggtagttaaaaaaattaaaaactccaaattttaaatatttcattttgtacacacgtacaattaaacaaaattcagtttttcacttgcactggccacattttaagtgatcaataggcacatgtggtatggggctaatgtattggatattgcagatacagatcatttccatcaatgcagaaagttcttttggacaatgctgggttttctttgttttgttgctgttgttgttttgagatggagttttgctcttgttacccaggctggagcgcagtggcgcaatctcagctcactgcaacttccgcctcccgggttcaagcgattctcctgtcccagcctctcgagtagctgggattacaggcacatgccactgcgcccagctaatttttgtatttttagtagagatggtgtttcatcatattggtcaggctggtcttgaactcctgacctcaggtgatccgcctacctcggcctcccaaagtgctgaggttacaggcatgagccacgacgcccggcttgagccaccatgcccggccgacagtgctgttttaaagcaaggatcagcaagttgtcgataaagggtcagatagtaatacttcaggctttgtgagccatatggcctctgtcttagctactcaactctgccattgaattttttttttttttttaatactggtcttactctgttgcccaggcttgaggacaatggtgtgatcatagctcactgcagccttgatctcttgggctcaattgatcctcctcccacctcagcctcttgggtaactgggactataggcacatgctaccaagaccaagcccagctaatttttgtattttttgtagagacagggtttcaccatgtttcccaggctggtcttgaactcctgggctcaagcgatctgcccacttttgcctcgcaaagtgctggaattacagacatgagccatgtacatgtggctatgtaccagtaaaacttttatttacaaaaatagacatgtttgctgatccctattttagagaatttgccctgtttcctattttcatgtcagctcagggtttattggtatattaaccttataatttatcatccaaatttaataaatgttcagttgtttaagagtgaacacaggcactcttattgtactggtagaattattaataattctaccggtacaataggcataaccaggagtactctgggtaaaccagggatgtatgtcactctgttagttttcctatgaattggttgcccttgtagtggacacatacctagtgacatgatttggctgtttccccacccaaatttcatctttaattgtagttctcataatccccacatgttgtagaggaacctggtggaggtaattgaatcatggcggtgattaccgtcttgctcttctcatgatagtgagttctcatgagatctgatggttttataaggggcttcccctcttttgcttggcacttttcattcctgttgccacgtgaaggaggacatgtttgcttccccttttgccttgcttgtaagtttcctgaggcttcccaaccctgcggaattgtgagtcaattaaacctttttcctttataaattaccgagtcgcaggcaattccttaaagcagcatgagaacaaactaatacacctagtctaatcaactttgggaaagcgaacatgaagccatcccttcagcagtgagcatgggttatccattttcttctgaaagggagtagttgtatgggaagtactctgaggtttggctggcctggtacactcaaaatagtctgtgttttctgtccccaagcctttgctcatgcttttcgttctgtgcccttttccccatcccttttgtatgtttttcctaattcaggccatcttttcaaacctctgcataaatggtaacatcttcatgccatcattcctgtaataccttttcaggcttataagttggtggttacattttctaaaagtcagtaacatagtgctttaaactgggtccccaaacctgactgtgtatcagcagtacctcagtagcttaagatacagaatcctgggtcccattcttaatcgcttgacctagaattcaaaatttgtagcagtattttgttattgttttgttttgtatttaaactctttatatgatttttatataaccaactagctggttcagtatttggaatctgttgatttagaatgaaattatttgatataaacattgacttttagaattagaaggaaccttagaaatagcctgtcttcaccttcatgttattaaattgtgggcagaggggtcaggaagaagacacaagggaaattacttgctcagatcccattgctggttactggcagagccaggactaaacgttgttaactctcactcagaacttgtattcatattcacatcggacatgcccttctacatagtaaggtttgagtactccaaggggctcaatacatagtagatgatggtcagatgttttactgataatgactgtttctaacccactttatattgtacctagcacattttttggctcttaatgattgctgcttgaatatgttgttaaccctcagttcactctcaaggaatgcctttctgatagttggagataattccacaatctgcgtgaaatcatctcagaaaaattctttccaaaactagttcaaatctgaatggcctctgaaaggctcactgaatcaaactaaattctggtacagctttgaaagttagtactttcccagagcccctctaagccgagatcggtctagacctgcaggattttcctcaccagtccacttccattttagaaaggttacccagaacctatgggagtatgtggtgggggacgtgtatactgaaataaggtgtgagaccagggccaggaaaaggcttgtgggaagtggtggtagcctaagctgagcttcgaaggatgtctgttaggccaggggagggagctggaacaaagcgtggatggctctggggaatagcaggttgtttagtttggccagaggataaagtacaggttagggagtgactagaaatatagatgggggccagattaaaatgtggtatttcacaatttcatatccataggcaaaagaatgaaactgaagccctatctgacacagtataaaaattcactcagattatagacgtaaatttaagaaaactataaaacttagaaatcttagaaaaaaaaatcataggaaaaaagtatttgtgaccttgggttaggcaaatggtttcttagctgcaacactaaaaacacaagaaacaaaaattagttaagttggacatcatcaaaatgaaaaggttttgtgtttcaaaggatacccataagaaaatgaaagcatgtagaatgggagaaaatacttgcaaatcatgtgactgataagggatttatatccagaatatatgtgaagaactcttacaattaacaatttaaaaagaatttaaaatggacaaagaattgaatagacagttctccaaagaagatattcaaatggaaaattgaaaacaggtccacacaaaaatgtgtacactgatgtttatagcaccattattcataacagctaaaaagtagaaacagcccaaatatggtatttccatacaatggaatactatttggcagtaacacataaatgagtttgagacatggatgagtctgaaagcattacaccaagtgcaagaaaccagagtcacaaaggaccatgtgttatttgatcccatttacatgaaatatttataatagtcaaatccatagagatggaaagtagattagtggttgccagggattgagagtcagaggaatatggagtgactgcgaatgggtctggggtttctttttgaggtgatgaaagtgttctaaaattagttagtatagttacataactctgaatatactaaacacaactgaatcatacaccatgaaagggtgtacttcatggtatgtggattctatcccaataaagctgttataaaaagtgctgtatttagtgaaagctttaaatactctgacagggaatttggatttttgtctttaaagcaatgatgtgttgtacccttgcagagttataagtcaagaacagcatgatgagaacatcattgtgggagcatttgaagaatggtggtcagatcagtgttgcagcagactagatctagctgcttagaatattttatcctgttttctgcccttcacaagtatgaacattttatgttacatattctgaattcaaaatttttaactttatacgtgctaatattttataatttctatcttgctctcctttttaaaaaataaactgctcaaggtgattgaaaaaaagaatagcagttgcagaatgttagagataatattgacttttaaatttacctttgtgtgtaaccttgactacagtcaatttagagatagcaaaatatgacttattttaggcagaagaccaagattcctggtgaatcataaagctttaaagaccctttattaataaacatggattttactaaggaaaggcttagaagtgaagtttcttaaggactttcaattgtctgttttcccctttttgtgaaatatcttaatactgccaaataaattacatattggaagatatttctaacatcatagaaagcaaaagaacagtaatcattttagctctatgtttttttcagttaaccctaaaaaactgtaatttaaaaactgttagcctttaggaaattctagactgatttaccacttgaaataattgtattcataagtcaaccctataggaaatattgaccttggtaaaccactcatcagtagttagtgtcataatttttctgttaaatatatgctggtgttagtaaatctatttttagaagagtacattgtgtacagcaaccattttggacaaacactgtgtaacttgtaaatagagagtgtgccctcctgtggtcattggtaacaaaaatctcagttataatcatcctagctttctgagttcacatttgtctgctcttccatagtagaatcacccatactctgaatttcttctcagtaagtaaaaaaccatagcatgatttttaaatggtggcagttgtcttatttggaggagatgctaaaggagaatcctaccagagaaaagatatcaaagtgtgaggagaggcaagtagttgtgatggtgcttgaaaagctttatgactattacacctgaatgtttttcagatacactctgcctcctttacagaatgctcccagaatgatattctggttttatttctatttcatcatttatatatgttttcttcctagagaaaggaactagtatccagcactgtctatttgaaacatctatcccattttatggaaattaagtttaatttgaaataagtcttcaaatctcttttgtactgccttgagtgtttattagttatggggattttgtttgaaggaacaatttttaaatgaattttccctgcaaattttattaatttctatgagatctcttaatatctttgttcttcttagagttaaatggttaaattttatattttcagcaatgacggtgcctcatatcttagatctttggctggtatttttagtgccctagtattcttagaagaattccactgttaatggtgttaccatctcttgccaggtgattcactgattttcaccaatccattaataagagagtgttgcaactaggaataaatctggtcacatgaatggatctttctgtgatcagggaatggcatgtattgttcttcattggtggtatgaatattatttgtagttaacagtttaaaatatcaaattgaaagttctgatccaattataaaatatcttaaattgacaaagacttactgccattttaatatagtttctgcttatttatatgtgtattatatataatatatattgttatatgtacacataaatacacataatataattatgtgtacttatatacataattatacagttgtaaatgccaggaatctataatttgattttttaaagtgatttttaatatgtggcttacaaaaataggttttgcattgaactacatgtatttgactgtaccatcaggtgtgtttaaaaggatgcagggggcctgttttcataattatatacacaattgtgttagcctttcatatcctaaagcttttaaatgaaaaaatataaggctagttaattagttcaactagcctttgaatgaatagcaatacagtgtaatacttaaaggctcagactgtggagttagactgcctaggtttgaatcccagcactgtcgactcactggctgtatgaccttgttaagttcttttgagttctatgtcctttagtttcctcacttgcaaaatgagaataatatcagtacctattttataaggttgttgtgaggattaaatgaattaatattaaaacatttagaatagtgcctggcacatccgtactaacatctaagtgtatattagctattagttttgccaatattaaatttatacataaatgttgaaatttattgtgaaggaaaaactatttgttttgtaaatataaattacatttgcatttcttttaaaatatttttatataactgaaaacagtaagctaaagtgaaattttatacactttttatgaaagctttcttcacaataatccttttttcctctttcttttaggcacggaatgttaacactggtgaattagcagcaattaaagtaataaaattggaaccaggtaaattgtttgaaattcattttttcttactgctagaaagccatgggatatcttaaggcttattttaatgatgtttggttaacattctcttgttttccccaacatctgggataaatagagctgcttgtatgccctttcctccacttcttcaagttctgcatacaacacaccttgctcagttcttccctgaaaagtaactgataattgggggaggaaggggaactcctcctgaaaagactttgttctttctgaactcagttgagctaacttgtgacaagctgatagtggtttatttccaggctgacgtcttgtggtgtcagtgtgatgtagtggaaaaaacagaactgaaatttaggtagttgtagttcagtttgtctcccactcccttgctctgtgaacttgggcaaatagcttcatgtctctgagtctcagtttttctcaggagatctagcttccacattctgtatttcattgctatcccagcagttgtctaccaaattgagcagcttattgtaaagccccttaaggctactccttattttttgtctgcttcaactatgttctttgaattcctcctacttccctcaaaacccacatttttcttagctaattactcactctttgtttattctctcttagaaaccccttcccactctttctccttcccaccataagcaagtctataattgtgctagtgtctagaccgagtaccacagcagttagtgcctttctgatgacttcttcctttacaagctgataataagagtttattggtgaaacaagttttagctccagtatgaacagaaatccattcagagactttgcaagagtggaaaaactttttctgtttaaaaaaaaaaaaaaggccaaatagccaatactttagactttgtaggtcatgtatggtctctatattcagttctccctctttccctatagtttgctcaccccttatttagagcatcaataaactttttagaagtgatattaaaatgaaaatttaaggatgtgctgattgactgtgatcaaaccacacataaataaaatgaattaaaaaaattttccagttatacatatttacagattttatgtagtcgttatattctaaacatcgcaagacaagatgtttatcttttttctgaatctcctactcttcaattcataagaaatttaagaaggatatttgaagttgttgaaatattagctacaaaaagaaatttggcatttaaagcagggccttcatttttaatcattaagcagtgactgtgttacttaatgaaatggttctaatgagaagtattttgtgtatacatcattccctcaagaaaccttctctttcaggaagccttgcttgaccctgggtctaattaagatgactcctgagtgattagctctgctgtagcactgaccatagctatattgtcattctagacttgcctttctttgtttctaagttttaatcaaatttgtgcccccagcactgagcttagggcctggcacatagtactcattctgtacatcttaaaatttccttaaaaaattaaaaacttgaaaaagcttactgttcaagtcaattattttctgttcatgaaatgttcaagttgttgcactgtcagtcttggacactgccatgtgtatattgatcaatgtaataaaagtagaatatacaactatacaaaaggaaaaaaataaaaatcattcatattctgccacccagagaaaacaaaggttaatcaccataaatatgtttcctctattacagctacccatttccccccgccaccagttattttgatccctcaatcataaaattccagcccatagtatttctgtgtatatgcctaaagtataaatactcaaaaagtgtaatcacaaacaggaaccctcatacacagctggtggaaatgtaaaatggtgcaaccactttggaaaacagtttgtcacttccttaaagtgttaaacataaatttgccataatgacccagcaattctactcttgcatatctgccgacacaatgattgtcatgcacaaatgtttatagtagcattattcacagtatgtctcaaaattggaaacagtctaactgcccatcaactggtgaatgaatatgttgtgttcatacaattgaatactattcaacaataaaaacaagttgctgatagcatgctgtaacataggtgaccaaaacgtgctaagtgaaaggagctagacacacaaaactgcatactgtatgattccatgtgaaaggttcagaaaaggcaaatctgtggtgtcagaaagttaatctggtgagctggggacgaggtggactaacaattattgtacgtgaagggtcttatgggaataatctagtgatggttgtacaacttggtaaatttactaaaagcaccattgaattatacacttgaaattgctgaactatccaatttaaacgtatgccttaataaaattattaaagatacgtaactacaaccattaacaacattacagttctttattaataagacctacgcttagcaaatagttgctacgttatatctataggttcccacttaatttctttttatcttttttccttgtaattttctgtggaagtaactcgatcatttatcctgtaaagttcccccccagtccagattttgctgattgccttgttgtagcatcatgtaatatattctttggtgacttgatagatatctctagagaactgagtagactccggttttatttggggtatggaggagggaactacttcacgagtggtgttacgctcacatttttctaaggtagaggggtgtgtgtgtgtttaagagacagtgtcactgtagcccaggctggagtgcagtggtaggatcgtggctcactgcagtcttgatctcctgggctcatggtatacttctacctcagtctcccaagtagctaggactgcaggcgtatgacatgacacccagctaatttttattttttgtagagacagggtctcactatattgcccagtttgctcttgaatacctggtctcaagagacctctcacctcggccttccaaactgctaggattacaagcatgagccactatgtctggcctaaattagagtttttgatggctagtcttccattttttggaaacaaaaattaagtctgaaatagtctagtgcaacatgttggattttaagaatttctgtctagagtttgttcctttttcctttttttacagctgataagcaatttgaacctgaagcaaaataaaaacttacgcagaccttttgaccaaattgtttaaatgtgaagttactccaaggtgtctgactgttgcttctcatcttaattatgcagctttaaatttaaaaaatttaaaaaattttgtttaatttttttttaatttgtgatggagtcttgctctgttgcccaggctggagtgcagtggcccgatctcagcttactgcaacctctgcctcccaggttcaagtgattctcctgcctcagctgcccgagtagctgggattacaggggtgcaccaccacgcccggctaatttttgtatttttagtagagacggggtttcactgtgttgggcaggctggtattgaattcctgacctcaggtgatccacccgcctctgcctcccaaagtgctgggttaacaagcgtgaaccaccgaacctggcctaatttatttttaattttaatttttattttttattgttttgagatagagtctcgctctgtcacccaggcagtggtgtgatcttggctcactgcaacctccgcctccgggttcaagcaatcttcatgaatagctggaattacaggcatgcaccaccatgcctggctaatttttgtatttttagtagagacaaggtttcatcctgttggccatgatggcctcaaactcctggcatcaagtgatccgcctgcctgggcctcccaaagtactgggattacagatgtgagccatttttaattttcgtgggtacatagtaggcatatatatttctgggttacatgagctattttgatacagacacgcaatgcataataatcacaccagggtagatggatatctgtcatctcaagtatttatcctttgtgtttcaaacagaccagttatactcttccagttattttaaaatgtatgattggattttttgttgttgttgttactaaagtcaccctgttgtgcttgcaaatactagggcttattcattctttctaattttttgtaccaattaaccatctccaaatcccttctacccccccaccaagccctgtaagcttcccagcctatggtaaccatgcttctactctctatctccttaagttcaattgttttgagttttagctcccacagataaatgagaacatgtgatgtttgtctttctgtgcctggtttatatcacttaacataatgacttccagttccacccatgttgttgcaaatggcaggatctcattccttttaatggctgaatagtactccattgtacgtatgtatcacatttctttcttcattcatctgttgatggacacttaggttgcttccaaatcttggttattgtgaatagtgctgcagtaaacatgggagtgcagatctctctttgatatactcatttcctttcttttgagtatgtatctaggagtggaattgcatgattgtatggtagttctatttttagtttttcgaggaacctccaaactgttctccatagtagttgtgttaatttacattcctactgacagtgtaggagggttcccttttctccacattctcaccagcatttattgcctatctttttgataaaaggcattttgaataaggggagataatatctcatggtatagttttgatttgcatttctctgatgatcagtgatgttgagcaccttttcatatacctgtttgccatttttatgtctttgaagaaatgtctgttcagatcttttgcccatttttaaattgaattagggtttttttccccagtggagttgtttgagctccttatataatctggttgttaatcccttgtcagatgagtagtttgcagatattttctgccattcatggggttgtctcttctctttgttgattatttgttttgctatgcagaagctttttaatttgatgtgatcccatttgtccatttttgcttggttgctagtgcctgtaggatattgctcaagaaatctttgcccacaccagtgtcatggagattttccccaatgttttcttgtagtatttccatagtttgaggtcttagatttatgtctttaatccattttaatttgatttttgtatatggtaagaggaagggggtctagtttcagtcttctgcttatggatatccagttttctcagcaccacttattgaagagactgtcctttccccagtgtatgttcttggtatctttgttgaaaatgcattcactgtacatgtctggatttatttctgggttctccattctgttcactgatctatgtatctgtttttccagcagcatgctgttttggttaccatagctctgtagtataatttgaagtcaggtaatgtgattcctacagtttctttttttttttttccttaggatagctttggctattttaggtcttctgtgggtccctaaaaattttaggataattttttctatttttgtgaagaatgtcattcatattttgataggaattgcattaaatccttagattcttttgggtagtatggacattttaacaatattgattcttccagtccatgaacatggaatatctttccatttttttttggtgacttcttcaatttcttacatcaatgttttatgttttcattgtagagatctttcatttttttggttaattcctaggtgttttattttattttatttgtagctattgtaaatggaatttctttcttgatttctttttcagattgttcacttttggcatacaaaaatgatactactttttgaatatttattttgtgtcctgcagctttactgaatttatcagtttaatagttttttggtggagtctttagatttttccaaatataagatcatataatctgcaaacaaggataatttgactgcttcctttgcaatttggatgctcgtttatttcttgctcttgtctgaatgctctacaaaaatttaatatataaatatatgtaatatatattatatgtataaagggatcaattcagcaagaggatgtatatagatagatgtgtgtgtatgtatacgtatatatatacatatatatatatagagagagaggatatatatgtagtgaccttcttagctcttcttaacagtttctattttgaaatcttttttttctgatatagctactcctgttcttttcttgtttccattggcgtggaatatctttttccatccctttattttagtctgtgtatcttcataggtgaaatgtgtttcttgtaggcaacagatcattgggccttattttcttatccattcagccactctgttttttgattgcagaatttagttcatttgcatcacatcagtgctcaaaaagttgtggattttggagcattgtgtatatcagatttttgaattagggaaattcaacgtgtattggcaagagttaaacattccactctttcctggagaacctaagtcactttgacatagagaagcagtcttgatttacatcccagatggcagagcttcaggtaagagacagtgttcacatccatcgtaactttgttgcttataaggacaaagaaccttgggttcattttataatccaatcctgaagtctgcccctttacatacagctctcctttgctctaagcctatcaaaacaccacttcatttaaatttcacctcacttccattttattcaaaatattacaaaaactcttatcttttcttttggtgagatgccctaagatttctctggcgtgtagttttcctcattgcaatgggtcagtaaacctgaatttgtcagatgacgggtttgttcctgtggtctgtggctgatccggctagaacactgccaattcttgagacttatttgggaaaaaaaaattaaaaatggatcaagatgagagctatggcagagcttgctagtagaatagaatttatatatatattctttggggctttattttcaagttctgataaggtgttattatataaataagttatagatctggaatctttttgtgatttaaagtcagaatttaaaagttacttatactcatttgtggtattgtttgcagcactagttattataatatgatacaaatgcagatagataacagtgattcattaggtagcaactcataggaaaaactcttctaaatggggaaactcattccttttccaacacaatgaaaactactgaggttgataaacagagaaacttgtagtgagaaaatagggtattatgctttgtttccgtgagagcaacatgcgttaaattgtaaagctaaattttaaaagtgcaaaaaagtaccaataagaccttattccactattttttcatggacctccaaagttaaatgttatggaatattctctcctgccagcctttgacattagttttttctttcctgagaggtagtagaggtgctttctgcctccttatctttcatcatagagtggcgaaacattggggatatgatttatctggtgccttttcccatctcccttgagtgtttttgtggatcccttgccaccatgtgcttattcagtgctgccttgtgtttatcgccatcatgaatagagtagttgttacatcattcatgataattattcttcaaaggttaatcatggatagcttagtcactcttaaatttattagaatcatactatgacttgaggctgactgagctggagagattgaatatttacacattgaaaggtaataatgctccaaaataaaaaagcaactgacaaaggactttttgttttgtttatctgcagtgtatttcttattctcagtcctctgtttatgaccagtgatttggcttcaaggatgtttatttagtacttaatttagttagaaggaagatacggagatatggttcctgccttccagtaacttgttatccaatgtgaaaactagaatgtttatgtaagtagcagcctaactacggagaacccattgagcagagtgtgtgtgcatatgtaggtggtggtgctggcagtaaggaacggtgatggctgtgactagaaagacttaattcatgggtcactgaagatccgcctttgactatttactccgaaatactctgggttgggaatatctaggtaggatgctgtgtgaaagaatacacatagtgcagagtggctgatgtagcctaacttatatttggtgggttccatagaagctgtgagttccacttcccttgggataaggaagtaaaacttcagatgagccttcaagactggctaggattttgctagtagaataagagaatggagggtattccacatgaggatagtataaaagcaaaggtagtatgaaagtactaggcctgtttggaagtagtagtttgatttgtctagagtagtatgctctatgtgagcatggtgggaaataagaagtggaaaactgatgatagtttatggaaagccttaaatactagcccaaagcagccaggcccagtagctcacgcctgtaatcccagcactttgggaggccgaggcgggcagatcagctgaggtcaggagttcacgatcagcctggcttggtggctcgcacctgtattcccagctacttgagaggctgaggcaggagaatcacttgaacctgggagacggaggttgcagtgagccaagatcacaccactgcactctagcctgggtgacagagcaaaactgcatctcaaaaaaaacaaaaaaaaaaactagcccaaaggtttagattttaccctgtaaaacagtgggatttcgtttgtttttacaggttagtaacatggtcagagtataactgtaggcagattcagtgtacacaggcagatgggagagaagccctgctggtgagaagacatgttactgttgtgacagccatgcttgagttatgtgcagagggaaggaaggggtgactgcatgagattttagggtggatagaacttaaaacgtgattgataggttacaagggataagggagaggtacgatatatgtaaaaattgagtttatgggaagaataggtttgttgttttgattttagaaactcattttcatgagttttatacagctgtggtttatgcctatgtaacctcaagaacagatcaggagctgctaaaaaaaattatctttaaatcagatctggtgagagaacagaaagttgagaaattaaaaacgtccaaaattagaactattttatttaactttttttcttttttgggattttttttttctttttcttttagagacaggatctcaccctgtcacccaggctggagtatagtgatgtgatcatagctcactgcagccccaactcctgggctcaagcgatcctcctgcctcagcctcactactggttggtattaacaggtgtgcatcaccacacccagctaattttttagttttttttgtagagactgggtctcgttgtgttgcccaagctggtctcaaactcctggcctcaagtgattgtcctgccttggcctcccaatgttctgagattacaaacatgagccactgtgtccagctaaaactattttaaacaatatgtcattgttcttgttggtgggcatgataaaaacagaaaattttttgcccattgtattcttcacttcccttaaaatctacaccgtgctctatttttcctttttctgtccttactccagaaacattttttgagtctactataatacttactttacatatagaaactgtagggttgctgccataatttttagtaggcagggggcgcgatatactccagaggattttcactagaaattcagtcctgagttacgggtaccttccttattttgggccttccatcagaaccactcgggtaaacctggctctcaaaagagctggatccaggtaagaaaaggagaccaaacaggtttataggtcaggaagctcaagttaagccctccttccctgactacctggacacaatccatttgcactagagaatgttttctcaaatattcctttaaaataagaaaggagtggaactggttctttgggatgaaaaaaatcttaattctttttatgtacaaagcacagatatatgtatgtatatatgcataatacataaacatgcagaatatctgtggtattaaaatttcttggggagaggcattaggaaaacagagttgggaaacacagcattagggtagacattttttctttttatcttaaagttgaggtctcactatgttgcccaggttggatcaaactctcacctcagtcccccaaatatctgggactacaggcttccaacaccatgcccagctctagagtaagactttttttttagggagccagggccatggtttctttcttttctttttccttttccttttctttttttgtttttttagatagagtctcatactgtcacccaggctggagtgcagtggcacagtgacagctcactgcagcctcaaccacccaggctcagtcagtcctcccatttaagcctcccaagtagctgcgactacaggctcacaccaccatacccagcttatttttaatttttctacagatgaggtctcaccatgttgcccaggctagtctgaaactcctgggctgaagcagtccacctgcctcagcttcctaaagttctgggactacaggtgtgagccactgtgcctggcttctttttttgtttagatagtttgagcaagggaatttctacttggctttgtggaacccaagttcaaaggccattcagtaacaatgtatgtaaatgtaagtgatacttatcttaaacattaatcaagaacacttactaaaatacagccaaacaaataaatagactctaagttatttttatcaggtgaagtatttgaagggttgttttcttcattctcatttctgaaaaaaatacaaatattgctgttttaatcattttttcatttgttttgaaataagtaggaatcaataggattattagatacttcctttgtatttctgtgttattgatcagggctttaatatttcttcaaaaattcaaagttgggtgctgcttctgtggttttagaaaagttttttctaattttatgttgtaattacttaagccaatttcttatctttttaaagattagccagtgggtttcaagataccctgataatttaatatagtgtttcagagtatttcctggtactccagtagtttgacacagtaattgacaacttaagagaagttggaatgttagccatagattactgtgtaaaccaaaaaataaagttccaaggcctcccaaccatctaaacgaacccctccactgggccaaaggcattccgaagttaccctgaaaaattcaggccatgatggaagcagaggtggaactacgccctcttccctttctgaattcagggaaagctgactggtattaacatcagtacagatcttacatctcaagagaaacatttcttcgtctgaaatttcgtctgaaacatttacgtctgaagagacgcctactacctggaggtttcatctgcatgataaaaccttggtctccgcaaccccttatcagaacccagacattcctttctattgatgataactctaaaccaattgccaatcagaaaatttttaaaatctccctctaacctggaagccaccacctccacccccaccccaccaccctgcttcaagctgtcccacccttctagatcaaaccaatgtaaatcttaaatgtatttgattgatgcctcaggtcttcctaaaatgtataaaactaggctgtaccctgaccaccttgggcatatgttctcaggtctcctgaggactctttcatgggccattggtcactcatatttggctcagaataaatctcttcaaatattttacagagtttgactcctttcacgaacaactgaagtactgttaatttcatttattgtttctaccatatgaaatggagtttagaaattatgtattttgaatgacaccacacatgaaattaaaagttaatttgaaattgactttaaaacacttttacatgtaacgtagatgtgtgttctcacttctctgtgtttaaaatagaatggaaatgggaagatttgagagtgaaatacccataacaatggcatgagaaaccttgttgatttttcgtagtctaagcttacatttttctcttggctataggacattttaaaaattactatgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaattactatggcgtaacccaaaaataaaattctaagccccccaaccgactgatggaggctctcctcagccaagggcattccaaagttaacctgaaaaactagttcaggccatgatgttaccatcataatgagactccgacatcctcattataccctcctccctttggaattcaagctcagctgaccaacattaacatttaaatagagatcttaagactagtgaacagactttttatagcaataagacacagaattccagcctgactctagtatagcatcacatgacagatagcaggccctgaaagaaatagaagtattttatcccaagtatatttctttgatatattttgaaatggtcctgcaaagccgtctcttgtgggggaaatctgtattctatagaggattcatttttcctttccaggtctttttcctgatccaggagagaattaactgagtctggcacttcataggtctgacaaaagctctgaagtctgctacctggaggcttcatctgcatgataaaaccttggtctctgctacccattatctttttttttttttttttttgagacagagtttctctctgttgcccaggctggtgcaggggcaccatcctggctcactgcaagctctgcctcctgggtttatgcaattctcctgcttcagcctcccaagtagctgggattataggcatatgccatcacgcctggctaatttttgtatttttagtaaagatggggtttcaccatgttggccaggctggtctcgtactcctggcctcaggtgatccacccaccttggacttccaaagtgctggcattacaggcgtaagccaccgcacctggcccaccttacacgttttgattgatgtcttatgtctccttaaaatgtgtaaaaccaaccactttgggcacatgttctcaggatctcttggagctgtattacagaccactggtcattcatatttggctcaaaataaatctcttcaaatattttagagtttgtctctttttatcaatggtggtaaaaacacgtcacatgatacctattctcttaacaaatttaaatatttagtacagtattgttaactataaccattatgttatacattatgctctagaatattttcatcttgtgtgactgaaattctttacacattgaacagcaactcctaattcttacttcccccagtctctggccatgaccattctgcttcctggagtgcaaatgtctctttgagattctaatttcagttctttggggtatatacccacaagtgagattgctggatcatattgcatttctatttttaatatttagaggaacttctgtactgttttccatagtggctacaccattttacattcccatcaacagtggacgggggtattcatatcctggacaacacttgctattgtcttcttttttttttttttttttataatggctatctgaacaggtgagaagtgacattatgtttttgatttgcatttccctgaagacagtaatgttgggcatcttttgatatagatctgttggccatttgtatatctttttttgagaaatttctgttcaagtcctttgctcttaaaaaaaaaatccccagtatgattactgtataaatgacaaaaattgtatactgtttgtttacagtttacaacatggtattctgatgcatatgtatgttgtgaaatgatcaaatcaagctatttcatatatccatcacccattcaaccatagctctttttttttttttttttttttgagacagagtctcactctattgcccaagctagagtgcagtggcacagtcttggctcactgcaacctccacctcctgggttcaagcaattctcccacctcagtctccaaagtacctgggattacagacacctgccactatgcccagctaattttttgtatttttagtggagtctgggctttgccatgttggccaggctggtctcaaactcctgacctcaggtgatccacccacctcggcctccaaaagtgctgggataacaggcatgagccactgcgccgagccctttgctcgtttttgaatccagttatttggtgggttttgttttgctgttgcattgtaggagtgcctagtaacccctcatcagatatatggtttgcaaatattttcttacattccataggtagtcttttaattctgtttcttgtgctgtgcggaagctttttagtggtggaatttcagttgtctgtttttgcttttgttgcctgtgcttttaatgtcatatccaagtaataattgccaagactaatattatgaatgttttggcctgtgtttttctataagagttttatggtttcaggccttgcatttaagtatttaattaatattcaagtatttaataaattaaagctgaattttttgtgtatgtaggataacgtccaatgtcattcttttgcatgctgccatccagtttttcccagcacctttgttgaatactgttttatcccattgcatagtcttggcatccttgtgaaagaggatttgaccttatatgcatgtgtttattttgggttttcttttctctattccgttggtctatatgtctgtctttatgccagtgccatattgtttgattgctgtagctttgtaatatgttttgaaaccaggagtgtgagacctccagcttttattcttttttctcaagattgttttggctatttggcgttctttgtggttctatctaaattttaggattgttttttctatttctgaaagaaaaaagttgctgtttgttctccagattacattgaatttgtagatcgcattgggtagtacgaacattttaacaatgctctttcagtccataaacatggcatgtctttacatttatttttctaattaaacgttttgtaattttcagagtacaggtcttcctcctccttggttaagtctattactaggtattctttttgatgctgttgcaattgggattattttcttaatttccttttcagattgttgttagtgtatataaatgcatttgactttgtatcctgcaactttgctgaatttgtttattagtgctaacagtttttttgtggaatctttagagctttctatatgcaatgtcatgtcatcttccagcaaatataatgttactttttccttttcactttggatgtcttttatttctttttcttgtttctggccaaaggacatttaacatgatccaggataaagaatcagaaggatgagaattattccagatgtatcaattctaaataagagctacttatttcaaaataatatctagtagaaaactgttccttcatgtttatttttttcaggtgaatttaagtataattttttcaggattcaactggcatttttattggaattacattaatacagttattaattcataaggtacttgctgtctttaccatagtaagttcttctattcagaagggaagtgtcttttgtttttttcaggtcttttatctcacagaatactttgttttcttattttccttttgtcatctttatttctgtcttctacatgtttaacatcttcatgactctcataagctaacatggttttccagaagcatcttgacagatgtcattataatgaaataattacttgcagtatcaaacagctatttaacatgaaaactaacaacagagcagattctgttttaaatgataatttaataatattaaattaaatatttaatatttaaataaaatgtagtttaaataatgtttaaataatcattttaaagattttaaaagcaagtttaaactttgtatggagcctatgggttttaaagcttattcttaggtacacaatttaatttgacatattctaatatgttattgaaggattttaaaaaattgtttctgcctttttttcaagtgtttgttgtccaagagcacagtcatatatagtaaataatgaaaattttgtatttctactgtttataccgccttatttttttttcttttgggtttcaattggttattacctttagaataattcattaattcatttatattgaaagagtctaatgtgctagggaaacacacatataagtaaacatataatatgttaagtgtggtacatggggaaaaatagagtaagggggcatagaattgtgactatgggtagttgctataatgtatattattataatatcatattattacataaaacgtgatataattgctataatgtagagacaaaagggtgtgggagagagagggaaacagagagaaagaaagaaacagaagagaaacgggaggcagagacagacagatttgcctgagatgatacaactagtaagttgtgaaaccaagttttataattagatattctgatttcaaagtgcatatccttaatagtgacactgtgctagatatgtagacaaggccagcagcaaagtatggacttaatgtgacagaaataagggaccttttcagggttcatctttaagctgttattgttttgattgttgatatagtttagctgtgttcccacccaaatctcattttgagtcattcccataatccccacatgttatgggagggactttgtgggaggtaattgcatcatggggggcagttaccccctgctgctgttctcgtgatagtgagttctcatgagatctgatggttttataagtggcttttcccccttttgcccatacttcttccacctgccaccatgtgaagaaggatgtgtttgcttccccctctgccatgattgtaagtttactgagccctccccagccatgccacactgtgagtcagttaaacccttttcctttataaattacccagtctttggtaggtctttattagcagcacgagaatggactagtacagtaaattggtaccaggagtggggtgctgctgtaaagatacctgaaaatctggaagcaactttggaattgggtaacaggcagaggttggaacagtttggagggctcagaagaagaaaagaaaatgtggaaaagtttggaagttccgagagacttgtagggctcagaagacagaaagatgtgggaacatttggaactttctagaaacatgttgaatggctttgatcaaaatgctgatagtgatatggacaataaagtccagactgaggtgctgtcagatggagatgaggaacctgttgggaactagagcagaagtgactcttgttaggctttagcaaagagagtggcggcattttgcccctgccctagagatctatggagctttgaacttgagagagatgattagggtatctggtggaagaaatttctaaggagccaagcgttcaagaggaagcagagcataaaagtttggaaaatttgcagcccaacaatgcgatagaaaagaaaacctcattttcctcaggagaaattcaaacctgctgcagaaatttacataagtaacaaggagccaaatgttaatcactaagacaaggggaacatgtctccagggcatttcagagacttttgcagcaacccctcccatcacagccctggaggcttaggaggaaaaaatggtactgtgggccaggcccagggctccccctgctgtgtgcagcctagggacttggtgctctgcatcctagccgctccagccgtggctaaaaggggccaacgtatagctcaggccattgcctcagagggtgcaagccccaagcctggcagcttccacgtggtattgagctcacaggtgcacagaaaccaagaactgaggtttgagaacctctggctagatttccaaggatatatggaaatacctggatgtccagacagaagtttgctgcaagggtggagccctcgtggttctgctagggcagtgcagaagggaaacatggggttggagcccccacacagagttcccactgcagcactgcctagtggaactgtgagaaggtggtcactgtcctctggatctcagaatggtagatccactgacagcttgcactgtgtgcctggaaaagctggagacacttaataccagcctgtgaaagcagccaggaggggagctgtaccctgcaaagctacagggttggagctgcccaaggccatgggagtccacctcttgttatcagcatgacctggatgtgagacatggagtcaaaagaggtcattttggaactttaagatttaatgactaccctgttggtagtcattaaactttaagatttaatgactatcctgttggatttcagacttgcaaggggcctgtagtccctttgttttggccagtttctcccattggaacagctgtatttacccaatgcctgtaccaccactgtatctagagagtaactcacttgcttttgattttacaggctcataggtagaagggacttgccttgtctcagatgagactttggacttggacttttgggttgatgctggagtgaactaagactttgggggactgttggaaagacatgattgtgacttgaaatgtgaggacatgagatttgggaggggccaggagtggaatgatgtagtttggttgtgtcaccacgcatgtctcatcttgaattgtagttcccataatccccatgggttgtgggaggacccagtgggaggtaattgaatcatgggggcagttaccctctgctgctctactcgtgataggaggcctatctttataatgtatttctcatgagccttgaacaaagttctttaaatcctttggattattaatgtattaaactctacttttttcttacccaaatctacattttttatttacctttaaaaatcgagtatgtggaatttttctttgaatttttttcccacaaaaatgttgaatttaatttgaccattctcacaatcacatagagttgacttaatagtacaaaatgatacactttggatcagtagtatttcatgggaaggctgcagttgaaaacctaaagccactaatacattctattagaaataaaaggaataatatgtaggcaattaattatataaaacatgctaacaattggatgaaattaaaccaaaagctgatattctggatttacagtcatcatagaaaggaattatgtggtgctgtagattgattcagtcaacagttctttattgatcacatctttggtactaggggtacaaagatgatgaagacataatgctatcctagaggactttgtattctagtgaaggcaaagacatgcagacatcagtgtaatataataaaagtgctcaatacaaagatcactgtagaagttatgatgcttatagttatctgtaacagaaaccccagctgaagtggcttaaacaatacacagagtttattggtcatgtacaggtatatctgaaaattacagagacaggtgaggcttgctgtaatagctcagtatgcttccttttacctgtttctcctcaatgctttccacatgttaactttatcctaaggctgactccctttgaggttgtatcatgactactaataactctcagggctacccccagaaagagagcttttgtcttccaaccatcagactaaagtcttgggttcactctgactagatcaacttttactgtatgcaactctttcactagattgactaaaagtataattttgggttgagtgagaaactaaaagtccagaacttccaaagtacctagtatacctataaaaattggtgttagtcttattttggctttattattcctaattttgttttcttctaatatacagaaaatcaggaatcctcaatggtgggaagtaaattgataagatcatagttcaataatcttccaaatttttgaaagcctaaaaattatgtctttggagatttgtgattttgtgctcatatcaacgcagaaattaagaacccaacataacaactgtctcttctccattatttctttccttgtaactgggacagtaaggtggattttgatattgggttcacatggttcatggttgggctgtttcaagtctcaattacatttgcagtagcaaaatgccaaggccagaaatgtcagggcttaccacaatgaccttatacttatgatttgagcagtaattggggaagccttctgttttttactttgctactaatttacatttaatcaggctattcatagtatataatactttaaaagctgaattagtaatacaaagctacttttctttcagagtaagcacttccatttgttctctttctgcatagtctctggttcaccacatttgcattcactgcagttctgtttctctccatgacaagtgttcattcaggagccacagcatgtgacactgctataggattgccagatcttattttagagaatttggacaaggaggcagtaggagagagattatttgctaatagtctgaccaggctaaaatacagtcccattctgcattataacacagttggaacaaggcactcaaatacaggataagcctgtgaatgtgggccatctggtaatccagtactgcttgagtgtaggcctctcagctctacaaacagcctgtggagataaatttgacacacttggtgtataagggttcctgccctaacttagaaaagaattacttctttgtgctaaaattatattaaatgttacttggaaataaaggaaaaagtaatttacatttcctattgatggattataccgatgattatgtccaaggcataataataatagcaaatacttgtataaagcatactccatgccaggcactgttctaagcattttacatgtattggttcatttaacccttacaacattcctatgagataggctattattattttactgaggatggaattggcacagagaagtcaaataatttacccaaactcacaccgcttagtgtggaacagagttaggattttaatccagaaagtctgggaccagagttcatgcttttaagcactatgctatattttctctcaagtcaggactgaaattgtcattaaaagtaataccattaacttattggctatgttttatttataactcattaattatgttatacttattaatacgtataattattttattgtgttttgaaataaatgagcattttgaaacttacctctaaatattcaacatgcttgttttttattccaggagaagactttgcagttgtgcagcaagaaattattatgatgaaagactgtaaacacccaaatattgttgcttattttggaagctatctcaggtatactgtttgtttcccttttgaaaagcaataatgatttcatcacctaatgcattaaacaaaataaagttagttttaataccatgttttgtagtttttcttcatgctttgaagataggatattttcataccaatggaatttttacttaggacctatgttaattctgtaaccaatattgcagtcgtatgacttgggaattctagatgtgcttttagtgaaaatgctggcaagtaaaaaccttacggttagtcttccagtggtggactagcgatctaaatatgccattctcttgcccctttcttctggacttaggtcagtgtagagtcaggagcatctcttccagctatgtgtttatcaaaaacttttttttaattttgtgcttctggtctaagagtactatattactttatccctttccttcattgtatccaaagaactaggaactataatcatctcagtaacttatttttccaggtcctaaagtgaacttaggactgtgaatttcctttctcttactttgttttggtagccagacccaagccaggttcttaggttatattgcataggcgatcaccttagggtcaaatcttgttttccattcacttctacatgcagctgtgagttgatcactggtgacctagttgtttttaagcttcctccaagggaagattagagaatattttactatttttttcctttctttcttttgtgggggcgggacagagtctcactctgtcacccgggctggagtgctgtggtgtgatcatggctcactgcagccttgacctccctaggctcaggtgatcctcccacctcagcctcatgaatagctgggaccacaggtacgtaccaccatgcccagccttttttttttttttttttttttttgaggtggagtcttgctctgtcactaggctggagtgcagtggtgtgatctcggctcaccgcaccttccacctcccgggttcaagtgattcccctgcctcagcctcctgagtacctgggactgcagccacgtggcaccacgcccagctaattttttgtgttttagtagatggggtttcatcatgttggccacgatggtcttgatctcctgacctcgtgatctgcctgcctcagcctcccatagtgccgggattacaggcgtgagcctccgcacctggcctaatttttgtattttttatagagacggggatctcactatgttgcccaggctggtctcaaattcctgagctcaaatgatccaaaatgctgaaattacaggtgtgagtcatcctgcctggccttccctatgtattaaaaaaactcttcagtttttcttcagcatactttagcaacatccaacatactgtaacttattgcaggttcccattttcatatgatccaggtacaaaacactttttctcttctcttttgggcacaacagaaaagactagggtattctgccctgtcatctttctagcttttgaaaaaccaactggacctgctgttcatggttgtaaccactcttgtacagctttgattgccccaccttggttaaggtagaggtgtgggagtttttttgttttttttttgtttgtttgtttgagacagagtctcactctgttgcccaggctggagtgcagtggcatgatctcagctcagtgcaacctcccggactggagtgcagtggcgtgatatcggctcactgcaacctccacttcccgggttcaagagattctcctgcctcagcttcccaagtagctaggacgataggcacacgccaccacacacagctaaattatttatttatttatttattttttgagatggaatctcagtctgtcacccaggctggagtgcagtggcgcgatctcagctcactgcaagctccacctcccgggttcaagccattctcctgcctcaccttccgagtagctgggactacaggctcctgccaccacacccggctaatttttttgtatttttagtagagacggggtttcacagtgttagccaggatgatctcgatctcctgacctcgtgatccacccacctcagcctcccaaagtgctgggattacacgcgtgagccactgtgcctggcctttttttgtatttttagtagagacggtgtttcaccatgttagccaggatggtggctaacctgttattccaggataaccccactcatttatgtggcacccttggtatggtaaaatgagcatgatctttttgccagagacaaatcgtatctttggtagttaagaggttaagttctggagacagattgtctggtctgagacctggttctatcacttattaatcaattatttaaccagtttgtgcctctgtttcctcatctataaaacagatgataataatatctacatgacaggataggtgtgagtacttcctgggtaactacgtgtgaaatactaagaacagtgcttagaatgtaataaatgctcaataggtatttgccgctgctactactactattgctgctgctgctgctgctgctgctgctgctactactactacttcttaactttttaaaagtatcattattttagtgcctcatttggtctttcagcaacctggatagcagtatagctgtggtagaaattatttccattttacaaataagattcttgagagaatttaacatctaagttttttattttatgattttgcttcattccaaatacaaaaagcaaaattacccagaaaccaaagtaaaacagacaaaagtaggatcatttttttcagtaaaactatgttctttttagtgttgtacaatctaatattaagaaacactgatttaaatatattattttattctgtaaatgggtatagctgatcaaagtgatttgaaggtaaatggtagtataatgtaggatagcaattaattttatctctctcttgctcttttcttctgtagagattcttcccttattccctaattgaagttcaggctcagccaaggttggagtagggaatcctaatgattagacttgtaggatgttagagctgtaaggggctaagagatgttgtcatatagcccattcttggttatagatgagaaaatgaagtggggtataaatgacttacttagtctatccaacgtctcattagtggcactgggatttaatcctggctttacaagtagctagtctgatgtcttttttggcatactgtattgcttagcccagaaaggccagatttagtctcagagggaacgtgatttcttgaattctttctcattactgaatgactttacaaaggaggatcttgtttgaacttgatagaaaccccgtaaaatatatactgttcattgcaacattcttccttctatgttgttgctattacaacctgtataacaaatttagacaaaaagttaagaaaactgagcaaatgtagtttgaccattgataaatttccccctcagagaatcagatttaccctatgaattttcttagtagatgactagcatataattaagtttcagaagtccattttatatcagggtagctgtgctcgcttatgaagaaatactgaaactgagcttctataaagcagaatacctggcattcttcttaacaagacctttcctactccactgttcaatatcattaatatacctacaataaaagtagatagacaaagcattaacatttaaaaattttaaatagtcccggtttggtatgtatttgtatctgaatatatatgtttgtgtatttataaaacaacagaattaaatcattatagacttattctttacaattcttttggagcttaactattacttcttttaaactaaagatgagtttaaattaatttcaggttccttctaagcattccttagcccagcatatcacttaagaataagttaagaaaatggagacattcctctcaagcttgaactcaataaagcttagggggaaaaacaataaatgctcatttatttattttttttgatacagagtctggctctgtcgcccaggctgctgtgcagtggcaggaccttggctcactgcaacctccacctcccgagttctagagattcttctgtctcagcctcccgagtagctgggattacgggcgcacgctaccacacccagctaatttttgtatttttagtagagatggggtctcaccatattggccaggctggtctttaactcctgaccttgtgagccaccacgcctggccaacaaatgctccttaaacaataagccagtagaagatttgatccatacagtaaaaactatttagaatagatattttaaacttttgggctgggtgcggtggctcatgcctgtaatcccagcaatttgggaggctgaggcaggtggatcatctgaggtcaggagtttgagattagcctggccaacgtggcaaaactcccatctctattaaaaatacaaaaaattagctgggcatggtggcacatgcctgtagtcccagctactagggaggctgaagcaggagaatcacttgaacccaagaggcagaggttgcagtgagccaagatcactccactacactccagcctgagtgacagagcgagactctgtctcaaaactaaagtaaaataaataaacctttgaagtacagagtactagtttagatgagcatactttacctcataacaacttaaataagtaaatcaccaccatttacaaagtgtttatacattatttcttagcatgtagagtgcagtgttgatttccacagaaagatatctaaaacctaatccttccctttaaggagcttataatctaacaggagaagtaggcatgagcaaataatcgtaacataatatgctagatgcagtaataatttagaagtaaggcacagaagtgctaaggatgatagactctctgatttttgtcaatgtaggggaatcagagaaagctctgtgaatgatgtaattcccaaatattgggtgttaaaagattggtagatatttatgtgtatagaaaattggaatttttggcaaagggaacacatgcatgaaaaactgtgacatattcaggagacagctactggtctcacattagagcctgagagggaaaagggggtacatagttacttctcagtatgtgcagagattggttccggaaccccagtggataccaaaacccatgaatgctcaagtcccttatataaagtggcatagctatgcacatcctccagtttaaaattatctctaggtgacatatgatacctaacacagtgtaaatgctatgtaaatagtgtaatactttattaatttgtgttatttttattgttgtattatttttattttttcccctctgaaaattttcagtctccggttaggtgaacctgcgattggttgaaccccacaggtgctggacctgtggcctccagagggccacgtgtagttggagtagataaggttgtggagatatgggcaaaaatgaatcttttatcccttaattaggacctaagggactgagcatacttgctgaaagattttaacagagttagtatattctgtggaggatggacctagggtggaggggattaaaagaggcaatttagttaaactaattatggtgtatttattacagtaatccaggaaagagatgttggtctcttgagttatataaaactgggaaaaaattttttctagagccagagacagtgctaagaagggaaacaactggatcttaactcgaaatacatttatgaatatctttttgaatacttagaatatgagaataaagattacagttaagtcactttatacccagctactcttgcttttaaaaaagggaactttctagtttaggaatattttacatttacgaaaagttgcaaatagtacagagttctctgtatttccttcactcagctttctctgatgtttacatcttaacgcagccatggcacacttttcacaactacgatattaacattggtgcgatactattagctaaactcagtatacttatttggattttatcagttttctgttcatgtctttctcttttctgtttttgagaggaattaggaatatatctgaaagttgatgttaatttgttatttgtttaagccagggtttctcacctttggcattatcaacacttaaggccagatacttttttgttgtgggagatagtcctgcgcattgtaagatagttgttaatattagtacccctgtcctctgttagttaccagtagcaccctttcccctagttgtgacaaccaaaaatgtatccaggctttgccaaatgttccttgggggacacagtcactcccagttaagaactactactctaagcaaaaaaactttggtgaagttacagatacgttcctttaccagtattgctaggatattttctatagatcattagttctgagggatacaaatatgtattttgtaaaaaaatgggtgtattgaaaaaataatctgggtaaatagtaaattaaacagaattagaagttttatttcttctttttctttctcctccatctcctccccctctcaacttttcccatcccccttctcctcttttttcgcttcctccacctcttcccactttatcttctttctggtacccttcatccttccattttgttacctctcccttctcttcccttctccctcctctgtctctccaaccgccttctcactacaggatttctcagagcctttaatataccagtggccttgctaattttcaagaaaagactatgtgatatttttaaaaactgatttaactatacggtggtttctttctggaagcatacttcatgtaggattgatgttcagtggcccaccctttggaaatattatgctgaacactgggggattattaggtataattatagagaaatagatcagcttgtatccccctgagtacagcatccttacccctccttattaaagggaaagcagatggtataggttacctataaataaatttggaatgcaattatttttccttattagtaatttttaaatcaaccaaaaaagtttaaaaattttcttcacgttaaataagttatttatattaaaacatctagcagttactaaactttgtttttctcattgatgattaaggttgaattattttgctgaatatagtggaatagccattgctttggtcagcaagacaacaactcacagtacagtacaggaatcaggggactgcagtgtacaggatagctagccatcctctcccagggaggaagactccgtatgccaacttcaggcagatattagagagttgctgatcctcagtagtcttggtcacattttattttgctgtttaaattatgctatatttgagaaaaatatataaataattatacttagtttggtcagttttaagtctgtgatgtgttacaaaatgtgggaagattaaaaagtgtgttttaggaattataagaatttcagaaccataaaatagctattagaattttggtccctgtatgctctggtagacatcaaaatagttaacttttccccctctacttaattttctgtttcttataagataaataattttacaaaatgagaaaaaagaattctgaggatttgttgaatcaggatgttaatactgatacattgaatatttacttcagtggttaattttatttcaattcagatacctagggacaaagattttataattgacctgcataaaatgggctgattgactgaagtcctttcctattaggcatatggcttagtgaatgaccaaaagcaaatgtagatttgtcattataagaaagatattcatgggacagatgaaagtcatttctctaatagactatgactactcaagcttttggataatactagactttaactaaatagaatattataaaagtaaagtattttaggcatcttaaaaagtaaagtattactatatagtcgtgatttttttttctgcctataagctggaaagtcattttacataggatgaatagaaaattgtatatttaagcaaaggaagaaaagagaatagaccaacttcaagtagaaggtagtgtcatattgaaatatataaaaagcgagaactcatttcctgcattcattttctctagcaaggaaaattgttttcaaactggaaggggtaggaaaaacactattaagatggaattgaaacacaagatggtgagtagataattatagagcagctagacaccttaaatttttagaaacttttagatttatgtaaattatatctcatattgaaagttcagcaaatgtgatggtagtccattatcaatgagtattgacaaacagaagaggtatcagagattagagatcaacaatgaacagtttgtaaatgaagggagaagttggtttccagaaaatacagactattaaagttgatatcactcattgatcactagcaaagctctaggataaatttctaatcagataattaatgaccacttataagaaagaagttgtgattaacatgactttagtaagaatatatgcctgatcaatcccatctctcttttttccttaaaaaagaaaaaaatttatttatttatttatagtttcaccgagttccaggagcaatttaagatgacttaaacatctttaagttaatttacaagttaatttaagttatactacactacactacaagttaatttaagttacactacacttaaattaagatgacttgtacactacaatataaattataacaaaaggagtagaaaacaacttacatttattgtgctatattccaggtcctttactaagcagtttacatgttattctgttaattctaagcagaccccagaacagtcattcaacctgttttttgtaagctgtgtgaagtcctagttgcttgcatcttaagaactctaggctggcatttaacatgaaagattcacttgtggcagatgtgaagatattttagagctatggttctcaaaacattttggtaatagaacccctttattttatactcttaaaaattgctgagtaccgcaagagagcttttgttttatatgaattatatctattgatatttaccatattagaaattaaagctgagacatttttaaaactcaagaatacaacataagctcgtattccagtagctgtcagggatgacgtcattttcacacttcatgtagtctctggaaaactccattgtactctcatgagagaaagagaatgtaaagagcagataatttcttagtgttattaaaatggttttgaccttggtggccctctgaaaatgtctcagggactctcatgggacctccagatcacactttgagaaccactcactcttttagaggaaggattcaactaacctatagagatcaggttatggaatcctgcattctagatatatccaaattggagcctaagcagcattccaaatattgttgacttgccagagcctttatatctcaggcagaggcagagaagtgccaaatggtaattctaagtaatctgcatagagtgtctttcatgttttaaaatatttgtaatattacttaagctcattagtaaacccactagtgcagattaaaatagtttataagccaagttcttacaattgctgcttctggagggtggactcctgatttaggttcgttcagatgctaaccaactgcttctggattgtgggggttgggagcaggagtggagaggtgtatttccaattaggatactttaaaaagttagctcactgccccaagggtgtggattaaacctaatgcaatgtgtgtgatgctttctttgccgaagcattttaaagtgatatgctgggagagctaataagacacctgtcaaaaacaaagggaaatgaatcaaaactactatttttttttaagtataagatttaacaaataagaaaaaagtcctatgcttagtgtcattgaaccaggtagacaaatatgaagctggagagagaactggtctgccttttgttttataaagatccagaggttttgattaactacaaacagtaaactagcagtttaatgtagttgctgagaagttaacgatagctttcagctaacttaatagaaatacagtgatcaaataaaggagatagtggttacattctctgggggattagaaagaccacacatctgccagtctcagacatctattctgaaagttcttaataccaggccactgggcagctggcacatatttatataatttatagctattggtatttaccatattagaaattaaaacaaatttttatatcagctgtatgcttcaatttcattgttatgtgaaccacctatgaattgcagatcctggatggcttcagatttattttgggcttcactctttttttttttttttttttttttttttgagacagagtctagctctgtcactcaggctggagtgcagtggaacgatctctgctcactgcaagctccgcctcccgggttcatgccattctcctgcctcagtctcccgagtagctgggactacaggcacccaccaccacgcctggctaatttcttcttgtatttttagtagagacgtggtttcaccgtgttagccaggatggtctcgatctcctgacctcgtgatccgcccgcctcggcctcccaaagtgctggaattacaggcgtgagccactgcatctggcccactctttttagcattattttctagaatcatgataccttgctacttcatactcttaagttggttgacctttgcgctctgatagcttgtgctttctttttgtatgctaccttgtccactacggtcaagtcagctcacctcttaggtccagctaattctgctactacccaaccatatgtgacctatggctgataaaagcatctctgcttttttgttttctttaagattcagatctcggtctgtcacccaggccagagtgtggtagcactatcatagatcactataacttcgaactcctgggctcaaataatacgccccgccccgccctgcaccttccccccgaccccctgcaccctgcctcagcctcctgagtaggtgagactacaggtatgcaccacttctcctggctaactttttttgtttgttttttaagagatgagagtctcactgtgttgcccaggctggtctcaaactgttggcctcaagaaatcctcttccctcagactcctgtgttactgagattacaggtgtgagccactgggcctggctcagcatctccactttttaatgtattgttcatgtaacactcagaatcttagtacttgattttttgggtgccacattttaagagacacaaggactgactagagattatctacaggaaggtaactaaactgagaagctagtaaacataggattgtttcacagtgtgacccagcctattctgggtttatttcctgctactgtctcttcaggcagtctttcttcaactcccactaaatcacccacagtctcccacatgtgcatttctttcaagttttcattcttttgcacaggtccctttcctgtctctccctggtaaatttctactttaatttcaagacccaatttaaatgttttctcctccctaaaactttccattcattttcctaggtattttcatctctgggttcccacagtactttatacatgcctggattatgcattcatcaaattatgatctaacccaagtgagcagactttttctataaagggatacatagtaaatattttaggctttgtgggctacatggtctctgtcaccacgactaagctcttctgttctagcgtgaaagcagccatacagtatagaaataaatgagtatgactgtgttccaatgaaactatttattggcactaaaatttgaatttcatacaatcatcatatgtcaagaaatatttttgttattttctcaaccattttatttattaattgtagttacaagtaacaaccattcccagccattttaaaataggaaaacgattcatagttgcagaggtgtacaaaatcaggcagcaggctagatttggtccgctggccatattttcctgacctcaatctaattcgatatgtttattctttcagtcactcatgcaatcattcatttatggaacaaatattatttgctggatattcttctagacactaagaaggcagtggtgagagagacagacatatattaaggtagaatctttcttctgcattagagcttgctgagttcagggattttctgtcccatctctgtaccatgaatggtacatttcctggtacatttttaagagattaaataatgaatgactgaacaaaggaatgacctatataaatcacagctgattatttctcctatgactatatgattacaacagcttataatttgagtatgagagagaagtgctatctaaagagaagtgagtgataaattttaagactgttttgggaaaatcactgttgaatctagatatgaagctaacatttatattttgcctgttttgttgatgagagtgctatcaaagtagtatactttgagatttattgccatttgtctgtgaagaatctgggtagatgtataaacttttggggaggagaagtttttaactaaagggaagtattttcattatttggatgtgcctgataacagctttatatccaacaaatggtgtattataagtttaaaacctcaggttggattatagtaacacattatattaagtaattcattactcataaagattaattagttattttaaagataacacattgcatttgttgtttttcagtgttacagcttacaaccttaaaatacttgttacctcacacagacagttttaatcatgaaaatatgatacatgcttcttttctctttataggcgagataagctttggatttgcatggagttttgtggaggtggttctttacaggatatttatcacggtaagaccaaagttgtatttttataggggttaggttgaatttcttaaaatacagctatttactatattaaaacatcaacattatcttaaggaaagcaagctatgttttattgttatattgtttggctatataaaggtattttagatataggtggaagaaaggaggagtctttgctttttaatttggaaaattaaatgcatttgaattatttgctaattctgcagaggcatattgtagtcatttcaaaaatttaaactcagacttgtaaaaattcaagggctttgctggctaatgctaagctggtaaaatatccagtgtatacatgagtagtgataatacaaagataatttattttgctctcatgtattcaagaaatatcaattaaatgtttattctcttagatactgccagattccgagggattcaaaaatgattaaaacatttttcactgggatttcaaggagtgtataagagatttgtaaagtaaaatagccttttctttttcttccttttctctttctattagtggattattgtcacaaactgtagagtaggcttttgattaatgtaaaataaaataatatctatttaatgtctattttctgagaaaatattgtggaccttttttctcattttttcatagaatttgggctcctattttctagtgtggggccacttaagtaatttgaggggtgaattacactaaagcagagatgtaagactatttgggtcagaattttactgtttctattttacttcatttcactttatcttcttggcataggttttacttaacataaagattgacataatagtattttactgggattacagttgaaatagggaaaaggaaatgatggattttctggaatcattttagaaaacttaataaagaaaataagctacttacattggtctttaaaagataggtaaactcggtagaaaaaggatgatgaagggccgggtgcagtggctcatgcctgtaatcccagcactttgggaggctgaggcgggcagatcacctgaggtcaggagttcaagactggcctggccaacatggtgaaaccccatctctaccaaaattagctgggcatgatggtgggtgcttgtaatcctagctactccaaaggctgcggcgggagaattgcttgaacctaggaggcggaggttgcagtgagccaagattgcaccgttggactacagcctgggcaacagaacgagactctgtctcaaaataataataataataataataataataataataataataataatactagaaagacaaagaagtgcattttcagagatgaagccttggcacagtaacatgaaggtgtgactcatgtgtgatcactcttgttggtgtgggtgtggggtcgaatagggagagccttgaagaccaggtgaaagagtatgagaaggtttctgctttatgaaaagttactttttaaggatacttttaattaagtatagttgttctttgataaatatttgagaaacttttctttattatttgtggcattttgatttcaaagattcagtgaaaatgaagagatatctggcattattttacatgacaaaacagtatttctagaagcttgtaatttctatgttagaaattcaaatggctattccacttttttttggttggaatttgggtgaatttctctattattgatttccttactaattggtttaatttcccttttgctgaatttttttttttttttaaacggagtcttgctctgtcgcgcaggctggagtgcagtggtgctatctcggctcactgcaacctccacctcccgggttcaagtgattctcctgcctcagcctcctgagtagctgggactacaggttcctgccaccacaccggctaatttttatatttttagtagagatggagtttcaccatattggccaggctggtcttgaactcctgaccttgtgatccgcccacctcagcttcccaaagtgctaggattacaggcatgagctaccacgcccggcctcctgaagttttttcagtgatattttagtggtaaacttcctcagtgtttgaccctcagtattagttgattatttaagtgggtatagataggtattttctaggttgacaggtattttctttcagcattttgaagaaggtgggccattgtcttttagcttctatggttattagaaccttctgtcagtctaattattgatcctttgcaggtaatctgttcttatctctaattgctttttgtctttttctcttaatttctggtgcctaagaatgggtttatttttactttttctgcttgggacttaacaggcttacctctgtgaattttgctcttttatcacatctggacaattatcaattattatgtcttcaaatattttctcccccaatctgcgatctctcctttagaatcttagttagatgtacagtaggtcttcatgtctcttcaactcaatttcctatttaccagttttttatccttcaggagagcctggagatactcatatctatcttccagtttactgattttacagctgtattagaacatccattagattttatttttggttaccatatattttcatgtctagaaattatttggttctattttatatctccctccattattttttcctttgtgtcttattcttacagttttcattccttcttttacatctttagtttttaaggcgtacctttttttagtcattctcagattgtttagtgatttcatcatatatccatatgattggtcttaggtgtctgattctgctttcttcattaagaagcaagaccagtttcgttacagaaataggttgtcatgattcttaccattccatttcaacctaactggtaaaagtaacaaagtaatatgaattcgtcaatactgatttatttatactggtcagcaactggctcagtggaaaaaaatggcagttttcaggtaccctggatgttctcatatatgaatattggggattcatatgcttatgcagaaccccaaatcctatctttctctgtgttcactcttttggctgtacccatgttttcaccaaataaccttttcgtggcaatgtgtaataatctttggctagtctatggtgttgtatacttgcacggtcatgtaggacacgtacctccatttctttctatgtgtctctctcttctgcctcttttttatcacattgtcattatatagagagagtattatatcctggaataatttatttaatgaaggggaagttcttttaataatcctagtgcttgcaaggtttcccctttaacttttatttacttttactttgaagaactaacagtagaaccttttattgttccaacataataggatttttttctattttccattgagctttttgtgtttgtttatttaatattgttctttaataactttccacaacccgttatatctttatggttaattattttctcacttattttataattttggattttgagatcatttttagtgaggtttttcagtgggaattctatgtggcatttgaagatgtgtccttccagagttttgtttttgttttttgggttgttgttgttttttttctgggatcctggtgacctcattgtttccaatatatatttgaatgctcaacctgagtaaggaggcctatggtgacaaattctaagaggaggcatgtttcctccatccctatgacagccaaaatccctagttatcgtcgtgcttgtctacacctttaatgaggatgtagccctctgagacttctggttttatgtgggtgtttgttttagctcttctgcatacctagggccttgtcttctgtacccatgtagaggataatgctaaagccctagcttaccaggattaaccttcccctaagagacagctagaatattctttcacagttttaccttctgtttttcatttgtctcctgggaaagtatcttactgtttgtaaagttagctagtaattgaaaaggttatttctgaaaaaaaaattgtctttcacttccaagtgttattttcagggttttcagattatcttatttatcatattatagaaacagaaatctcaaggaggtttatcttactgaatgtgtgtgggcttggaagccacagaaataagttacatggtttatccatagacatttaaacccaacccggtccttaaaataatctaattggaatagatttctctctttcataattgtaaaataccacaagtactccaaactaaacatgtttacaaatctgttaagtttgtgtaaatgtgagtttactatctagccaaggtttttatccttggaatttaattcaatttctagaatagtctctcccactttttattctaaagtgatttaatagtgaaaaagaaaactattttagtgtacagatgctctgtttgtgctgctataacaaaatgcctgagactgagtaatttataaacaacagaaatttatttctcacacttctggaggctgggaagtgcaagatcaaggtgccaacaggtttggtgtctggcaaggacccatttctcatagagtgcacacacactgtgtcctcacatggcagaagagatggaagggcaaaaaagagtagacactgcttgaagtctcttttattaagagtcttaatctccttcacaagggaggagcactcatgacctaatctcctcctcagtgtcctgcctctttgagattaagtttcaacgtgagttctggagggacttagcagatgcatacacaggaaatattacttataagattaagacctatatattgatgtaaaggtgttcatcgtaagtgaaaagagtaggtttcagaattgtatgattccacttatgtaaagtttctgagatacaaatagtttataaaatgtccgtttaaaatagtctggtaggttatagaccaaactattggtattgcttactgttgagtaacattttggataaagaagagacctttaatttccaaacttttctattgattggaactttagagtgaacatgtattaattttatagctatctggctaatatttttataagaagtattgatttaaaactagtcataatacatgttctatatcaactaaaaagctttaataaaagccagctaaacctattggacatcgtttcttttgatgtttaagagatgatattgatgaatgagatataaaaatgagaatataattaatttcagtgactactttagacattcattcattccataaatatttatcaggctgcttttctgtgccaggcactgttctgcacactggagatacaacaatgagcaaatcagatttttaaaaagcaaaaaattggctgggcacagtggctcacacctgtaattccagcacttcaggaggctgaggcaggaagattgcttgagcccagaaattcaataccagcctgggcaagataatgagaccccatctctgcaaaaaatgaaaaataaactagccaggtgtggtggcatgcacctatgcccccagccactcaagaggctgaggtgggaggatcacttgagcccaggaggtcgaggctgcagtgagctgtgattgcactacactccagcctgggtgacataatgagaccctgtctcaaaaaaaaaaaaaaaaaaaaaaaaaaaactggagccaggcacagtaggacagtagtaattcatgcctgtagtcctagcttacatttcagtagaattgtttagggatattaagtctgttgcttaaacttgtaaaactttattatatattgaaaaacatgcgttgactaattttatgagtattaattgtcttcttttacagtaactggacctctgtcagaactgcaaattgcatatgttagcagagaaacactgcaggtaaatcaagtgctaattcaaaaataacatttttcattaaactaaggctttacttactgtgcattacctgttcagcaaagtaagaactaaatattttagtttggtaaactcttaaaatgagttttaatacatttgaaaattgtgtaatgaactcaaattatatttacaaataaatactttaaagcataaatgtgatgatataacctaaaatttaagcactatgcatctgttattgtatattttcctcttaataccaaagaaaggcttgaaaattaagcactatcatgggaattcaaacactctgatactaattaggtatatactttttaaaagttatttcaaactatttgtagaattcactgaaaattttcttagaaaaattagtcattttcttgatctttttttaggatatctcattaaaatatgttaatgattagtactagatctcctgtaaagattaaataaaatacacagaatactacccatttgattacataaaatccaaaagagtgctctttgataaaatcttgtttatttttctgttttttgaaactccagggattatattatcttcacagtaaaggaaaaatgcacagagatataaaggtatacattatatttttaacataataaccctctcttcatttttaaatactctgatcaaattgttttgagcaaaattgttttatttgataaatgcatctgaaatgttaccataataaaaatgagtgatacttttaatagtttaattttttatagcagctttattgaggcacaattcacataccataaaattcacccttttaaagtatatcattcagtagattaatgttttaataactcattttagcttctttgtagttattgattagtaaaatgcagagtaagcttatagctttcatcaagttatagtttttagtaagttttatgctttgactatttcagtgagctttcgcagtcttaagtctaagtcttagtaatgcatcaaaatggataaattgacctttgacactttctcatagtcttttttttttttttttttttttttttttttgagatggagtctcgctctgttgcccaggctagagtgcagtggcacgatgtcggctcactgcaacctcccctcccgggttcaagtgattcccctgcctcagcctcccgagtagctgggattacagccacctgccaccatgcttggctaattttcatatttttagtaaagacaggatttcatcatgttggccaggctggtctcgatctcctgacctcaggtgatcatcccacctcggcctcctaaaagtgccaggattacagacgtgagccactgtgtcctgccttctcatagtcttttatttatttagctggcaaaggagagcaggtgctctgaatgtgctggggttagcccagtggtacagcatgtgctctggtaggaatccttagcatatttctaaagatactgccatctccccagtttagattttttttctttcacttatttttcttgtgccttctttgttcatccttcctcatatttctctcttccccttttgttttctaacattttctctaacataaagatttttaaccttttttgaggatagaggctggggcaaatcttactgtcctctgggtttctgatgataaactatgaactgtcttctgagaaaatgcccttatgcgcatgtcttcaaattttccaagaaatttcaatggactcgcagataacctgctgagatcccttgtttgaaggtatttttttgtgatccacttaaaagacataaagagcttttggagttcaaaggtagaagagctcacaggaagatgagcagctcaagaaaggttctgtgtcattggcatgtagatgatctgggaggattgacagatttttgtcagaaatggaagttggagtacatttcaagcagagaaaacaatgtgagcagatacagaagttagaaagtgtgaggccattttagagaacataaaaactgtaccatattattgaagagaagagaatgtatgagactaattagagatgggactggttgggtagtttgatgttccattatgcaaggacttgtgtgctagacttcagagtctgggcctaattgggttgatttgatttgggtcatcgccaccatttctactcctgtctaagccaccataatattatatcatgtggtcttttgtaatagcctgagtggtctcaatgctcccattcttagtggttttgtagtcacttttctgcttggcgaccaaagggaccttttcaaccatatcttatcactctcctgcttataaaccaccattgctttcccattgtactcagtataaagtccagatgcctttaccatgacctgcaaggttatacgtggtctgacccatgcatttctccgtgacctcatcttatactccaggtttctctgttttactcattcttttccagccacactaaacttgccgatcttagaatatgttgagctcattctagccccaggtcttcaaatttcctcctcctttcctgaaatagtcttctcccagattttggtgtggctctgtacccttacttcacccagatctctgctcatatattactgcctttggagaggccttccctgctgtgtcttcagagtaattatttctacctgactttgaatcatttgttgattcattcattcatagatgataaatatatttattttaagttttttcctcctacttggatgtaaactccatgggaattggaacttactcattattgtaaccccagagcttaaaatagcacctgactactagtagcctctcagggagggaaaggagggaggagagaaaggccataatgtacaagtgatgtgattataagctataacttaggaaagttagtctgagctgaagaaaggccaaactgaagcctctgacagaagtcttagatagctaggtactagatcaagttaaaatccctgctcctagtctctttcctttttctccttcccctactattccacagagctacagtagtatcagtgggtgggtgcagctcagcttcactggtgacatttggagtttaggagcctttttttttctccccaaccccctgtctcctgtgccagtcttttactgttttttcctcatgttggttgagagtaggagggttcccagtattttttccaccaaacccatacttacatgattgatggcaccttggaccaaagagcccacaatacctttgggatatagtattgctatctcttccaaaagctttgagcttattgaagatgaagtcatcattatctactttgagcttagatcaagaagcaaaagtggctaaaatgcaaccagatcatgcagaggggtgacattttaattttgtgggcctgtggctagttgtttatgtactggatgggcctaagcacttggtaaggcacattaggatagacaacctcatgtactaagcagcaaggtacagtctcacataccaaccctggttcaattgatggtgagttcctagaaagggaggttcttttaaaaacacacacacacacacacacacacacacacacacacacaaaaatgggaaacaataatcaagtttaaagtgtaatgtaaacagttgaaaatgcattgtacggttacattatagtgtggtgatagtgtttgatcaatgaggaaataacattttgatgaaaactaatatatcacttttatattaacattcatactatgttagtagcagcttttttgcaaggcagaacattttataaagatagtcaagttgcctaaaaagtggacagtagatttacctatgactctaatgatacgacattttaattaagcacactttaagtatttctaggtctaaggctgtgattattttaaatatgtatatttattatatatgtgctgtctgataaaatatctatttcctactctaactaaaatattgttactttgaagggagctaacattctattaacggataatggtcatgtgaaattgggtaagtaaattggaattttgtcacgtgcacaaatctattctaagatatagtaaagtttatgttttcctttgtaggaccaggttttccctctcctaagacggcatctgtgtatttttagatggaaatctcgttgccatgctgtcacctctctgcatccacttctcttaaacagggataaagtctgtccttcacataagacatatctgttgtaaagatactgtgaaagaataccctttctgaattctttcacctctaaacccaggaatgtgacttctgtaatagtaagaaatctgtacagaattaccttgtaaccaaaaaataagacaaatatcaaaaaatcagtaactccaaaaacactttattcttcacataaagcttttaaaataaaatacagcattacttacttaagaatgtaatttagatgctgaatgttgctttatttcaaacagtaacatatttcattttgtaactgtaggttgttaaattttcaattaaaatagagttcaaaacctaaataatgacttaatttgcaagtttaagaacaagtgttcgttatagttttatgaacaaagtcatatttgttagtattaaatgaaatagttaataacaaatagaaaacagttattttaaactatatctattagataaacccaaattaaaaataagcattttataaaaatatagatataactattttgaactataacctgtgagattaatcagatttaagaatatgtatctagaaattaacatataataaaaatttcctccgtgacttctaaatatgggaaaagcagaaaagatatgtcctgttctttttagttatctattgattgcttagtgaacagtttttatcagcagtttaatattttgtgccagtgtgatgtgcctcactcaaagacatactatttataatatatcttacttgagaaggttttagaagtcatcattagtaaactagaaaatattagatctccaaatacttatctaaaagaatagtaacaaatcatacataaaaataatttcctgatagtgactgatactggtactaaatgtattgttaagtttggggatattctgattggatgtcttttcaagctgcaagtagacttactggtttatctgatgtcaatcatgggtatggagaaagtgaatggaatataatgtctcttaaagatcccttccagtgatattccttggatttctggtcctgagaattagaaattacaatattaataagtttggcaatttacattctctcagctatcactttctcttcaaaattatttgatcttgacctttgttatttgatttatgtggggatatatgggaatcttatttggctgtgatatgtattcactactttgtgatattttaatgcgagtccattaaggttaaaatttgtaatgtgatgtttgagaatatcccgtattgctgtaaaattaacttaataaaaataacttttaaaagtttctttttatgttgccttaaacaattttattttctctcagtttcctaaatgtttctcattttttttaatagctgattttggagtatctgcacagataacagctacaattgccaaacggaagtctttcattggcacaccatattggtaattgtattttaattgatatttaatactttgttctatcattattggatatagcatttctaaaaaatagactggtcagaatttttcagactaagattaagaaaaaagtcatcaacaggcaaagtaattcaggcatgtacacttatgggtggattacatggccagaaaatatcctaccatgttatttttcactaaggagaaaaggctttaatgattgatatggctttcagaaaccttaatatttgttctagccttgctggaaaatcctgactctttttcctgtacatttctcatgtattttcacaggtgtttttatatctttcttcacccccatttccagtccatattgtgattaatctttcaacattacattattcaagtacctctttgctaaaaactttttggcatgtcttggttgcctataggatcaaatgcagatttcttgacagttgagtcttctgtgatctggcctctgtctgcttcattagccttagctcttaccagtcttctccatggaccttcctttctagccatgtttgtctgttagatactgatcatagtataaaaactatcctactcgcatatttatttacagaatagtttttggccgcttactatgctagatgtgatattaagcagtatgatgataatggtggattggtatagagctttttttgttcatatcattactttgaagtaacagcaccctggaattcctaccttgctttcagcttatgtgcaaccactcccctgatgccctcttcatctgactcatcagcagtcatatagctttaattgctactactaatttttttgcatttagaatatgatgtatataccattttcatgtcagcctatcttttcatcaatatatattttaaaagtcaaataatgctaaaaaggcatatgagaaaaacttagttgtaacttctgccatctctagcattattcatttacagatactgcgttatgacagttgaagatcttagctctcttcattcatctttcaatcatcttatctttccagtgtactttgctgagtcaattaacagtactttcctgaaaaaagcttttcctgattttaataatttcattttaaatttacttagtttcttgtttctgtttttaaatccctgattaacactttccataccttccctcattttgcagttttgtaagatgcctctgtataattttctataccataaagtctgtcacattatctgtcagtgctgatttttgtcgggttgttgttgctttatttttgtttttgtttttgttttcctagaataatccttcctggagtcattttccctcctgttccagcctggactgttgaattctctagctcttttgcctggctctgctctggcagtctttcatcttcagcttagcattcctttcttggattctaggtcttcttctttcatgatgtactccttcctttttgtgtgtgtgaaacacattttaataactttctgagaaaccgtgcatgggagtaacatttttgagattttgcatgtgtatccttgtacatgattgataattttggtgggtaattctaggatagagtttttgaagtattgcactagtgtcttctgtggtgcccatggtgtgataccattatctatgatctattgaatgtaactcctccccctagaatcattcctggtgttttgatattccataattatatacctcaaaaaatatttttttattgtttttacttttattcattgtacttggcatttgtgctttataatccaaagactcatgtcttttcagttttgggaagtactcttgtgtcatttctttgataatttctttgctgtactttttcctgctctctatggaactcactggttgtatcttggaccacttaaattaatctattaattttcttatattttctctaagaacaaaaaaatcttttttgttctacttataagagttcctcaactctctacattcatattttcatgatggagccttccctcaaatgtccactaatccttacattttggttcactttgaagagcatggcactaaaaactggttcataactctttttgtttgggaagtcgggtgtaaacctggttgttatgttctagaactggtcaagtgaaggaagcagagatgttcattgttctatatacgtacttctacttaatcatgtcctctccctttaacctcttcactccttggttcctggtgtctcttgagtctgcagtctctcttcttcgtcttggtccttatccagtgggaattggggggcaatagttgctggggcttaatggataagagtaggaatgccagggactgactgttgacactttctaatactcctgtttccagcccaacctcaaccctactattgctactttttaaacctagcttgtcaacatttccagggtatttgaggctcattggctgctagttgttgttcttttccttggcacctgcttaggtttgccctgcctcctgtttgctacatcatttactattcttctgtttttagtctgtgtgttatggttttagttaaaatatgtctgctggacttttcaaagatggtatgtgtatatatttctctttgttcttctctttattgttttgggttgagcagagtgagggcttgaattgctgtcatttttaagtacactgtcttctcagttttattgtaaacatctcattaaatcttcaggatctgacttgattctatacaatattcattcactgaatgttaatgatgaaatttccaactccagtttcacaggttaaaaatttatgtcattactcttggaataatgtgggaaatatcttgggaacatgtgaaattgtgaattaggtaaagttaattttgggaacactctccctgtatctgtctttctggtattatatctttcctacctaaaatctaaaactttagaacctctctcttcccaagtgattagatcggcagttattcagttgttcgaaaaagtctgcttgaaatgacagttctcaaaattaaacacatatgtaccttaaacattttatttcaatttaagacatatatgtacatttattcaacagtcttttgatatagaatcaaggccttttcttagagtagatcacttactagagttccattttagtaatgcaaaccacacacaccccaatgcatcaactacatttcttagtcaggtttattgaggcataaatttacccttattaggtgtacagttgtgcaaattcatacagttgtatgaatgttgaaaaacttgtatgctgtggtggtaagaaaccaccagaacacattgacactatccaaaaaatcttttattttgcccctttttagtaaatgctctacctccatccgtagcatctggtaacccctgatctgatttctgtctctatatttgtgcctttttcttgagtggcatagaaatggaatcatataatctgtagccttcccagttttctgccattgtcatgttcttatctaacgtaccaggttttttggctcatctttagaaatttgcctttctaaaagcgaagtctttctaaagcattcactaatttttgtttgtttttgtttttggtttttgagatggggtctcactctgtcacccaggctgaagtgcagtcgtgtgatctcagctcactgcaacctctacttcccaggctcaagcgatcgtcccacctcagcctcccaagtaactagaaccacaggcatgcgccaccatgcccagctaatttttgcatttttggtagagacggggttttgccatgttgcccaggctggtctcaaactcctgagctcaaaccatccacctgcctcggcctcccaaagtgctaggattacaggcgtgagccactgctcccggccagcattcgctaacttttaaaccttcattataactatgtgtttacaatagcaaatgtaactggaataaacagtttcagagatgaacccagttgactgtgataagcacacaacttagctggctggagtagacatgtactaagtgtaatgtttcccttgtatttacatagaagaagggagagcatcagctaatgtggtgaactagtaaggggaggcaagttaggagcgtatcacttgcatgcatttcccactccactagggcatttctaccagctacttggaatctagtcatcataaaagtaataactgacactttgaaattcgcttttcttatagtaatttaaattttcataagatctgtttcagatttaaaagattttaagaccaggggttttgaaagttagagggttttttgtttttgactttactgacttacttgaccttcctgaaatcataccaggaagataaatgtgtatttgtaagattatctagactgctctttagtatggaagagttgagatgtttatttcaattagttgcttttaaaaatattgtttaggatttgaaaatttttgtatttgataattaatagtttaaatcagtcaaattcaaatttatggaagtataattagaataagactgtagcaaagtaaagagaaacaaaaaaattactgaatttgggtaactttcctctgaataaatacattttttaaaagtagacacttgtttttataacttttccattattataatagaactagaaaaaatgccaaataagtttttagtaaatatgaattaaatactaaatatgaagattattggtgcccgacggaatagttttggtgaagtaaaaacagggattgcctggtcgcagttttttgataacaggaagtagagctataggttgcttattacgaatattatttattgaattttgcatgtacagagagattgggagcatgaatgattttggacgtgttggtctattagaattgtatatttttataaacctttttagtaactagtataaggaagtaacaatggaatcagcaataggggactgaagtgcagagtcttttttaaaatttataaacaaaggtttgattgactcacagtattgtattgcatggctggggaggcctcagaaaacttacaatcatggagtaaggcaaaaaagcgggcaccttcttcacaaggtggcaggagagagcactcgggaaacggccacttttaaaaccatcagaccttgtgagaacctgctcactatcatgagaaaagcataggggaaactgacccaatgatccaatcacctcctacgaggcccctccctcaacacatggggattacagttcgagatgagatttgggtggggacacagagccaaaccatatcattctgcccctgcccaccccccaaattgcaggtcctttttacatttcaaaaccagtcatgccttcccaacagtcccccaaagtcttaactcattccagcattaacccagaagtccaaatccaaagtctcgtctgaggcaaggcaaggcaagtcccttccacctataagcctgtataatcaaaagcaagttactaatgagggtcttatgagatgtcaagatcttggaaaaggtggaccttttaagtactgcatatttatttttcaaaaaccaaggcctaaagaggccttaatttagatagtgataattccttgtgcctctgggtgggagtataaaggaaaacatataacagaagttttttattttctggaatatttatttcaggatggctccagaagttgcagctgttgagaggaaggggggttacaatcaactctgtgatctctgggcagtgggaatcactgccatagaacttgcagagcttcagcctcctatgtttgacttacacccaatgaggtcagtgcatcatcattgaagaatcttacgcttaaggtttttatcctcttagtatgctgtcatgaacaagtaattttcttagtcttgttttaccttatttggggaacaaatagtaatagaatttgtgtaatagataaaaatgtgaaatattaaaatgctgtgtaatgatttgttgatttttcagagcattatttctaatgacaaaaagcaattttcagcctcctaaactaaaggataaaatgaaatggtaagtatttttatgttatttacttttatggtgagatgagcaaaaaatgaattggaatgtaaaagtctaattttctaaatttcttaggtcaaatagttttcatcactttgtgaaaatggcacttaccaaaaatccgaaaaaaagacctactgctgaaaaattattacaggtattatttttgccctgaaatatatatatatatttcaaaagataaaatgttattcaatcagatttatagtaagtgttctgcattgtatttaatttttatagcatccttttgtaacacaacatttgacacggtctttggcaatcgagctgttggataaagtaaataatccagatcattccacttaccatgatttcgatgatgatgatcctgaggtaggaattgcttttaccagcgggcatatataacatgtatatgtgtatgtatatatgtgtgtctgtatgtacgtctcaaaatccatttttttaattttggggcctagtttaaataaaaaagctcttgagggaacaattaattctttgtctttgcctttcatggaaagtcaaatgctaggtttttcttactgactacttataggtgactatagtgtgaaaatggcaaaggcatatcatttaatccacttgttgaaatcactgtagttatttcaaaatagccatttttggtgaagttgccaaataatcattcactgtaaaagggaaagcaaatgggaagtgcctaaacaagacatttgaatattcaaaatttcccctcagtttgcttctcaaaaagaatcctcagtttggcctggtggctcatgtctgtaatcccatcactttgggaggctgaagcaagaggattacttgaggccaggagtttgaaacctgcctggtcaacatagcaagaccccgtttctatctttaaaaaaaaattcttatataatacttcataaattattagaggttagtaggaagtataggcttgactttgccagtgactaaaactcagctattcactatggaaatgttttaaaatgagccagtatagttgttaataaaataattctaatatgacagaagcattgatattaatggaagcttcacttctgtttgcatatgtaacattcctagcactgctaatagttgtggcaaccaagataaattcagtatatgtgacatggcagaattctgttattgggtctgtaacagaagtggataggctttaactctactggctttatgggaggcccttaaaaatattgtaaatttcattaatgactgaaggtgaagtgtttagaaagacggccacagattgtcttaagtcagagagaacctttctatcaattcagcattgtcccagcttgccatcttatgatagataagctatttgtccttttgtttaagggtctggaaaagagtttggagcttaaaaatgtaaggaatgtaaagtataattaatcttataattatactctgaagaagttttttttgttttgtttttgtttttttttgagatgagtcttactctattacccaggctggagtgcaatggcatgctctcagctcactgcagcctctgcctcctgggttcaaacgattctcctgcctcagcctcctgagtagctgggattacaggagcccaccaccatgcccagctaatttttgtatttttagtagagatggggttttaccacattggccaggttggtctcgaactcctgaccttgtgatctgcctgcctcggcctcccaaatgctgggattacaggcatgagccaccgcacctggcctgaagaagttttttggtgttgatttgcttaattttatttttaagaaagttaagttttacaaactcttctagtcttatttagtatacaggcagtccttgatgtgcatggtagtatgggactgtaaaaatgactgcataagctaaaattctgcaaagtaatcttaataatcaggaaaaattataattgtttcatgacttttaaaattttttgttaaagcataaactctgttactgtcagttgtaattgtagaaatgtgaaaaaatagtaaaactattatttacagtgtattataaatattagaatcatcgagagttaatgtgtttcatttctttgttaatgaacttttcatgcactttttttacttatctagtagtctgcttattgagtagtttgccttttcatcatgtgtctgtgacacagagcaagtatcttttctatgccttggcaaattgtcatattgctttctaattttctttctaatcatgatcatgatgtgcatctgttatttacgtagtaatttgtgaactgaaaggctaccaataaagtttatactttatgcaatttcaattaatatacagtggtaactgttatttgaaccatgatgtagggaactagtgttatttaactaaattatggtaactgaaattggtgcataacaaagctgtaaaacaaggactgcctatatccttttcagtgcactaaatgctacatgattgtttcttacctcaccctatgtacttgtcatgtctttttaaaaatgtactcaaagaacagaaataataaaccaaatagagaagcaatctgtggaatgaagattcttctaaaactttctcatatagcagggaaagaaactcatctttcttatccagacattgttttggtattataattataaattgttacaaatctctatggtaagtaggtaaaataaaggaatttaattattccaggggtaggatgaggggaagctgttacattccctctcacagtagcttagaataatgtttttcttaagagaaattcataacttttttatttgcaaatgatttgtaattgtaattgctaagtgcagtgttgtcactcaaaatacgaatgtatctaagaatttcagcacttactgtgatactagaactattgtatgcatactcttaaaaataagggtgggctcagtggcttatgcctgtaatcccagcactctggaagaccgaggcaggtggatcacctgaggtcaggagtttgggaccagcttggctaacatggtgaaaccccgtctctactaaaaatacaaaaattagccgggcatggtggctcatgcgtgtaatcccagctattcagggggctgtggcaagagaattgcttgaacctgggaggcagaggttatagtgagccaagatcatgcgactgcactccagcctgggcaacagagcgagactccatctcaaaaaaaaaaaacaaaaaatagaaaaagaaaaatatatatatatgtgtatttatctatatatacatatatacacacacacacacacacacacacatataccacatctaagtctagtttaagttttttataggttatgcactgtggaagaaagtttgactttttaatgttgagttcccctgtagtttctattttagaagtaattacacactggtgtaattctaattctgatttttattcagttttcgtctcctatatgtaagcccacttactatgtacagcattataagatttaacaattttattaatctgttatgctaataaattaataatttattgtgctgtttaagccgggaaggtaaaactgttctcagaaataatcatgagtttcatccatgttcattaataacagtctgtatgagtaacctgcatgttacctgtttttgtttggttttgctactgtatattagatcaaaagtctagggtttttcctagctctatggctagctagctgaatgccctgccacttaattttaagtctcagtatcctcatctatgaaattgaaggggtgggttgcccctccacacctgtgggtgtttctcgttaggtggaaggagagacttggaaaagaaagacacagagacaaagtatagagaaagaaataaggggacccaggggaccagcgttcaacatatggaggatcccgccagcctctgagttcccttagtatttattgatcatttgtgggtgtttccccgagagggggatgtgtcagggtcacaagacaatagtggggagagggtcagcagacaaacacgtgaacagtggtctttgcatcatagacaaggtaaaagaatcaagtgctgtgcttttagatatgcatacacataaacatctcaatgctttacaaaccagtattgttgcccgcatgtcccacctccagccctaaggcggtttttccctatctcagtagatggaatgtacaatcgggttttatactgagacattccattgcccagggacgggcaggagacagatgccttcctcttgtctcaactgcaagaggcatgccttcctcttatactaatcctcctcattacagaccctttatgggtgtcgggctgggggacggtcaggtcttccccttcccacgaggccatatttcagactatcacatggggagaaaccttggacaatacctggctttcctaggcggaggtccctgcggccttccgtagtgtttgtgtccctgggtacttgagattagggagtggtgatgactcttaaggagcatgctgccttcaagcatctgtttaacaaagcacatcttgcacaacccttaatccatttaaccctgagtttgacacagcacatgtttcagagagcacggggttggggggtaataagatcatagattaacagaatgtcaaggcagaagaattttttagtatagaacaaaatggagtctcctatgtctacttctttctacacagacacagtaacaatctgatctctctttcttttccccacagaaatgaagaataatgcttgtttcacgagtttaaggatataatgctaaggtgcatcaaaacactttgtaaactaaaaagcaggttgcacatgtaaaatttaaatacctaattttcaaaattacttttgctactgtttcaccatcacaagtatttaatatttcagtcttttaaatttgtatattttttccctgagatgtacctacactgtgagtagttagtttgagtcttgttcttgatttgccttattgaatctaagacttagagcataatgtttatgaattatgtttccacaaagatagatctaagagtgtatctccttcaaaggtaatacaatagcttcaaaggtagcatttcacccacagaggaagctattgggtattgcaataattacatgaaatagatgctggttgagagaccttagtgtgagtatggagctgcaaaagttttttgaataagacctcttttacttccaaaggttatagtaatgttcatgaattaacattaaatagaactcatctccattctacccaccttcagaatattcctgtatgaagttggcagtgcacatagaatggttttaataaagtaaaaggaaagaaaatagaggactgctcctccaagaaaaaaacataaagggccaaaaaaaaaaaattgtgttgaccaagaaaaagtaccataaatcattaacccatttagcctagtgttccattattggaactaggcttgtgggagttatttatatcctactgctcaaggccatcgtcaaggtttgatttttcacacaaaaaatttgcaacctcaggtataaatgggttaatgcctttagcattatttcattgcatttatgtcttatccttttgatataaggagttgacgcagattttttaaattgcagtcttctctgcaatagggaaagctacttgcaacgtgtaaacagctattgaattattgaaatacttaatttttgactatttatttatatttaactcgatgaacattcactggggacctgctgtagctaaaacattatttcctaatcttgagaagttcaccatttcaggagaagaaaaaacagccaacttttgttagggaagtcagagaagatgtcacaaaggaagtgacattgctagaaaggagtttgccaataggaagatgccagaaagaccaaagtttaaaaaataaaaataatggtcaaagaattggggacttttaaaaactcatcaagactcttaaaaaatgatagccatcccccatatctaaatgtttgaatacactagctttcataaattttagaaatggtaaaatatggtctttagccttaagattcatgtaaaaatgaatgcaatcaagagagggttacatatggattaagagcacatcaggtatgtgaatctttgtaatttcatttgtctaggttcttatctactgcatagcagattagtggattcttcttacattaaataatagctcaccatatgacatttatatagtagaaatatttagactcttgattttgaattttaagagatgtttgacaaaataaatattacttgagattttactatcattaacagttacctttctttaaaaacactgaaaatatagttgtcccttgacgtacacaagggggattggttccaggactctcaagtataccaaactccgtgcatacccaaatcccacagtcagccctgcaaaacccacatatatgaaatgttggtcctccgtatacatgggttttgtatccccaagtaatctgcatagaagtggacttctgcagttcaaacttttgttcaaggataaactgtacgtggaatgaagaaacaataaggttttagtttccgtatttcctaaaattcctagcaatttttagggagaaaattggggtaaggaggttctttgtagttgtggtttaaaaaaaaaaaaagtatgtaattgagtgtatatacttgaaaaagatgagaagacctaaaagtaaatttgacagcattcagaaagtattggcatttgcttgtaggagttctcaatctgagcactgttgacattttgggccagataatcctttgttttgggagggctgccctgtgcattctagaatgtttagcagcattgctggactcttcccattagttgccagttaacaccctttaatcccaagttgtgacaacaaaaaaatgtccccagatattgccaaatgtctcctcagggacaaaattgccccggtcaaaaaccactggcttatgtcaactaggatttatcatactgtctatgtctttccttcccgtacaaacttgacattctcatctagctcccattgcaaagggcctgttatttgtatttatattatttgatgataacaataatcatagaactttaagatgataaaagttgaataaacgtgaaatggtttgtaagggcagggttttgttttttatcaagaagtaataaaaataattgtaatcacgttgcatgtaaagcattgtttaaaaaaaatagacaccatgcatcattgtgaatggcttgtttctttaaatgccatttattagaaagattattttcatcagtgcttctctaaatatcatatattagttactataagcccgttatcgcaggtgtctatggttagtgtgtattacatttatagaggaaaaatgagagtatttatgtttagaaattaaaggctacattttaatttttaaaaatcttaccatttttattagtgatcttgaaaaaataattcattacgtttctttttctcttaacttttattttagtttcagggtacatgtgcaggttggttctgtagataaatggtatgtcacgggggattcatgtacatattcttttgtcacccaggtcataagcctagtacccaataggtagttttttatcctcaccctcctcccaacctcaagttggcccctatgtctattgttcccttctttgtatccatgtgtactcagtgtttagctcccacttatcagtgagaacatgtggaatttggttttctgctcctgagttagtttacttaggataatggcctccagctccatccttgttgctgcagaggacactatctcgttcttttttatggctgcatatccgtaccacattttctttattcagtctactgttgttgggcatttagtttgattcagtatctttgctattgtgttttgctattgtgagtagtactgcgatgaacataacgtgcatgtttttatggtagaacaacttatattcctttgggtatatactcagtaatggcattgcttggttgaatggttgttctaagttctttgagaaatccccagactgctttccacagtagctgaactaatttacattcccaccagcagtgtgtaaccgttcccttttccctgctgccttgccataatctgttattttttgacttttcaataataaccattctggctggtatgagatggtatctcattatggttttgatttgtgtttctccaatgattagtgatgttcaagcattttttcatatttttgatggctgtgtatatgtcttcttttgaaaagtatctgtcatgtcctttgcccactttttaatagagttgttttttgcttgttaatttaagattcttacagattcaggatattagatctcggtcaaatgcatagttggcaaaaattttctcctattctgtgggttgtctgtttactctgttgatagtttcttttgctgtgccgaacctgtttagtttaattagatcccatttgtcaatttttggttttgtggcaattgcttttggcatcttcatcatgaaatctttgcttatgtctatgtctggaatggtatttcctaggttttcttcaagggtctttatagttttagattttacatttaagtctgtaatccatcttgagttgatttttgtatattgtgtaaggaaggggtccagtttcaatcttctgtatatggctaaccagttatcctagcaccatttattgaatggggcgttctctccccattgcttctttttgtcaggtttgtcgaagatcagatggttgtagatgtatggctttatttctaggctctctgttctgttccattggtctatatgtctatttttataccagtaccattctctcttggttctgtagccttgtagtatagtttgaaatcaggtaatgtgatgcctgtagtgttgttctttttgcttcagattgctttggctatttggactcttttttgattccacgtgaattttataatagagttttctataaattttaatttttgagaatgtatctacatggcctttgtctaattaaatgattctaaaggatatcctttttcttagaagggcaactttttaagttcagatgagctattttagaatcaattctgcttattcgaaattctagtaaatgtaataccgttttagagatgttaagtgtaatctttcattgttagaaacaaaacaaattatttagcatttcagaagatgatgcctaacattctgttgcctactttaatttcaggttgggcatctttcattccctggcctcatttaacaaaatcttgtggcaatccctttctccttttttacatgaaatatttcattttcaaaagaaatttttgaaaaaatatgaaaaaataccgttttcatatccaaccatctgaattggtacatctgaagggaagataatcagtcaagtctccagttcacctctgttctaaagggtgaaatatggcctctgtatacctggatagcctttcttgtaatcatttgacttcttgagttagttatcagttttgttcctgacaagctagaggttcagttttcacagggtttctctaaatcatattttttcagctttttctttttcttatgttggagcccttgacaaatcttatattggacattcagagtataagttttccagtattcctttgtgatcacatttaattagttagactctgtaaataatttcaaggtgtgaatcttctttgcaaattaaaggcaaataattaaatattggtatgtttcctactcatggaaattataatggcacatctataaccaagagaaactgagatggagtggagagcatttttttaattaaaaaaaataaagcttctgaaaaacataaaatactgtatgttcacataagcataagttatataatttttccagtcttagttaaatcgattacaattcagatagtgccaaaagtgaaacacaaactaatatcctacatcatctataaatgtctgtgtgtagtttttaaaaattatttcaaaaaaattcataaattgaaaaataaaccttaaaaggcttctaagctcaaccatcattaaatgatagatgcaagtggtaatgtttacactgttgtatttcctttcccttcagaatttctcgatgtcagaatagatccaggatactcaagtgtacttgattcatccttgtagaatggatctagacaagtctgatgttgcacatacaaataagaatatgttactaattgtgtttaatttcatatgtatttagccaaagaagtgccctttctagtacaaataataatttatgttgtggataataaaaatattttttcacctaatagtttgagctgctattgtggtttgcttttttaaaaaaaaaaaatttgcaaagtgctgttttgctttcatttttacttaaaatgaagtattttttcctatttgggtaattttgtggaccaaactatgacttgattatcaaatgctgcatatcattgattttgttcttttctagcctcttgttgctgtaccacatagaattcactcaacaagtagaaacgtgagagaagaaaaaacacgctcagagataacctgtaagtatatactatacacagtttatgatttaatgatagaaaataagttataatttagttacagttatttttgttttatttccttctgaatagtttttcttactaaacactgttaaaggtaaagtttaattagggcagtaagaatttcattttccttattcttgtggaatttttggtggcaggatgggatgtatttatgttgttactgtttgggaggataagttaattcctggaataagcagggtagaagtaattaaggcagtgccgtaaatgcctgtgtgcatgtaactcacctagagagcttgttaaatgcagtttcagattcagtagacctgggatgggatctgaggttctactaacaagctcccacgtcattcatgcactcatgatccaagggtaacagagaaatagaggtctgcaaactgccctagcatctgagtaacctggaaacttttaaaaagggattctcaggcaccacttttccatagagtccaattcagtaggtcttggattggcccagaaaccttttaaaataggcctccagttatttcttaggggcagccaagttatgggcccactaagacaagccattcattcacatgggatccaatactgtcaactcatcagtgataaactgccaacaagaatccctcgaacaatagtgccttaacttttttattccttagaagcatttattctctgagttttgttctagtgatacctggaaagtatggtgggttatataaaaagctcaggagtgggatttggtactttgcttgccagcagttagttgtgtgatcatataaaattatctttaaagctcctgctgaagtcacgttttaaatttgctaatttcaccacaaaactatttttccgaaaatggcatccttagcatgtgagagcatttctcatattttaatatacaaaaaataattatgaaatatctttatcatttctttaatatacaaaaagtaattagaggccaggtacagtggctcatgcttgtaatcccagcactttgggaggccgaggcgggcggatcacttgaggccaggagttcaagacaagcatggccaacatggcgaaactccgtctctacataagctaccaaaattagccaggcatgttgatgtgcacctgtaaccccagctacttgggtggctgaggtatgagaattgcttgagcctgggaggccgagtttgcagtgagttgaaatcctgccactgcactccagcctgggcaaagaacaagattctgtttggaaaaaaaaaagtaattagaggtgacttgcagttaatttagaaaactttatatattcagtactgttgaaaatgtaatttaaagtactctctttcttgttatctcattttattaaaaaattacattgtcagtccctttatagcatagtatttctgaatcactctgtggtaacatatcagtgattctcaacttctaagtgcatatgcatgtgtatgctatttcaaactagatgtctaggctgggcacagtgactcacacctataatcccagtacttttgggaggccgaggcgggtggatcacttgaggtcaggagctggagaccagcctgaccaacatagtgaaatcctgtgtctgctaaaaatacaaaaattagccgggcctgttggtgtgtgcctgtagtcccagctactggggaggctgaggcaggaaactcgctgaaacctgggaggcagagggctgcagtgagctgagatcctgctactgcactgcagccttggcgacagtgtctcaattgaaagaaagagagagagagaagagagagagaaagaagaaagaaaagaaaagaaaaagaaaggaaggaaggaaagaaagaaggaaagaaagaagaacatcatatgagaattcatggacacaaagggaaacaacagacactggggcctgcttgagggtgaagagttaggaggagggagaagatcagaaaaagtaactattgggtactaggcttagtacctgggtgacgaaataatctgtacaataaacccccgcgatgcaagtttacctatacaacaaacctgcatatgtaccctgaacctaaaataaaagttcaaaaagtaaaaataaaaaagagcatcataaacagtgccgcagactgggatgattgaccaacagttatttgaagagtaactggaagattctgtggcagaggcttgtcataactttagggaatttgaagagagcagaagagtgataccagtgtaaggtttgaatctccatagggactttgctccctttctggaaatgcattctccatccacagagttcaggtacagtgatactgaatacctgctatagtcacggcttttagtaagacagcatccttgcactcaggggttgtacaatctggtgggagaaatgggcatgttcacaggtggcaataacacaaggcagatagatgcacaagactgtcctcatgtaattttattacagaccgcattttggaatttgaagacaagtataggtgaaagctgttcaataggcctttatcaagatgaggtatatgttagttttgataccttactaaaagttattttgtaatctttgatgtgtgatcaattgtgaacagttaggatggactcattcttaacctacttatcagatctaagggccatttgatatctgagccattaacagcttaaaagcatatacacacccagacataactggagatattacagggctgtgtttctcaactgtttttttccttatgcctcctattgctaaatattcaaatcccatggtcttctttcattggtattaacattcacaataaatttacatacaaagttgaaatcaaaccgttagaaaagtgattatgctttgaaatctcactgttttcctcagcttggttgagaagttttggttttggctgaagctcttactagttgaaatgtaatatattgtggctgttttctttttattgttttgtattttttcctctgcttgtatctcagtggacttgagggttttacccaggttataagatcagaaaatgataatgagctgtggaaataaaaggtaaagatactgaaacattcaatacattagaaagcaaagaaaaagaaaagatgaatgtagtacagttaatctgtgtctactctggctagtttatactttagctgcagtggttgtttttggttgtgtagcaaacccaaaatttagcagcttaaaacagtaaacattttttaaatcaactcccatatttttattttaaatcttataagacaatattattgtcattaaccatggtcaatattaatttgtatttgtatatttaccaattttttgctcttcattcaatactgtatttctgtaccactacttatggatctcttttgattaaataattccttttagtatttctttaagtctgaaggtattgaattctctcactttctgtatatctgctcatattaaacaataaacatttattgtctctaacagattttgagagtcaggaatccaggacaggttagctgagtgattctggctcaaggtctcataaagttgcacacaggatatcagctagggctggagtcatctgaatgtttgactggactggaagatttacttccaagctcattcacgtaactattggccagaggcttcacttccttgccaggaggcctctctttagggctgctcacaatgtgacttcctccagagcaagtgatccaacagagagagcccaagacagaagctttatcttggaactcatatacagttaacttctgctctggtcttttggtcacatcagccaacgctgatccaatgtggaagcattttgaataccaagaggcaggagtcactgggggccatcttacaggctggcttccacaagtaccctgtatcagcagctgtctacccacctaaatactgaattaagatggtctcagccaggcacagtggctcacgcctgtaatcccagcactttaggaggccgaggcgggcggatcacctgaggtcaggagttccagaccagcctggccaacatggtgaaagcccatctctactaaaaatacaaaaacttagctaggtatagtggcgcgcacctgtaggcccagctactcaggaggtcgaggcacgagaaccgcttgaacccaggaggtggaggttgcagtgagctgagatcgcgccattacactccagcctgggcaacggaaagagactccgtctcaaaaaacaaaaccaaaaaaagattgtctctgttttattcttggtcacaacaaagtagcaagttagaacttgattgtacacacatataattttgttaatcatcttcttttcttactgtggaaatggcctagaattaacaaattaagctttagcggttaagactttattgggctttttccagctgacatacaaatggccatcagatacatgaaaatatcactaattgtaatattacaattagttcagcatcactaattgtaaagaaaatgcaaatcaaaaaagaaaaaccccaatgagatatcatttcaccctagtttaaatggctgttgttaaaaagccaaaaaataacacatgctggtgaaaatgcagagaaaagggaattcttacatactattgatggaaatgtaaattagtacagccactatggtaaacagtatggaggttcctcaagaactaaaaatagaactaccatatgattcagaactactggattatgcatccaaaagaaaggataccagtatatctaagagatatctacactcccaagtttattgcagcattatcacaatacccaggataaagaatcaacctatatgtgtatcaatgggtgaataaataaaagaaatgtagtatatatacacaacagaatattattcagtcataaaaaaaatgaaatcctgtcatttgcaacaacatggatggaactggaggacattaatgttaagtgactaggcatggaaagacaaatgtctcatgtcctcattcatatgtggtagctaaaaaagttgatctcatggaggtagagtagaatgatggttaccagaggcaggaaagggtaagagataggtggatgaaatgaggttgtttcataggtacaaaaataaagttaaatagaaggaatacattctagtgttcagtagcagagtagggaaattaacaatcatttattgtatatttcaaaatagaagatttggaatgttcccaacacaaagaaatggtaaatgtttgatgtgatagatatcctaattaccctgttttgttcattacacattgtacacgtgtatcaaaatatcgcatataccaccatgaatatttacaattattagtgtcagttttaaaaattgaaaacaaagatctttggagatcagtgtgtggttgatggtagcattaaatgtctttcaccatggaataactttttaaattattatatcattaagaatataaaaacatcctggttttggccgggcgcagtggctcactcctgtaatctcagcactttgggaggccgaggcgggtggatcacgaggtcaggggatcgagaccatcctggctaacatggtgaaaccccgtctctactaaaaatacaaaaaaatcagccgggcgtggtggagggcgcctgtagtcccagctactcgggaggctgaggcagggaaatggtgggaacccagggggtggagattgcagtgagctgagattgcgccactgcactccagcgtgggagacagagcaagactctgcctcaaaaaaaaaaaaaaaaaaaaaaaaaaatcctggttttacttttttttcttttttagttggccaagtgaaatttgatccacccttaagaaaggagacagaaccacatcatgaacttgtaagtagtatagccttagaatgttagcactgaaaataaatgttttaatttgtttttgtgtgatgtattagtactgaccaaaaaagctagtcattaatattttcaaaaacattcgaggtcccagcctggtcaacatagtaagaccctgtctctacaaaaaaatgttaaaacttagttgacgtggcagtgtgtacttgtagtcctagctactggggtggctacggcaggaggatcccttgagcccaggaattcaaggttgcagtgagctatgatagcactactgtactgtagcctgggtgaaagtgtgagaccttgtctttaaaaacataaaataaaattttttttaaaatcgtgggaaacaaaaaggtaagtaattctcaaattcataataaataaatctgtgttgctgaatattttcaaaattattttaagagaaacttaattgttttaccattctgtgattaaatgtttttaatgctgacttttaaattttttttattttttattttttctctttttgaggggctttttaaaatgtgttatttttatgataaatgccatggtttccaaacattagagtagagtcatatctgtatagagtattgaaaattagggagatgaggcatacatagtaaatgaagtttgtcattcatttaaggcttgctataactttatgaatatactttgcatgattcttttgttgttgttttatatactcctttccagataaatgataatatattagattcagtcataaaagcaaaatactttgcatctatttgagatgttaatattctatagaacaataaaaaaatgagacattggaaaatacaaaattctaaagaaattattttgccagagttccatatgatgtctgtttcatttttttatttgctatttaataatgagaagaaaataactgttaataagtactaaggattgaagtaggagctttcttcttcagtttaatgcttattttaactcacttgactgaagcatacaaagggtgtcattagcctttaccttatagttactctaattcagtgtaccagtgtggaggaataggatgttaaagaaaaagtcttaaaatgatcatattgtaataccaaagcctgacatttatgaagaggggtggagaaaattaagaaaaagtagtcatgatatttataaatgctaattgtgttttgttaaggcagtttgagtttattttttgtttccctttgtaagttggcattgcctgtatttaaattctgtactaatttagtaactgcattttagagcaaagttgttgcaatgttgcttttttagaagctgcctaatacagtttgactctccatttgccttaataaaattatattagcaggacttacttcatttgtgaaagtttccctttgtgaatttgtggcttttagtctaagcgtaaataacttgggtttcttggtctctgctaaacagcccgacagtgatggttttttggacagttcagaagaaatatactacactgcaagatctaatctggtatttctcatcttctgattttctttgtcagcattgttttagtcttaattgttttcttttaagatcaaacattttgtccaattaaagcattgttttataagttgctatcatttagcaaacttctatatattaagaattgtagcagttttttcccataacaagttacatatatatatctactcaaatataatgctgtagtaataaacatgcttgtattttttatgaaaaatgttaatatttaattttctcattcatatattagggttttttttttaagaaatggcatttccctgtaaaaatgtccagtttaatgatgtaacttgttttaatgaactagaaaccacccatccacatgtatatatataaacaattcatatgttatatggtacatatattcatatgcattacatatataatattcatatatcatggtacatatattattcagataatatatggtacatatataatttttaaagataatttattcctacattaacaatgaaatcattctcagatgaagttttaatttttcagcattactatcatgtctggtttccttaggacaaaatttagattataaagcattcctgaagttataaatactgtcttaccattacataagaaaaaatgagaaattgatgctattaaatgttaaataaataatacttttaatagttgttattaagtaaatagttctttctgctactgtggttggcgagagccccaagttacccccatatttactcccagattctacttttctgacttttaaatggaattttccttatctttccttcctctttaccttagtaacatacatctttcaattttgattggcttaaatgattctttatataaattttttaatctaggacctctgacatttgtaaaatataaaagagattttagacataatttcccttctttagggaggttgctgtcctattggacagaatatacttacacatacaaactcttacccatgcaacaaaatacataatggcttgccaacattttgccaggtggcaagtgttgatgagggaagctaacatacaataggtactgtagagatgagagaaggagaagagctctggggcccatgtggcttatctggcttctgggagggactaagactaatgtcagtattgtgtaggaacattgtagattcttcaggaagaaaagggaccagatgctggctctgtttcacagcaattggaaacagttgccagcacagaccacaggtttgagagatgtcaggcagagagctgagattttgaaattatcatactaatctcggattcctttaaaaaaaagtagatttaaattatcaaagaggaagtgatagatgaagccatgaaattgcatgtgttccccattgttaaatctgaagaaacagtgcaaaaaactggttacctcagtggatgatgcctatgtttaacattcaggtagaaccaacattggaagtagggaagaagcagttgaaaagctaggagagccagtaaatgcactgtctcaaaataaagagggaatgtgttcaatggcataaagagacagaatgtgtgaggattgggaattaacccataggggccaagtgagatagaatgtctgaagaaaacacagtcggtgcttgctggattgaaaatgttttcagaattacacacgtaggctagaatgacaattagtgaaatttattgcagaaataaagacaacacaatcaaatttttaaattgactctagtatttattaatatcctccatgtagaaaagataacaacaaaactggaaacataatactttaaaattacaaatactcagccgggcacggtggctcatgcctgtaatcccagcagtttgggaggccaaggcgggcagatcatgaggtcaggagatcgagaccatcctggccaacatggtgaaaccctgtctctactaaaaatacaaaaaattagctaggcatggtggcatgtgcctgtagttccagctactcaggaggctgaggcaggagaatccttgaacctgggaggcggaggttgcagtgagccaagattgtgccattgcactccagcctggcaacagagcgagactccatctttaaaaaaaaaaaaaaaaattacaaatactcttttctgtgccacatgtggaactagcctagtaacttgaataagttaccatattgtggctttgttccctgtaactgctcccaccttcatccctgctccctgccctataatcaggagtttcctgtggtacaggggagcatttgacaggggtcttgtgacaatggagggatttagggactattaggttagttcgggcagaagagggatgaatgaaatatttgtcagagtatacaacttataaaatcaaccttaaagctcactcccaatggtaacaaaagctaacatttatctagaggtttttatataccaggcattattctaagcactttaaatatattaacttattattcttgttttacaaatgaggtgatttaaagtgcaaagaagctgaaattcgttagtctttagctaagaatagcagagctgggattcctaagcagcctagctcaggaattcaaaactaaaccactgtactgtgttgcctctacccaacatcatcagtatatatttttaaagtaatactgggccccccacctttttaaagtaaatatatatgtcccatggttatgttttgtttttgttttttttactgtggtaaaatatacattacgaaatttactgttttaatgtttatgtctacagtccagtggcattatgtacattcacattgttacgcagctgccaccactctccatcttcagaatgatttcatcttcccaaactaaaactctatactcattaaacaataactccccattcctttttccctccagcccctggcagcgaacactctgttttctgactatgaatttgacttctctagttatcttgtataaatggaatcatagcatatttgttcttttgtggctggctcactacttagcataatttcgtaataccttcagggttcctccgtgttgcagcgtgtgtcagaatttcctttttaaggctgaataatactccattgcatgtaaataccacattttgtttatacattcatccattgatggacagtgagttgcttctaccttttggctattgtgaataatgctgctataaacatggatatacaaatatctgtttgagtccctgctttcgattcttttgatatgtaactagaaatggacttgtagttctatctttaattttttgagaaactgccatactattttccacagcagctgcaacattttacattcccaccagcgatgcacatgacttctactttctccacatcctcatcagcatttgttattatcctctgttttgttttgtttttgactttcgataatagctatcctaatgggtataaagtagccatagttatttctgtgttctaattttatcaattctaaaatcttggcactgtgaacaagatttcatctcttacaaatgcttgtggctggccactaaaagcctgaggaatccagaatgtctggccctcatcttagctggcagttggcaccaaggtaaaaaccctaaatccctttgggaccagaagaaacatttacccctttaaagaccttgctacataaacattccatattacctgtgatttctggttgttttaaatgccaactgtttttattttgtgattttgtaagtgaatttagaatgttgtatttaaacttttgtgctatccaaaagtgctctctcaaaaaaaaaaaaaaaatcagataattaatatatgaagccagaagaatagggcttgattttttagaattgacagtatgagaatttttgaaagatgcctgagtttaaaacaaaaactcactgtaagttaattaaaagagttttgcccataaccataaaaatcagtttgtctgatctgcaaaatgctatctgcagattaaaagattatattacacatccgtcttaactgatgctatttttttctaatttgcatagttttactggctatttaagcccatgtaccaattaaaaacaaaaaattgaaagttaattctgtataaaagactatgttgacccggcgtggtagctcacgcctataatcccagcactttcggaggccaaggcgggtggatcacttgaggtcaggagttcgagaccagcctggccaatgtggcaaccgcatctctattgaaaatacagaaattagctgggcatggtggtgcacgtctttaatcccagctacttggaaggctgaggcaggagaatctcttgaacccagaaggcagaggttgcagggagccgagatcgtgccactgcactccagcttgggtgacagatcaagactgcatctcaaaaacaaacaaaaacccaaaaaacactatgttaatgactatgtaggggcataaataaatagtaacataatcattgctctgaagaagtatatagtatgcctcacctgccaatattcatttccgagcctgcagtacaaaagtcatattattccattttcaggctccttaatctgcttttattagtcagaaacctaacttgatcagttaatattctgactctacttgcttttctgactttttaagaaataaaaaatatttgaattatcctggattcaacacctctctatttctataaatcatctactgcgttaaaaagtgtctcactaacaaccttatttgtgccataattttctcatttttgatgggaaaatatttctcctgttctctttcttggtcaagatatattgctcaagtatttttttcttttgtgtttttgtagtgaactgtatcaattctattgacttcctgctgctttctcatcaggtatagacttaaatctcccaaggggattttttttaaaactacaataagatgtttttggtcatatgcttttccttttccggtgctccatgttacatcctttgttcattttcagttctttctcacactttgtgttcttagaaattccatctgaaatttagaaatagtctcccattcgctaaaatgaactgctgaaattaggactttgcaacccaaaaagatattttaattgggctaggataacgatcttgaacttttaatctatactaggttattgcatgttttcagctcctgttacttatttgactctactgtgtaaacactgtcattcattaacaagttgatgcctgattagtgctactaactttttttatgctggcatactcaagtgtttcttgtttagcttgtaaagaatggccataagataccatcatcttgggatagtttgagcgcctttccaagcattattttggtagcatttttctgatatggaataacttccaaatcctttttgaaaagcattttatatcagtctttcttagactgccccaacgacatataatgaactactaactttgccctggtttcacttttgttcctttcctttttatttcttgtcattttccctatccgattttctgtatgaattcctgtcagataataggtgcttggtaaacaatggttgtattaaatgagattagaaactttttagaaggatttaaagtaatattttacttatggtattcctagcacattgttttgttccatggttgctataacataatttaaggagaagaaattgttaaagaatgagcccctttgaatttcacctttcctggtaagacttgggacatgacccatttaatcgtcggacttggatgtatctacaacttctttcctggcctgaatgttattctctatatgagcctatgctcaattttctattaatatattactttagttattttagatacttttcttacctttctaaatatactgctgaactcagtttattttctttatttttttttaattttttttattattattttttgagacagagtctctctctgtcgccaagctggagtgtagtggcgcaatgttggctcactgcaacctccgcctcccgggttcaagcgattctcctgcctcagcctcccgagtagctgggactacaggcgcgagccaccacgcccagctaatcttttgtatttttagtagagacagggtttcatcatgttggccaggatgatctcgacctcctgacctcatgatccgcccgcctcggccctcccgaagtgctgggattacaggtgtgagccactgcgcccggcctatttcctttatttttaatcattattaccgcgcccggcctatatcctttatttttaatcattattaccagccttttacttgtcttatatcagatgagctgagtatttttatgacacatctgtgtttgtataacagaagagccatggccattccacacgaatgtgtgcttttggaagctgtcatttgattaaaggcttaagagattgtattggctaaagatatagctggtctgatagagggcccagttatctatagctgaagaaaacaaattttgtgtttatttaatttagtacttctctttactgaatactacagtttaaggattcagtggtaaagtcatgaccacttaaactgtgcagttttgtaataacaatgattttatcttattaagatatatcattacaaattaaagagtacagatgtcctttttcattggaattttgtgtgataccagtgtgacagtcaactagtcttttttatgatgtgttatcttttctcacactgataagaacactttattatgcatggaataacacaaatattgaagaagacaaaatttgagtcttgtctaaaccaggattttgattttaattttcatcagatttttttgacaggtcttggaatatttaaattttaaagtgcttctctcttaaatgtaatgtattgcttaaaatccttatattttgaggcttagtttttagtgtcatttagaattagctttgtgtatcttaacgaggctgaagttttatttatgggaaaataaacagttggcatttgaacaagcatttatttatggtgcagtcagtttgtgccaggaacaatgctagaccgtaggctgtaaggaaagaagatagatttgattatttcccattgtttaaggagctcgcttttacaaacatgtaaatagattaaaatgcagtgtaagtgctagagcagctctgtgtgttaaatgctatggaaacttagagaaagctgcagataattttccctggcaatcttggaaggcggctgctccaaggtggcttttgtgttaagccctgatcatgaatctgagaatatcttgtaaaaataaaaagcactttaaatatgctatattctaatgtaaataagattcattttttaaatgtcaaatattcccccttaatggttaaaacagtgcctagattacagtggctctttaagaagaggacaaaaggcagctttacttcattcttttcatggttgttggaaagcacatttctttttctcaagaaggcatttgagttgagcatgtgtactgttcatccttttaaatgttaattcttaacactctataacccacagcattaagtcggaaggtgtttaaacagttgaggaactgccttaatactcatttgaagttttgcttaaaaaattattaaaagtccttcagtacaatttataatattgtacaagttcatatacgtaatttacttttaaaatagcacccaatttcatatctttaaaaaattgttacctgcgtgaaacagcagtagaaatatgtgaaagtgtttatatacgtaattattttagatactatatacaaagtaaaccaagatttttgtcacatattcacttctctgaacgtttttgcttcattataactggagaataaacaccttatttgagcttttttctttctaaaaactgatttttacaaaagttaattaaagtaacagtaaccaaaaatgaaactttgcatatattattcagaaaaattccaagaaaaacactcaaataataaaatacttaaatcaggactatgaactcgtgaaatccttctttttaagaatgtatagcaatacagatttatttgggggtctgggacttatcttttaaaaataatatgtattatatatattaatgtatcatggtgtgtcatatactactattgtgctaaatattttattttgtactattaggatctgcaactggaatatggacaaggacaccaaggtggttactttttaggtgcaaacaagtaagtaaagttcttttaaaacttaatttaaattcaagaattattaagttgcctttaatattatattttaatatttaaggtagaaaattgtattaggctggtagatatattttacaatatgcatttcacctttttccattgcttccttgctcattatttagttaatagttgtcctaatgggaagcatcaacataatttttttatatcaagctacattgctgatcttgtatgttagagaaaaccacatgtattgccactgaaggcagatacatgttttagcactttatttctaaaactgatctgtttatttcttataaaacttgctttggtacatctctaagatgggttggtcactaaaaacagctggaattattcatacaacttagaaatcttaactttttagctataaggtttttttaaagtaagatagcagttaaaatgtgtgtctgaattcttaaaagttaccaatctatgcagtaaataaattcaacagttatttaatgcctcttctacaccaggcactgtctaattgatagaggcacagaggtttaaaaggcagcttacaaacattaacaatttaaattgttcatttgccaggtatgatgggagacagaattttgctattccccttagagtctcattttctaagtttgtggataaattatgataaaaactaatttataagggaatataatttaaattaccaaaatcttccagcagtgcatatattattttaatagtcagaacaagttaaaattccttttttttttttttttttgaggcagagtgtcactctgttgcccaggctgcagtgcagtggcgtgaacttggcccacttcaacctccgcctcccgggttcaagtgattctcatgccccagcctcccagtagctgggactacaagggcctgccaccatgccaagctaattttttgtatttttgtagagactgggtttcaccatgttgatcaggctggtctcgaactcctggcctcaagtgatccacctgcctcagcctcccagaaggtgctaagattacaggtgtgagccaccgtgcctcgcaaaatttcaaaatattatttcagttgcattagagagttgagacatatatattcccatattttaagttaagcagttgagaaatagtaactaaagacaaatagcttagttttaagggtaataatgcaaaatcatgtttctctctttttttaataaactaaataccaaatgtttaatttttttagttaaatatgctatcctttcctaacagagagaaaaggctttaataacaatctggagaaatatattagtttttatttaagctgaacttcagttaaatactatcagagttttaaaaatattattagctttgatactattattaagtcattattattattagcatttatgttttttaaaatggaaaataagtgtaaaattttcttggcagagaaaatgaaattttacctaaatagttgactatttgtgatttataaattgtcttagtttgttggtgaaaaacaaaggaaagtttgtctcatagtggattcgcaaataaaaaaaatttttgaagtgtttttatgttattttctctaaatatgaagtccctaattttaaggtccttgttagtaaattttagtgtattttaagagactgaaatttttgggaaaatattttttaccttttttgattcatttaaaatacattttaaaaatctgtacatgcaaagtacaaaaaaaaaatgtagcccctcactaaatgcttttccagattccttagtttccattgtctgatttctgattgttagacattttcgtagtgtatagttattttggctaggtaaaatgttaataatttgcccaaccttcattttttgatgaattggatccctgcttaaggaactgtattctatgtaacgaacccttggcaaggtaggttggccaaaagtttgctctttggctgtgtttcgtgtgtaggtatagacatacatgtgacatgagcatggatgtagcacttctcttgctgtattgatatgtctgctttattcttgtgattaggcagtgttttaaaaacgggatttcctgctttctccataggtgatcaggcagacagatttccattgacgggtttctacctattccagaccgtgcaggaactatctaattataattgttaacataggtcttttctttttctaacaggaagcatatgtactttgacttatacttgcttgtctccttttctttggaattctaatctcactaaggtcagcttttctgataatttatttaaaaccaacaaaatactatttttaaaagaaaacactaggccgggcatggtgactcacgcctgtaatcccagcacttttggaggccgaggcgagtagatcacctgaggtcaggagatcgagaccagcctggccaacatggtgaaaccccgtctctattaaaaatacaaaaattagctggacatggtggcacacgcctgaggtcccagctactcgggaggctgaggcaggggaatcgcttgaacccaggaggcggtggttgcagtgagccgagatcgtgccattgcactccagcctgggcgacaagagtgaaactctgtctcaaaaaaaaaaaagaaaagaaaacattaaattatttatgttttgttttaatttagggcaaaaatgttgaaggtaaattctcttctaataagtaatagttaaaagagtacattgaattacacaattcctggcacagttgagtatagtagtagtaaatgccagatggcttttcctataagctacatgactttgagaaatttacctctattattgctagtaaaatggataatataatagtacctgcctcatagggtgctaaggatgaaatggaataattgctataaagcatttagcacatttaggacttagtaaatacttattagttgcctttatttatggtagttattcagtaaataattgttgattgtatgaacaagtagtaatgtgagtgaataaaactgctgtttaattttagagaaatagggtttttgtttgtttgcttgttggtttgaaatgtaatcagagcagtacttacagattgggggcagttagacaatttttaaagatgttaataaccgcagcactgattctttagctaatgcaaatatgctgagtattttggtggtcattttagacctctgccatatctgtttgtacattgtttcatttttaaccttttcgtcaacatttcttactcattttagattgtcttagaattcagcatctgaaagcattgtttttgttttgttttgttatttactttataaaacttccataagagaagaattcaagtggactagtgaatagtgacattgtttattgtgtaacattcaatcttggtgaataaatcagtatcacattttctccagtgctctcaagatgcaatatttactgtaaacagactttttagcaaatttagccatatttcattttctcttttataaagcctaaaaagtaaatcatgcatcctacttttcattaagaccgtattaattctgtaatttcattaataaaatatgttaacacacaatggggatttataggtaaatgaattaaaatatacatatgaatccctgagccatgggctatctgctttttcatattcacttattcaaccattctcttattgttagagaactcccagaaagattctttttaaaaaagtggaatgctggctgggtgtgatggctcacggcttatacctgtaatcccaacactgggaagccaaggcgggtggatcacttgaggccgggagttcaagaccagcctgggcaatatagtgagactcagtctttactgaaaatacaaaaattagccgggcatggtggtgcacgcctgtaatcctagctactcgggaggctgaggcacgagaattgcttgaacctgggaagtggaggttgcagtgagccaagatcacgccactgcactccagactggaccaaaaaagcaagactccatctcaaaaaaaaaaaaaaaaaaaacatggaatgcgaatgcaatataaatccaattaaatatggtacattttaaattatcttcctgtattcaaatcctaatattttctattgtaaaaagaaatatctcaaaaaagattgtcatgtgcttaacaaaaaagtattttttcacatctaaaattacataaaagccaactgtacagttcagatacattatgtttaatttggtaaaatagtttaaagcagcacttctcaaatatttggtctcatgatttttttacagtgtttaaaattattgaggattccaaagagcttttgtttatgggggttataactatcaatatttatagtattcaaaattaaactttagaacttttcaaaatgttaatatatttttaaaataatattatttgttataaataacatacttttgtgtgtgtgtttaaaaaaaaatctccattcttaaggaccaactcaaatgccagctcttcacagtggtttcttaaaacacctctgatttctctcctgagactcagaggcagtgaataattgccataaaaggttttattatatatgtcagtgcactgcagaacactttttgttgaggtccactaataacatttttttatgaaaaaaatagctattttttatgagacaaaataatattagtaaaaaaaagtagcattgttttacttttttttttttcaagtcttgttaacattgccttaatagaagacagctaaattctcatgtctgctactgcattcaatctgttgtggtatcacacatcttgtagtctctggaaaactccagtgtatactcatgagaaaataagagcaacaaaggtattacatattgtgaaaatagtttggaccttgcagacccctacaggagactaagagaccccaggatttttataccacaatttgagaactgctagtttaaggaaatgttatttagccaatagtaataaagaaaatactaatcaagtcccaactctgtcctaaattacccttctgggcactttacctacattaattcagtagaccttctgacagccactttgaaataagtactgaggtaatttctactttacatagctggaaatcaaagcatagagaaatcagagtaacttatccagtgccatatcctgtgatggtgaaggcaggattcagattcaggccgtcttggctttaaagcctgtctgcattttgctctagtgcctctagacagaagctcctgctttcttagagttggcccttggagagctttgtgaataagataatatttgactgtggtacctcactttttgtatctccaaaataggacttgcaattagtttgtggttttcctatagaatttaccactctggagtcataagtttttcattttttaaaatttaaattgttgttaatctaggctaattaaaatattgatgcctaaaacctattctgttaattgcttacagtagataaccatacctttcagtttctctagttttatgttttgtaattttaagggcagtttttcctgatatgtattaggagggaaaataattaaaaggtgctacctgataacttttagggagagtaaaacttttgctgactctcttttatcccagtagtatattagtaactatatttatctcccctattagctttgagaagtctatcgagtctttatgctcgaagagtgtaatttaggaggtatgctgcatgaacttgcggtaaaaagaagtaagggaacttcaggaatgccatagttctctcttacattcctgaaaattaaagttttgtatactgctcctaatggtaaaatcctcgacctggtctgatacaggcttagtctcccaaaagtgtaaatgtgtttgcccgtgcaccactggagaacaaatccttcaggtaagtgagtgtcttccgtgaaagcaaagtgctactacattcatgtattcacatcacatgcatgcatgcttctgcagagagatccaacatggtgagtttcattttgtaggattgcctgagagcatgatgttattttgaagtgtgtcaccttccttattttaagaaaaagaaagtatatataatttcaggtgtcaggtataaaattccaggtaaaatttgaatcctggagactcctggctatgaccctgcaattattgttttgtcagtactgttgtgacattccatggtgagttgtcttctgtttgaattggtatttttcaataaatattaggatttattttgttcatttaaaatacatatataaagacattggcaacaggaaaatagaggtattttattaaatataacttgatgttttatggttgcagaggtgatcactagcaaattttcagtaaatggtaaaaaagtaatcattcaaaaaatgtatggttaaggttaaaatgataaaaacacattcgatattcctttgataatttattcacattattttttgtttttgttttttcttttaaggagtcttctcaagtctgttgaagaagaattgcatcagcggtaattttaatttttaatcttaaagtactttatgtcacagacaagtaaagtcagtttgccttcttctctgttatgtagcctatttgtttgcgttgtcttttttttctttaatagagatagggtctcgctctgttgcccaggctggattgcagtggtatgatcatagctcactgcagccttgaactcctgggctcaagcgatctttccacctcatcctccctagtaacggacatcacgatccaccgctcccagttccttgttttaattctgaatctatcctatcctataaagatgcagaaataaaattttatcttacagtagcttttcctgcattttctaaaatttcttcttactgttttggtaaaatccatttaataacaatgacattatcctttttatttagaggacacgtcgcacatttagaagatgatgaaggagatgatgatgaatctaaacagtaagttctgtctctgtttttggtaaaaagaaaaggtgtcatttgacctgatttcatcaatctggcagcttaatattgatggaaatttcaatatcagtaacacaatatcatgggttgtatctcagtttccttccttttttctattctagttacattaacttgggctgacataacaaaataccatagacttagacaacagaaatttatttctcacagttctggaggtgggaagttcaagatcaaggtaccaaccaacttggtgagggctgccttcttggcttgcagacagccgtcttctggccatgtcttcacgtggcctttcctcagtgtatgcacatggtgggatcaggggtaagagtgatctctctctctcgtaagatcaccaatccataggattaggatcccactgttacaacctcatttaagcttaattacttcctaaaaacccatctctaaatataatcacattgtgggttaatacttcaacatgtgaattttatagtgacacatttcagtccattttttccaaaggacaataattttttattgtagatttatcagtgattgatagctgctgtaattttactacaactacaaagaagcttattataaatttgattaaattttaatctgttatatttcaagtgaacaaatactttggatgtaaatatatagttttaaaggaggaatatttttactattatgtatgcattgatgtttacttttttttttttaataaagatgcagtttcatggtaaaatgataagagcacttgagtagcagttgagggcataggttgatcttgggtaaagttacataaactttctaggccttgaaatcctcatctgagacatttgtgcttcatcatattacaattttttctttctttcttttgagaaagggtcttgcttgctctgtggcccacctgaagtgcagtggtgtgatcttggctcactgcagcctcgacctcctggctcaagcagtcctcccacctcagcctcctgagtagctgggactgcacctccacacttcctaattttctattttttggtagagatgggtttccaccatgttgtccaggctgggctcgaactcctgagctcaagcaatctgctcacctcagcctcctagagtgctgggattacaggcatgagccactgtgaccagcctctttctgtttctaaaactgatcctgagttataatgaatcctaacttcagtcacattctgcatataatttcataaagcatatatatagtttttgatgagcttcatcaaagatgtttcatatctaacagtagcaaaaatgaagtttacaatgtgatatattttatactgtatcatttatttcataagccagatgtggcttatgttcttaattatttacctttcagttgatataaactggaattataattatctttcccagttttaattacaatatagtacttggaaccaagaaagtgtattacccaattacttctttttaaattgaatttaattcttttaactgaaataattataatacaaatttctgtggtacatagtaacgttttgatacatataatgtagtgatctgatcagggtaattagcatatccatcatctcaaacatttatcatttctttgtgttggaacattcaatatcctccttctaactatttgcaactaaataacacattattggttttttgttttgttttgttttttgagacagagtcttgccctgtcacccaggctggagtgcagtggtgtgatctcagctctctgcatgcaggctctacctcccaggttcatgccattctcctgctgggactacaggcacccgccaccacacctggctaatttttttgtatttttagtagagatggtgtttcaccatgttaaccacgatggtaggatggtcttgatttcctgacctcgtgatctgcccacctcggcctcccaaagtgctggaattacaggcgtgagccaccacgcccggcccgttattgttaactatagtcatcctacagtggtataagagagtagtaatacttacatactgtaagtatttacataactgtaattttgtattctttaacaaatctctccctttcgtccccttttccctgcccttcccagttcctagtatcctatgttctgctttttacttctatgagatcaacttttttttttagcttccacatgagtaagatcatgcggtgtttaactttctgttttggcttatttcacttaacataatgtcctccagttcccagttacttctgaataatacctctagcaacatttcacaaaatactttagaaaaaacttacaatcttagaaaatgatatttgtctttgcagcttttttatgtgtctttgaaaaaattattatattttaggattgattcatttgtaaaatgaatagttctgattctaaacttttctgtttttagctcaactctgaaagcaaaaattccacctcctttgccaccaaaggtagacagatttatttttcaatttgatatatgtgtgttattgttctgccaatttaatactttgttgagagtttttctagcttttcatttgtgatccacaaagaaaaatcatgaagttgatataagtaaatgattttttattatgtttgtctcattttataatgcccaacttatatttagtgttctttttttttttttttttttttttgagacagtctcactctgtcacccaggctggagtacagtggcatgatctcggttcactgcagcctcctcctctcgggttcaagcaattctcctgcctcagcctccccagtagctgggattacaggcacccaccaccaggtccagctaaagttttgtattttttagtagagactgggttttgccatgttggccaggcttggctcaaactcctgacctcaggtgatctgcctgccttggcctcccaaagttgtgggattacaggcatgagtcactgtgcctggccttatttaatgttcattctaagtaacaagtcctaggaatttacactgaaaatgattgtattaatggattagtgttatttgacttgggttagaaaactcacatttcttacaagattgtttttctcaaaatctgcaacctattcctgacttctaagaatgaataaaggatagtaatttatcatcatagatatttaattttcaaaagataattttaattaaaaatacaaaatagtacaatttttaaatgctttttaacaacaaaattatttttccaaacaaaatcattctaaaatagtaatttcaactgatgggttgttttttttaaaggtaaaatgagctaatatatactttataagttcatatgcatagcaaattttaattataatatgagttgctttaaagtttaaaatcaaagtgttacaaatgagagttggagtcttatcagtcttgtcattcggtttattactatttttatttattttcattttatacaattgagaaaatcctgattcatgcaagtaaataatgctgtacttgcttgtttagttttatcatagcagaagtaaagagatctgaatttcaaagaaataagtgctgagcaataataagagacacgttataaattctacaaaccgtcagccaactgtagatttttccattgtttgtacagaaagtgtctcaggcatcccatattgctatgtttgtattctccaacatgataacgttttttgtttttttgttttgttttgttttgagatggagtctcgctctttcgcccaggctggactgcagtggcgctatcttggctcactgcaagctacgcctcccggattcatgccattctcctgcctcagcctcctgagtagctgggactacaggcacccgccaccacgcccagctaattttttgtatttttagtagagacggggtttcaccatgatagccaggatgatctcgatctcctgacctcgtgatccgctcgcctcagcctcccaaagtgctgggattagaggcgtgagccaccgcacccggccacatgataacattttaattggtatcctctcatgcccctggtctgaaagattaagcattaccataaagacattgagtcatctaagagacagcttagattagccttgatacggagctgaactttgactagtctgaatatttgaaataaaaagagattgatttaaattgaaggagataagaaagactaaaatatttttatttggctagtctaagtggggagacttgtgaggaattaataaaaaagtcgacttagaggcccttttatttgcacagcagcaaaacctgagatgtacacattttagtgtacatttttagaatatatttaaaacaataagatagtctgaattggatggttgagtaacctttaaactcatctggtaaacctctaatgtatagtagaaataatttgaaagcttttaatgtataatagtacttacttcaggaaaataatttgatgtttcattgttggtctctttttctatattatttcagcctaagtctatcttcataccacaggaaatgcattctactgaggatgaaaatcaaggaacaatcaagagatgtcccatgtcagggagcccagcaaagccatcccaagttccacctagaccaccacctcccagattacccccacacaaacctgttgccttaggtaatggtggagggtgacagcaaatatgttaccaggttttcatactatggggagaaaaaaaactttcttttaagagattatttgaaattcttttggtggaggacagaaggaaagcagtggctatggagatgttttctgctttttgcctactagcttaaagtgtttttatgacaggattccctatgacacagtctgagatattttgtcctcatttctcatttcatatttagccttctctcttctagagactggttccccattcatttagctacggtgtggaaacaatgcaaattaaactatgaacaaacatggaaaatgtgttttgcgtctaggttacttctgttttagaagagagtaccttgtcctaactccttatttcatttaatcatttctaaaaaaataattggtattatttgctaggtatttgcctccaaattaatactagaaggtgctattttaacactgtaaagactcctctgtgtttatccagaagaagcaattttaaaaaagagcaactaggctgggcatggtggctcacacctgtaatcccagcactttgggaggccgaggcaggtggatcacctgaggtcaagagtttgagaccagcctgaccaacatggtgaaactccatctctactaaaaaaaaaaatacaaaattagctgggcgtggtagcgcatgcctgtaatcccagctacttgggagactaaggcaggagaatcgcttgcttgaacctgggaggcggagtttgcactgagccaagatcacgccattgcactctagcctgggtgataagagcaaaactccttctcaaaaaaaaaaaagagcaactaaagtttcttggatgacataataataaatcaccccttttctaaaagtagttatgaattcagtatttggttttttaatgctaacaaatacatgcacttatacacaacctgaatttaaatttgcctaatatgccagaaatagaggtataaatagaagaacatatatataaatgacgtcttactttcatagtaaatattctgattgggtgatcccaaatgaataatgacactatgtcagagttaatattttttctttcctacttgataactttctgaataaaagttttcatgaagattaatcattttcaatgaatatatcttattgaaggaaatggaatgagctccttccagttaaatggtgaacgagatggctcattatgtcaacaacagaatgaacatagaggcacaaacctttcaagaaaagaaaagaaagatgtaccagtaggtattgatagtcataagttctacttgtatttgtttcctttttaactgttaagttagttttatgcttacaattagtgacactatagcactagtatattttacaattactatattgatattttagtatattaattataatggtgaatagattatttaaatcttgaaaaaagtaacttagctatggtaaacttgaatgatggctttttatcgtttacattatttagaccaatttgttatgtagtacgttataaaacatcttctttatacagataaatgcttagtattcttgtgattattcacaaaataactattattattctcattgaggataattgattcttgatagtttctcttacagtctcatgaagttacggaaagaaggacatagataaagaaagctgtagcttctaccccaggacaaatttctaactatagatcaggggtccctaacccctgggccgcagaccagtaatggtcagtggcctgttaggaaccaggccacacagcaggaggtgagcagtgggcaagtgagcattaccgcctgagctccaccttctgtcaggtcagctgcagcattagattctcgtagtgcaaaccctgttgtgaagtgtgcatgcaagggatctaggttgcacgctgcttacacgaatgtaactaatgcctgattatctgaggtggaacagtttcatccccaaaacatccctccccttcaacccccatctgtggaaaaattgtcttccacgaaaccagtccctgatgccgaaaaggttggggaaccactgttagagattacataagtagtgacattgctgctcttacttaccacttcaagaaaggtgaaattagtcttagcagctactcctatcacaaatgttagctaaaacatcagaactattaaaacataaatgttattcatcagggatcataagagatgaaacattttaaacatttgtaaagaattgacttacaatcactggaagacattcaactatcatcatagaatttaaaatagtagaaaatccttaaaatccccaatatctcaacagatgtcaacaagatgaatagggttttttggaagtttttgtatatactaatatttgttatttttatagaaatttctagtatattcggtatgtttgtctagtacattcagtatgctatggtttctgcagtaagcacatcactagagtcttttgtgctatatctgtttaactttttaaaaatatttcactatacaatatgacatattattcttaaaattcacataaagtatttggtgttattcattgtaatttctgaaatttaggaatgggttttatgaagttctgtccaactgagcagtgcctttttgctttcaacaatttaaattttaatagacctgctaacataatagtacaaaaatgcagctgagtgactgtaacacagtataaaataaatagcctttgagagatgtaaactttttttttaacctttccaatggtactaagtaaacattttttatgtatgcatttttagttcactttttctgttaacttacttcattaagataaggaactgtttcagtaattctgaaataaatatgtccatggctctatcataggataaacagtatcagtgatatattgaagcatgcttacagtttatgctgtaattcttgaaattatttacagccgtcacatctgtaatcccagtgctttcagtggaaaaggcaaggggatcacttgagagcagaagttcaagaccagcctgggcaacatagcaaaaccctgtctctacaaaaaataaaaatttagccagacatggtggcatgcacccataatcctagctgctcaggaggctgagacaggagaatcacatgagcccaggaggttgaggttaaagtgagctatgcttgcctgccactgcactccagcctgggtgacagagcaagaccatatctctaaaaaaaattaaatgataataaataataaatttattttattttatttatttatttattcattttgagatggagtctcgctctgtcgcccaggccagagtgcagtggcgcaattttggctcactgcaacctccaccttctgggttcaagtgattctcctgcctcagcctcctgagtagctgggattacaggtgcacgccaccacgcctggctactttttgtatttttagtacagacggagtttcaccatgttggtcaggctggtctcgaatccttgacctcatgatctgcctacctcagcctcccaaagtgctgggattacaggcgtgagccactgcgcccagccttatttattttaaataatatttacaaccagttctattagtgcttaggttaaatctgagagttataacactcagagctccctaatttaaaatgatgttttgctaggccgggcacagtggctcacacctataatccgtacactttgggaggccaagacaggtggatcatttaaggccaggagttcaaaaccaacctcgccaacatggtaaaaccccatctctactacaaatacagaaacagccgggtgtggtggcaggcgcctgtaatctcagctactcaggaggctgaggcacgagaatcacttgaacctgggaggcagaggttgcagtgacccgatatcgtgcccctgcactccagcctgggtaacagagcaagactgtctcaaaaaaaataaaaaaacaacaacaaaaaaagatgttttgctaaaatagatgacatcagataatttaataacatcaatataagaaaaaatatatattatttgcataatggaataaaaaggtatcagaaattattggcaataataagatgtgcgcatcctcaaaaatatatctacaaagtatgtcattttaatttcagaaatgttatatttttatgttgtatatatgaaatcaattaacagtagcttttttattagttttcatctcattgtttaagtgattctgatgtatggcagctctagggaaaaattagaatgtcattccttaaaatgatgttactgagattaaccttgaaagaaatgtagactgtcacaaagttcatgtttaaagtatacccagggggttccctctcaggggacagttcgtatactcaagaatgtggccacttggagaaatatctggcattcttcagcatagtgtgggtgagcaaatgtgttacatttcttctccttataattgcctgtatactctaaccaatgattaatatatttgaattcatcaaaatttggaacttcacttagcaaaactcattgtaaacatggtgaagattatctacacaaggagaaactatttgttgtatatatataacagataaaatactcaaacctagaatatatttttaaaagctccaacaaatagatatgaaaaaagataactcagttaaaaaaaatgggaaaagaattcacaaaagaggaaatacagatagcaaataaacactgggttaaaaagattcttaatcttcctagcagtcagaggcatgcaaattaatgaggagcacaggagaaaaggttttttactaatcagcttggtgatattgctgtgagactagaaagaaccaggagctctcatacattgctggtgggtgtgatgtgatatgtacactctgaaaagcagtttgacagtcaatatgcactaaaatgtaaaagatagagaccctgtgtatcagtagtttctcagtatacccatactgcggtatacttctcacagtataccaataaaggcatccactcatacactgtgtaagtaggtatatacaggaaagtttatttcagcatctgtgttctagtaaaatattgacaataatctaaataccgaataatgtttaaggatagctaaataaagtatatttatgccatgctgcagttaaaacaaatgaactaagtctacatgaccgatatggattactgtccaattttaaggcaaagatcctgcagatagtgtataactatttgtgttttaaattcctaacacacacacaaacactattttctatgggaacatgtatttacatatataccaaaaatgtctggaaagccatatgattacataagtatatctaattcactagagaaagatttggaaggttttacaccaaactagtttttctggggcaagtactagaaatagtgcattgtgaaagaattatggggaacttcagccttaactgtaatgttttgttttacaaagaatgtattcatgtattttatttgaataaatgtgtttgaaatacagtattattatatcaaacagcagcaaaaaaagtgtaatcatacatgtgttctttttctagaagcctattagtaatggtcttcctccaacacctaaagtgcatgtaagtactaaatatggagtaggctaagtttcaagctaagtcacttgtgtgtgttatctttgcttaggtttttttgtctgtttgaaagaactttcattattattgaaaaaaaatctataagattgctaatttaattacaggcatgtgtcaccatgccccgctaatttttgtatttttaatagagacagagtttcaccatgttggccaggctggtctcgaattcctggcctcaagtgatctgcccaccttggcttcccaaagtgctgtgattataggcataaactaccatgcctgccctttttctttttttttttttttgagacggagtctcactctgttgcccaggctagagtgcagtggcataatctcagctcattgcaagctccacctcccaggttcatgccattctcctgcctcagcctctcgagtagctgggactataggtgcctgccaccatgcctggctaattttttgtgtgtttttatagagacgggttttaccatattggccaggctggtcttgaacttctgacctcaggtgatgtgtgcacctcggcctcccaaagtgctgggatcacaagtgtgagccaccacgccttgccgttttttacctttaaattctactttttaattagcacagagtatactttataaactgtatgttacaaaatatatatactttatatttgtaatttatataatacttaaattataaatattttaaaataattttaatattgatttatacagtatactttatattatatagcatatatattacagcagagaaatacataaaatagggcagattttcccacttgactgtaagataaaacacttacctcaggcttgcagtttgacagggaaaagctatctgtggaatgccaggtagactccagctatacaaattagcttaagattgggaactggcttgattgttttgttcttcgttttgtcatttaaatttctaggggttagcagtaccctaacacagaaatttccgtagctgtcttaaaaggtcgttattagggttagttaaatgatagtttctgccctacatcctaaagacatgtttctattggtctgctactacttgatggtattgccaagctaaattgttcttttttggtaccagagtctttaaagatatattgtttggtagatttctgtcattaaaagggaaattttaaggtccatgttttaattatgttaatatttttaatccattattgtcaactagtgatgttttcgttcagtatgttacctccgtgtttgtgaggaagacattccttctataaaatgatgcacaaatgctgttcttttaatttaggccaacatggcaaatactgaaattttctctgaccaaaaatatttttgtactgtttttccctcaagttgtcagtagtaaaagtgattacctgagtcaacattcttgtaccttgagtatttaaccagaaggataatttcagagttaatattttgctctttgataatataaagttcaaatgggtgatatatttcattatgatatatttattatctgaaaagtttgtaaatggacttgataagtaatattaacatcaaagagttaagctttttaatgaatctttccagggaaataatcagattgcttaattgaaaaaaataaaaataaaagtctgtgtttggaggttgaagcacatatatgaatttcaaatcagccatacctgtttcagtttgtaatgtgaaattcaatttttaataccatttttaggctcataaaaccaaacaagaaaaatgtcttcctttgtagagattatgatttcctttttaccagagactattgtattgctcttgacatggagcatgtaagatacattattatgcagaattggttcctattattgctttgtttagttgaaaagatagaaaaaataagaccttttttttttctcttttttccaagtaaaattattgtggcacctggaaacttgtggtaccactgttaggcaaatgactatgatgatttcttacacttacttctgtaaatttgaagatgatcataatttcagtatactatctatagactctcacattaaaatagataatagttacattttatatattaaagactgttacttgtcactgtttcatattggttattctttgtttccctagatgggtgcatgtttttcaaaagtttttaatgggtgtcccttgaaaattcactgtgcatcatcatggataaacccagatacaagaggtagtattgtgtgtttttatctgttatcttcctaattttttaaaactggggccatgaaagcatttgtgattttgtttattttctgagtatctttctggggaaaaaaagttttgttataattttttttttattttaaggtaaatatgtttctttgtgctgttatcagtgtttgaggtgacacataacattaaaatttcactgtatagttaccatatcagtatagtgaagccatgtattctgagccaccctagtttcctccagaaatgtttctgctgctgctgcacagtagtctggtatctttttttattttttatttatagggaaaatgttttgctctgccacccaggctagagtacagtggcatgatcatggctcactataacctcaaacttctggccttatgcaatccccctgcctcagccacccgagtagctaggactggaggcacatgccaccattcctagctgtttttgttttttaattttttgtagagatgggagctgtctgtgttccccaggctggtctcgaagtcctgggctcaagcagttgtcgcctcagcctcccaaagtgctgagattacagacaggagccactggccagtagcttcatttttttcaaaacagccattatggaaggaatttagctaccaaggatccggggtttagtgaccactttagaggatctctgaccttaaaaggggccataatcacaacagttgtccttaggcaaccactaagaactgtctgtgtcctctcactgtatatctgattcttaatagctgtctatgtaagatacacatagaacatttatacgtgaacatttttatatacatacacatacactcattaaatatgctgagtacttttatgtcataggcaaggaaattggcactcagagaggttcattgtttatagccaattggtgctagaaagggtcagtttaaatccaatactgtctgaccacaaatcttatgccattaatctcccagtactaatcttaaattctgggcactttaggaatgctcttagcattctatactgttctcagcgtacttcagtttagcctagttagtctagaaaagttcttgacctgtattatcttaaaaacagatcgggcacttttcttcaagttgcctgcttggatctcttggaagtgttctttcctttctttcctgttctaaagtctttttaataaatttccactcctgctcctgctctgggaaacaaacaaacaaacaaaaaaatggaaaggacgatggccatgcttctcatatcttttagaagatactgagtaccctagcaggtatccaagttttagttaactttttaatagactgtggtcagattctggggttttttaaattagagtacttatagtatagctctgaaaaaaaattctgtagaaataattagaatctgtatcagccactctcgattttatattctgtatgtcagttgcacatgatcctgtctttagggggttttagaaaaaggagctgcagatcctttgccagttcttagcattctctgatgagtgaagaatctactatgccactcttcagaacctcccttacataaaaattctcttcactgctttgaggctaatgtttacatataattcagtttatgggtctaaagtgtctaacctctttgtattcactgcttataaatcatagtaattcttgttttatatgttaatacttatttacggaagtttagattatagaaatcctatttaaaaatattttatttaccaaaatcagtcagtgaattacttttatttcagatcagtacttgatatttggtgccgaagaagggatttataccctcaatcttaatgaacttcatgaaacatcaatggaacaggtatgttattttgtatattctttttttttttaatttttaagttaccataagtacacattagaccagaaataaggttcagtttcatgacttgctgcctcttttattcttttttgttttgttttgttttgttttttgagaccaagtctcactcttgttgcccaggctgcagtgcagtggtgtgatctcggctcactgcaaccagtttcaagcaattctcatgcctcagcctcccaagtagctgggagtagaggcacgcaccaccacgcccagccaatttttgtgtttttagtagagacagggtttcaccatgttggccaggctggtcttgaactcctgacctcaggtgatctgcccgcctcggcctcccagtgtgctgggattatagacatgagccaccatgcctggctaatttttgtgtttttagtagagatagggtttcaccatgttgcccatgctggtctggaactcctggcctcaagtgctgggattatagatatgagccaccccaccccagcgtcttttattcttaaaatcctcatgacgccgagcatggtggctcacgcctgtaatcccagcactttgtgaggccaaggcaggcagatcacctgaggtcaggagttcgagaccagcctggccaacatggtgaaaccctgtctctactaaaaaatataaaaattagctgggcatggtggcctgtgcctataatcccaactgcttcgaaggctgagacaggagagtcacttgaacccgggaggaggaggttacagtgagccgagattacgccattgcactccagcctgggcaacaaaagtgaaactccacctcaaaaaaaaaaccttctggagcatgttctaattaccagatactgaagacaggttaacaggactagtccatacccttgagaagctcatgatctaatagggaaaacaggtgtataaaccagtaactacagcactcaggattagatgtcatattaggaatgagtataagatattggccacagaggtggatgtcaccagcacctcctgtggggagatgagtagaggcatttgagatggaccttaaattatgatgaatagaagtttgtcacacagacaggataagcatgatggcatagagatgtgaaatagcatggcaagtttgggaacaatgactgggcatttgactggagtacagaatggtaacaatagatggagctgggtaggcaggcagaagccaaacaccagagcttggtgtactatgctgatggaacagacctgtgttttagaaatatctgtttgcagtacggtgagagatgagactagaaaccatggtcaaatggtaaaagagtgttaattcagggcaaaggtagagaacagaggggaaaagatatttttcaaaaacagttttatcgagatataattcacatatcatacagttcacccacttaaagggtacaattcagtggcttttagtacgttcacagcgttgtgcagccattacaccatcagttttaggacatttttatcatctccaaaagaacctccgtaatcattagtggtcattccccatttctctcctcctctcccccagtatggggatgtttttgagtgtcacaatgagtggggggagcttttatcatttagtacccacgagtcaggaacataaaacaacctacaaactgataataatggtgatgctattaatagctaatacttacataaagcttactatgtgtccacgcagtgtttttaaatgcttgacatatattatttagtcttcatgaaatctctcacaggtagacaccattgataatctcacttcacggatgagaaaactaaagcaccgaaaggattagtaacttgccaaagactccatagctattcagtggctggactgcgatatgaacctaggcaagctagctccagattccatgtgcttaactacttcaccatattctctctaccgattgtatagttcctgtagagaaatgctggacctagagaaagatcagagatctagaattgaccgaattgaatgaccgtttcaacatggaggttgaagagaggtctaggttaactttaggttttccacttgagtgactgggtgcctgacagtaacagaaagatggagtatagtatactgaaggatgtgttgatttgaagagaatggtaatgctttcaatttggtcatactgagtttggggtgccttcgggatgtgtgactaattcttttatcaatataaatcgattacaaggccggccgtggtggctcatgcctgtaatcccagcactttgggaggccgaggtgggtggtcacctgaggtcaggagttcgacaccagcctaacaaataaggtgaaaccccgtccctattaaaaatacaaaaattagccaagcatggtcatgtgcagctgtagtcccagctactcaggaggctgagacaggagaatcacttaaacccgggaggcggaggttgcagtgagccgagatcacgccactgcactccagcctgggcaacggagtgagactccatctcaaaacaaaataaaaataaaaataaattgattacaaataaaatggaaagaaaaatatataagtaatgatttattcatgactaaacagtttcatcttcattttttaaatcaaattttctagcaagatcctaaactgtatgatatactgtaaatcttttaatctggaaatggtgtacagtgaaatggctgaaaagtgcctaagaacagggaaagggaggaaaaggatcttgtaattataataattagtaaataattcaaaggtggtcatatttttattgggtataatgagatatccaaaaataatattggtaacaatattaattgtaaggaataaggccagctttatgcataggtggagtaagcatttatcaacctaatttgaagaactcttttgttgttgttgttatttttgagacagggtttcattctgtcacccaggctggagggcagtggcgtgaacacagctcactgcagccttgacctcctgggctcaagtgacccacctcagcgttctcagtagctgggactacagccacatgccacaatgcccagctaattttttgatattttgtagagactgggatttcactttgttgcccaggctggtctcaaacttctgggctccagcagtccttctgccttacccacccagtgctgggattacaggtgtgagtcaccaggcctggccaggactcttgagagaaggcacccatcaaccacacctagccccagtctgcaataacttcccttcttagttgctttagcatttgaattacattactagagtaattttttttgaaacattgcccttcaaaggaaacatttttccctcctagagggagcctataagagtaaagaattagtatatgtggagcctgaatttttcatcttactgtgaaattgatgattaggttgattttctctagactttataggaaacagggtggcgtgagcctactaaataggggaagattctgaaaagtgagaagatgacactaatcagggtcctgatttaaagttttttatctgcttttattatttatagctaacatttattcagtactcagcactcttctaagtgctttacaaggagtatcttgtttaattactattcagctctatgagatacaggtattctgttttacagataagaacactgagacagagattcagtaaattacccaagatcacacaatcattgataaaacagatatatgagtctaggcagaatatagaagctacccttcttaactgttatattcttatttattaaactgatcatttcacctagaacctaactcactaaaggaagaaagcattgaaaatctagtaaagctttagatttgtaaaagttgttaaaaatgaaaattcagggtcaggcgcgatggctcatgcctgtaatccctgcactttgggaggccgaggtgagtggatcatgaggtcaggagatcgagaccatcctggctaacacggtgaaaccccgtctctactaaaaatacaaaaaaaaaattagccgggcgtggtggcgggcgcctgtagtcccagctactcgggaggctgaggcaggagaagggcgtgaacctgggaggcggagcttgcagtgagcggagatcgcgccactgcactccagcctgggcaacacagcgagactccatctcaaaaaaaaaaaaagagagagaaagaaaattcaaaatgaaatccagtactttttaaataaaactatacataaataccttttcattgtccctatgttgaaaatatgaaaggaatttgtgtcttgtcttgctactttatatatgtttatattaaataagcaaacctacttacatttggaagtatataattttatagtaaaccatcgatgtagtatcagatacttttttagtggatatgtgtatgaaaacccagttcaacactgaattaaataaaaatctgtatcttgctactttgataacacgtactgatatgtggtctggaataagtcattgccccttctctacctgattttttcagtatagccaatgaagtcccaattttgttgtgaattttttgtgaaaagcagaaagtaggaaatggatgttgataacttctctatttgaggcacaggtataggcacattttacaaattaaaaaactgtattggcaatgccacattttagttgtttggagaaattggttattttatgtaagtacattttcccagtaaatgaaataaaatttttattaaaatgttactttgtttctcctcccttttattattaccttttctcttttagttattcagtcccattattatggctgtgtttccataaagtaatgtccttagaggccttgatgtgtttcatcattcacccctgggtcctctctattccattctctcatctcaattagttttggagtaacttagttgtaggaattgccagagcaaacccagcaacaaaggttgttaaatcaggatgtctaattatgtacatcagtggctctcaaacttcagtctgcctcagaattacttggaggcctagttaaaccatagattcctgggtcctccttcagaacttcttgcttcagtagatctggggtgaggtccaagaatttacatttctaccatgtgcccaggtgttgttgaagctgctggtccaaggaccatttaaaaaccactgatacgcataacgaaatgtcttaatgagagtatttttttttaaatatatagattgtgttccatgaaattcctttttctttgctctaagttgtgaccactttcaggcttccagagatgcctctcagttcttatggtactaaattttagtaataaatttcatatatatatatatctgctttgtgatttatgagttttcatcatcttctatctcagccttttttttccctccatacctagtgtttctgtatcctgtgttccactacaccatgatgctttttcctgtatcatacaccctagaatgcatattgtgcctagatacgtctattttgggaggagtagagaggagaatcttattcaaccccagaaccaaaataaaggaatagatgttgtttgaaaatgttgttattccctgcatagtttggggttacatagcccttaatcataagggagacttgagctgatcatatcgtgtttaggctaaaatttagcctaatttattttttctctcacataaatatgtatgtatatatatcatcttggtttgaatccttgataaagttaatttatgttaaaaataatttacttttaaagaactgacctgtagataagacagcttacgtgattactgtgtacagatttacattgccattatgtattattctttgtaaactttgtgcctttttttaatcagctattccctcgaaggtgtacatggttgtatgtaatgaacaattgcttgctatcaatatctggtaagtatattagtttttaaataccttacaattgttactatttattattagcttttatgtcatatctgtttttctttataggtaaagcttctcagctttattcccataatttaccagggctttttgattatgcaagacaaatgcaaaagttacctgttgctattccagcacacaaactccctgacagaatactgccaaggtaagggtacatccttagaggcaatatgatattaacagttcattctcataaatatttatgttacagaaagtgaaagagcactcagtttgggttaataaaaatcatgatgaaaaaataataagtaatatacattaacaagtgcttagtgatcacactcttgttctaaaatttttctactttgtactttcaaattatatcagacattttctctctgaattttttattctttttctgcaagtttaaaactagtttttttcttgtactttgccataattttacattgcatttagtgcctttgcttttgacatatgtgttaactttataaaatttttctcaaagtttctatacctagaaaatcaaaatgatttattgaaaagtgtttttgcaacctggcatggtggctcacgcctgtaatcccaatactttgagaggctgaggcaggaaaatggcttgaggctaggagttcaagaccagcctgagcaacatagcaagacctcatctctacaaaaaatattttttaaaaagtagccaggcatggtggctcgagcctgtggttccagctactcaggaggctgaagtgggaggatcagtggagccctggaggttgagactgcagtgagctatgatcatgccactacactccagcctggctaacaaggcaagaccgtgtctcagtgttttgcattagaagataattagtttgaagttgagtggttttgcctttctagtttcagtaatttgttattatgctctgttctttcgttatttaatataatattggacctctttattgactgaaagattttctagctctggtataaattgtattttacaaaaactttataatatgcctattcttttttataatatttgttgtaaagcaactaacataaaaccttaattttcgagtaccttgagaatctgctgttctcaatagagacctttttagcttatttgcttttagctgtgttcgtttcttccagattttactgaatacaccaaatgtgtatgaaatgtcccatgtataaatgagacaaaattgaataagatatagtctcttcctttaaggagtttccatatggtatgattttacctacgctgaatataggtacttattgtaccatattataattcatttttaataaagcataagctttggaattcaagtaaagttgaatttaaatcctggatcattgacttactagatatgggaccttggataaattatacaacctttccccatgtgttcagctctaagggtatttcacctccaggttattatttcaggaattttattatagtcaatctttagtttttttaatagtaacagccacaaatatgtccttcccactttcttcagtttcattatctagtaattactgtaaaatcttttaattctctcacttattggcaggaaacctaaaaacccttttagcatcataatattttatatatgtgcattcataccatttcttctgccatacagtgagcacaacttaaacctctactgagtgtcttattcttaatctgatgataaagagcctcatggttctcattctgaagataggtactcattgtaccatattgtaatccatttttagtaaagcataagctttggaattcaagtacagttgtatcatttacttactaggtatgggaccttgggtaaattatacagcctctccacgtatattcagctgtaactggaacctatatactcatctggcagagttgttttgaaaatgataaatcgtgtatgtaaagtacctaccacagcacctagtaagctctcaagaaatagaccttttgtcatcattattgggcatgataaattgaactctgccttgtagtgtactctaaaatatcctatgttaaatacattcagacagttaatttagaattccagttaattgggtgctggtaaaataagttgtattgtgtttcataaaatcatgactaaaattaaggcaagtctatagatcactatagaacattaactaaatttttgaaacatttcagtgtactgcccacaactcttattttgaaaagtttttgaaatccttaattcacagccatacttaatagttgatttctgtttgtgtagtagtcatccctatggtctttcagaacttggcagttaatcctcctgggttttgactagttcagtgttttaacccctaagttagctttgggagctaggacacaagttcacaagtgtggacaggaacattaaactttctgccagccgaaatctgtcaggagcttggttcagattttttttaactctaaaaagcgctttggttcaaagcagattcgttaagagtgtggggagtttttgttttgttttattttaagctgcattaaactccaatgtatatgaaaggggcatttttataattgtaagttataatgtaaaacttttcctaatgtaaagttagtcaagggtacaatgaggtgttttaaccagaaaatcgtaatcagaatattctagattgccattgtagtcgttcagtgtttcaacatctgaataaattctgtgtcattgtttagctgtcacagtgtgaaaaacgttttgattcacaaagacaagtacttaaaaagaggtaacagtttttgacagcttaccttgcacactctgaataatgttcatttaaattgatacagcctgtagttccagctacctgggaggctgaggcaggagaattgcctgaacccaagaggcagaggttgcggtgacccaagattgagccactgcactccatcctgggcaacagagtgagaccctgtctccaaaaaaaaaaaaaaaaaaaaagacctgagcaaaaatctaagcttcagatttctatgctgtaacctacctctttattggagggactgaatgacacagatgtctaaaatgcatggcacatagtaaggactcagtaaatgaagctaaaattatagcttttcataaataggtcaatatataaaatgtattaagggttaaaattacagtactacgatattatattttttaatattatatttatgcttatcattcagttgccaattgtgtggttacaagaacatccatcaggaaaattgttctgagcttgtttggaattgcactgaacatcacacatgtgctgtacaattttatataaaattgtacaactctaaaaaaaaaaaaagacttgtacagagcactggcatctatctaatctttggcaaatttacacatttaagtttaagtggctcatgcctgtaatcccagcacttaaggaggctgcacttttggcagattacttgagcctcaggaatttgagaccagcctgggcaacatggtgaaatctgtctctttcttctaaaaattatttttttaaaaaaaagagtttagatgtttgtagaagtcaggcacggtggatcaattgaggtcaggagttcgagaccaacctggccaacatgtcgaaaccccgtctctactaaaagtacaaaaattagttgggtgtggtggctgatgcctgtaatcacagctatttgagaagctgaggcaggagaatcacttgaacctgggaggcagaggttgcagtgaactgaggtcaagccactgcactccagcctgggcgacagagcgagactccgtctcaaaaaaaaaaaaaaaaaaaaaaatagaaaaaatctttagccgggcacagtggctcacacctgtaatcccagcactttgggagtccgaggcggacggatcacctgagctcaggagtccgagaccagcttgggcaaagtggcacaaccccgtctctactaaaaatacaaaaattagctgagcatgatggcaggcacctgtagtcccagctatttggcattctgagacaggaggattgcttgaacctgggaggcggaggttgcagtgagccaagatcacacccttgcactccagcctgggcgacagagcgagaccttgtccaaaaaataaaataaaatttaataataaaaagtatgtacagaaatgggtttaatttgaggtttttacaatttgatgcaccaacaacctttattatattacattttaaaagacatttgagtgtatgtgtagtttttaaattgtagtttttaaaaaaattcagaattgatttttatctattaaattcgagtcagatgtttgcaaaacacctatagcacctttgcagaacatctgtatcccacttttcctgagtagagaaacaaagatttctaaaaaagaaattcttcacaaatttttataataagacagctttttacagtacatgtaaatgtattacatgtactaaaaatagctctctccagtttttggcttttcattttctcaatgatatcttttggtaaaccaaagttactaattcagtaattgactgccacctgtagtttgaggtgctaaggttgaatcagtgggggcaaaaaagccaattaaaatgtaacagcattttcctgtatgatttgttgtttttgtatttcttaaatcccaaggtcatatatttctatagacttctatagtttgttttcatatttaaacccttaacccatttggaactgattgggggccatgagaaggggatccaatttatttaatttttttttttttttttttggagaccgagttttgctcttctgttgttgcccaggctggagtgcaatggtgtgctctcggctcaccacatcctccacctcctgggttcaagcgattctcctgcctcagcctcctgagtagctgggattacaggcatacaccaccatgcctggctaatttttttgtatttttagtagagacggggttttattatgttggccaggctggtctcgaagtcttgaccttgtgatccgcccacctcggcctcccaaagtgctgggattacaggcaacgtgccatggcacccggcctttttattctaattttaatagatgagctagtatgtcagcaccagttttgaactcatcctttgtgcactgatctataacagtagctttttcatatactaagtttgcctacatatattacgtactcacttttatttacatttaggaaattttctgtatcagcaaaaatccctgaaaccaaatggtgccagaagtgttgtgttggtaagtaaactgtccaatagcatatagctctctgagactcctcctaaaatctggcataaaacagtactaccccagggcattctgccagcaatactttatttttcctgcttaagtagaacaaatttcttggctgtttcatctctgtgtagactaagcctaatacatagtaccttgcaaataatttatttgcaaataaatgtttattagcaaataaattatttgctaaacaaataatttattgcctaggtaaatggagaaagttgtatgacttttttttttttaccacattttatcacaccctgttttccaagggtcctgttacgtaccattcaccattctgcttagcaatggcttgtgagatggcatttattccttcagcatgtatttttatgttcaccttcctctcacctaaattcctcccccaccccaataacaattagttgttctatttgcatgtagccagagcaaaaaatgatttctttcccttaagttactattattataaaagggacgataaacacatgagtcattataccacaagtatagtgtggaaaggactctaaacataggctcactgaagaaggtggcatttgggccaggcctcaaaataaggcagattcagatttgaactgaatagatggagagtcatttcaaacagaagaaatgacataacatgtggaggcaaaaaaaaaatcataaaggttacataataaatgctgactattcgcttagctggatacagatgatagaaaggagagtggcagatgagtgtgagccattggccttgtgtgagcatgtacttattactgtgcaacaagtaaggaaggaagtcttgtgctagagcagtagcagtgcaaatagcagggaaggagtatctgggtgtgaagggaaaagatgtcagagatgactgaggcctcaaacccaaaagactggcagaagggcaagtgttaacaggaagcgagaacagctggtttagagcaaaagaggatgacaaggttgggtttagacatggtggttgagtctctgttagaactgcagcaaatttacttgactctacctgaggacaaaggggcaggtttttaggaaaagttaattataggaaagaatttcctatatagacttctctgttttctttggcgggacagttttgctgttctcctcctctgccatttaaatatttcaaatctatttgaagtgtgtgaactttactgctgttccccttttcacagttcagtttttttatctttattccaaatatatttacttcacatatatttactttacttcttctggtttataaccagaagaaaatttcaaaatctgaggtaattcaattttattatttgtaaaccagtattttaaggttcgattaatatctgtgatgttttctagtgaccataagaattgaatcaaaagggggaagatagacaagtgttttattttcagaaacaaaacattattgcctctgaacattaccaccaaaagcaccttgtgaaccacccgaatgtgttgtatcttaggagtctgacaacttcttcccaaatttactttgacccttttatcagaatgttgccacctcaggtaattttcctaccatcataagacgaaaagtccttcctcttaccccacagcctcattataaccagcagtttcatttgtgcatacaaataaaaatcctgcaagttaagagggcatttcctgctattacctgaaacagtatttttttcacccagccctctaattaagaaactgaactggcaaccagcttttgattttgttttatgtttagtttgtttagttttgtttgtttttttgagcatgcaattattgtcataatgactttgttttataagagaactcatttatatttttgctttgacagtaagaaatccttacacgggccataaatacctatgtggagcacttcagactagcattgttctattagaatgggttgaaccaatgcagaaatttatgttaattaaggtaagcataaaagtcagactatcttattcttactataaaagcttgtcaaccttactgttctttaaagaaacatttttttcagttaattttcaagttaatttagtgattttagataatgtggcagggttgtaaaaatctgcccagttgtaagcaacttaattggcctagtaaaagttttataagagactagagaaataatgcaagggtatggcggtggggagctggaaatagtgtctcacatacagagcctgatggcagaaacaggaagtactaaaagatcagtgaaatattttgaatacactctctggttgacctccatcacagctgaaaacaacatacaggttgcagtttggcctaggagaactaggggtaaccataatgacagggaaacaagttgtttttagttatatacccacccattaatttacctaggcctttccacagattttttttatagaatcatttaattaatgaataatttttaaaatatttactgttactcatctgtaacttacatttaaggaaaaactaacttttaaaatgtgtgaagtacaggctcagttaattacatcaaggaaataccaaatgaattttaaaagtcattttccatgctattatatatggactgagtggtcttatttcatgtgcatttgatctcagtagaaattagagtcggaatatagctggagtggggttcttcctaaattttatagtattaagatgtttaaagtattgactccctgttgtttaaaatcctgtaagtgactaagaaatctagttttcgttttcatatcagttttaccctcgagattcactagggctaaacagatgaaaatatagtttcaagaatttgaaacctattgaagtattaatttcacaggtaaatgcactgaaacaaaaattatttaaactgaaagctcaggggaaaatagccttataagttgtctaaagcagaactactgaatacagcccatttatggcaaacattgttttgttctcagctcctctttattcttgtttatttgacaaaagaatgctctatccaagatggaatggtaaagtctacacagtttgatttttcatcaacctcttcctttcctatctttttcctttctttcttcaggctattttaaatatgtccctcctattattttcattcctaacctctatcaaaatgaaaatgtttcatcatatcagttattcttgtatactgatatactgattaacctggtatgaatgaattttatgtgttatctaatatggtaaaccatttatgctaatatataatgaaagatgcttttctctgttagaggaattgtccatgtcaagagcatgcaggagggaatatatactttgaagacataggacgcttaaaaattacccatccatggcttctcttttccgggtagatggtaccagggtgcttggcctggctctaatgaggcctcttaccagcattctgagatagtgaacctgtagtacaatactacttgcaggtctccctcaagattttaatcactcttctcccttttcttaaactctctgagctataatgtttgcctgccttccttaatcttaacctagctttcctttccgtgtctctctgcgtcaagacttctatatgggccgggcgcggtggctcacgcttgtaatcccagcactttgggaggccgaggcgggcggatcacgaggtcaggagatcgagaccatcctggctaacacggtgaaaccccgtctctactaaaaatacaaaaaaaaaaaaaatagccgggcgtgatggtgggcgcctgtagtcccagctactcgggaggctgaggcaggagaatggcctgaacccgggaggcggagcttgcagtgagccgagattgcgccactgcactcccgcctgggccacagagcgagactccgtctcaaaaaaaaaaaaaaaaaacttctatatgtatattttgtctccatatttaacattatttctatcagtatttatgatgtttctatactataacccttaatcagatgtattcaaaaacattgttacgctttctatattcttgtttcctcctaatgacatttctgacagtttttgcatcattagactgcttttatttttttttgagatggagtctggttctgttggccaggctggagtgcagtggcatgatctcagctcactgcaccctcagcctcccaggatcaagcagttctctgcctcagcctcccgagtagctgggattacagacacccagctaatttttgtatttttagtagagatggggtttcaccatcttggctaggctggtctcgaactcctgacctcaggtgatccacccgcgtcatactcccaaagtgctgggattacaggtttgagccaccgcacccagcctggactgcattttcattataaataaaagttaaaaattaaagatctctccagcaaacatgatgtacctattgcaggcaaggcaccgtgttatttactagagagacaaaaatacattagatacaattgctgccctcgaggacaatagcaactggatttaaaactattagacatgaatccccttctgttaatgacttatacaaattgcttagttattattggaagcaatgtagaagtaatcaaaatctgttgtgtttttttttaaagcgttgtttctgtgtttaaactgtaaaagtttaaagatgcgtctttaatcagaagcattggttttttttctgcttcgttgctctttatttcaaagagaattatttaagttgctgtaccttattaaaaatgacagattttatcaaaagcatgtgccccaaggtaatgggaaagctcctagagaagaggtttggagaatattgatgaagtgtctgtgcccgtggaatggaggcactttagcagccacagggaaagaaggactgtaggaacagcaggtgaacacagagcttcacattccagccatgagtaccattttgtgtcttccaacactttaaaactacctgttaggatatcccccgttgcaccttttacttttctttagaatttatgagttgccagattaaaaagaaaacaaatcaaatccagtagcttcataaaatgctagcaataaccatttggaaaatacagtgaaaacacagccagtttataaaagcaacaaaaatataaaatatataagaatgaactaaataaaatatgcatgagagtggtattttttttaatttgtgaagaaaaattttagaattccctttgtcatcctcccttttagtcagctccctgcttcttttttacaaaggaaacctagaaagttcttccttttttctctttttttactatctaagctcatatccctaaacattagaactaattttatttaatttttcaacagtatttaagtggaattataaagtatatgttcatttgtgtctggctttttgtgcaacattatatttgtatagttgctggacatagctatagtttattcatttttcagttgtctatatataattttttattttgtgaatgtgccgtaattttatctgttttgcatttgtctcttgtatatgtgtactcatgttctttagaatgtatacctaggagtattattgcaaggtcctaaggaatgcctacttccagcattaataaataatgcagttaactagtctggctatgccactctatgtcccaccaccagtgttgtatgagcatttgcttactcctctgggatgcttattcactgtcattctttttaattttagccattcggtgggtatgtatagtatttatctcattgtggttttatttcttgattactaatgaagttagtgttttccatctattttttttgtccttcagaatgtgaatttattctttgtagcaatataaattttaaacatataaaattaaaatgggttgtattataactgagttgatttgataaaaatcacttgagatatgaagctaattttttttgatttatgactttttctgttcacatcttacaagaggagtgtctcttgctaattagcatttcacttctctcatccatgtttgctcagttgattaagaaggcagaggagtataactgaagaagcatcacattgggagacaggagactctgccacaaaggccgggggaccatgggctggtcacccagttcctgggccccaggttccaactctgaaaagagagggttggacacgtgacttataaattcccttccagccttaatgtcctaaaatcatgtaattataactttaaaatattttgcggtggtaaacctaaaatgtttataaaagagagtccataatttagatttttctgcattacctgaatttctgtgacaagatgcagtctttattgtagaaagctgttttatagtattctcatagaattattcggtttttattttccttggtttaatgtatttttgtttctttctctagcacatagattttcctataccatgtccacttagaatgtttgaaatgctggtagttcctgaacaggagtaccctttagtttgtgttggtgtcagtagaggtagagacttcaaccaagtggttcgatttgagacggtcaatccaaattctacctcttcatggtttacagaatcaggtttgtaatttttatggaattattaagggtaatacatatactggttttataagtagtaagtttactgtatctcttactaaggaaaaactgcatatactgccagtcttcaataactattattaaactggaagaagggaagattactctctttaaaatagctaattcatatgacacatttaaaacattggctggcagggcatggtgggtcacgccagtaatcccagtactttgggaggccaaggtgagaagatcgcttgagtccaggagttcaagaacagcctgggcaatgtagcaagaccctgtctctaaaaaaattgcatgtaagttagctgggcatggtggtgcatgcctgtagtcccacctaccagggaggccaagatgggaggattacttgagcccaggaggtcgagggtgcagtgagccatgttcgcaccattgtactccaccctgggtgacagaatgagatcctgtctctaactaaccaactaaatcaagcaaacattgccaaaacatgatactgagagcacatacaccagtttttttatttagaaatgaatataaggatctgatcctcaaagtcctgtgtatattattggtatgtatatttggtatatattaataaacaattgtgcatgaacacacctcttactataaaatgaggtatacacctgggttgttatttgattttggtgatatgtattttaaataacaatgtctcttgaaggacactgtgtataggaaacccgtaaagtcatgtttgcattaatctttcttggaaataattaaattaatattacaaattaaatgccaattaaggcactttttttcttcaaacaaaagggaaataatttatatagactcaaatatttttaatattttgataatacttttcattttatatgtttcacatttcctttttggagaattttacatgcatcaaattgttttgactaagttcattaatatgaaaatgaatacgaaatgtatattaacataggaaacatttaaaacaaaacttgggtacttaacattttcataactctcagaaattttaagtattttatgtatttttaagtggtgtatacctgaaaatttgcattttacacaactccagttgccctgcctccctgaggtgatgttacctttttgatcatcttccatcacttcactaggggtattggtaagagtgatcattgagtatgtagtatgtagcagcaattaccagacttgagcattcatcagaatcactgggagacttgtgacatttctgagccccacccccggagctgttcatttatagtctagataggacctgagaattttcatttccgtgaattcccaagtgttgctgatgaggttgacacaaagaccatagttttggcatatatagacaaacctcagcctaggcgatatagcaggaccccatctctaaatttttttttttaattagccagacatggtggcatacacctatggtctcagctactcacaaggctaagtcaggagggtcacttgaggccaggatttcaaggctgcagggagccatgatcacaccacagcatttcggcctgagcagcaggcgcaaaaaaaaaaaacaattttcatttttgtaaattcccaggtgatgctgatggtgttgatacagcaaccatagtttgagaactacatgtatttacaaatctcccactaatagaaaatttggtttttaaaagaagaaaagttgcattataggatattttaagtatgtttgttttctagtgcagtcggcattctgtatccatgtgttccgcattgccagtagtattgacaacagccaacatatgctctgttgagcacttacgttgtttagcacttgcatcagcatttaaacccactagcctggctcagtcactacatgtgtattacagaagacatatccgtttcaagtattgttatcctcagaattctttttcttcaatgtttccatgctttaagtatcacagtttctgtaggtttaccaaaatttgtttgtattgtagataccccacagacaaatgttactcatgtaacccaactggagagagataccatccttgtatgcttggactgtaagtttttatttatgaatgtcttactttaataagacttcttttatcttagtttctgagtgactttttttcctctaggttgtataaaaatagtaaatctccaaggaagattaaaatctagcaggaaattgtcatcagaactcacctttgatttccagattgaatcaataggtaagtcaaagttttataattctttgcattatgaactccttaaaataatttatctgctaattatccaaaattaaagattgatattattaagattctttttttaaaataaaggatatggctgggcatggtggctcatgcctgtaatcccagcactttgggaggccaaggtgggtggatcacttgaggccaggagttcaaaaccagcctggccaacatggtgaaaccccgtgtctactaaaaatacaaaaattatccaggtttgctggcacacgcctgtagtccgagctacttgggaagctgaggcatgagaatcacttgaacctgggaaggggaggttgcaatgagttgagatcgcaccattgcactccagcctgggtgaggaacgagactcttgtctcaaaaagtaaaataaaattagaggatataataaatatgaggtcactatcagccttcattcttacacattttctaaaatagtttaataactgtagtgtagataatgttatcttcctggtaagaagtaatatcatttcttttttttttttttttttgagatggagtgtctctgccacccaggctggagtgcaatggtgcagtctcagctcactgcaacctctgcctcccggattcaagtgattctcctgcctcagtctcccgagtagctgggattacaggcgcccgccaccacccccggctgatttttgtatttttagtagagacggggtttcactactttggccaggctggtctcgaactcttgacctcgtgatccacccgcctcggcctcccaaagtgctgggattacaggcgtgagccaccgcgcctggccttgaaataatatcatttcttataacatagttttgaattcccatttcctccagactcctgtagggtttttctataagtgctttaaaatttagtactcagtataccagattatgttttggctgttgtgtctgctgctcagagaattttaagtatatggaagttccttcttgtcattctcacattttgcttaataggagtatttttctggaaaaggatttctgacaatcaatacttttaaatgactacattcaggaaaaataaggtgaaaatcatcttatgtaggatagtgctgggaaaatgaatggtgattaatatttgactaggcacactttttctggtgttccttatcagtaaagatatttgcgtgtatgtgtattagcagacggtaaggctaaaggcagttagttcattgtcttattcctggttctgttttctacattctcccaactagaatgtcattcatccaacaaacaaatgattataataagtcagtttcgagggatatctgatcaagatgttaaaatggaatccgctttcaaagacatagccagggtcaaaaagcaagatcaacaacagaatctcaaagcagtatacaggtctgaagctaacaggcctgctgggctccagttacaaaagtatcccacaggagatggagaaccacagccaagttcattgcttgtggtacctgataatcaggcatgatggtttttttacctacctcccccattaaaggaagagataatccctatcctgtgcaaactgtttcagactacagacaaggaattctgaataaatcagtgtttaatactgatgctaaaatcaaacaagattagtacagaaaacaaaaattataatcttatgaaaatcatttttaaaaatctaaataaaatattagcaaatagaattacacattatcaaatagtaaactatcccaggaaagcaaggatggttcagcatcagaaaatgtatttatgtaatacacaataccaagtattaagagaaaatcatgtaactcttcagtagatgcccaaaaagcattcagtaaaatctgtcattaatgattttttttaaataatacttcttagcaaattgggaatagaaaggaatgtccttcacctagcaaagcctgttaaaaatatgtttaatgatcaaattaattcccattaaagtggagaactaaataaggatgtttgctattatcacatttcattattgtctattaaatgagaaagggaaagtatgaggattagaaagaaagataaaaagatcattttttgctgatggtatgattatgtacatagaatataaaaccctattaataagttactagagttagtaagagaattcagagttgctggatatgagtaacaccaaagaatagctttcctaaataatcagtgaaaaacttaattggaaaaaagatccctttcacaaaggcaataaagtaacatacataagaataaatgaaatccaaacatttttaagatcattatctaggaacctccaaattatttttttttaagacataaaagattcagcaagtgaagaactacatcatgtccatgggtagaaagacttaaatgagaaagatgccagttcttcagttaatccacaggttcagtggatctgcagtaagaatcccaacatgatgttttgtgccacttgataagctgctcttaaaattcatatggaatggccaggcgcggcggctcatgcctgtaatcccaacactgtaggaggctgaggcaggagaattgcttgagcccaggatttcaagaccagcctggacaacattgggagaccccatctctacaaataattttttaaagtaaaaaataaatttatatggaagagccaaagaccaagaataagaaaataaatgttgacaaatcgttttctacccaatattgaaacttactataaagccatagtgattaaggtagtgtggtaacaacacaggaataaataggtagaagagtgagacagaagaaaaggcccagaaatagacccacatgtaaatggaaattcgtggcattatgtattagtggggaagaaatgggccattcaacaaatgatgctggtacaattgcttacctgcagaaaacaaaataagatttattcctccctgaatacatgccaaaaagtatattaaaaatataaatataaaaagcaaaactaaatcttgttctgtttatgccctgtgcttcagtaattctatctatgggtgtctaccctcaagaaagatttgtacatgtattcaagatgtacaaaaatgtttattgcaaaattgtttgtaataatgcaaaactagaaataacctcaatgttcatcttactgaatgtatgaaggttggaaatattcaatataaaatttatattgatagtataaacttatagtaatagtaaaaacatgcatgagaatgataaataccaaatttataatagtggttatctcagggaggaaggaaagaccagaaatgggaatagggcagggtacataggggatgccagctgtatttgtttttatttaaagcaaaaatggcagaatgttaggatctgattgttgggtggtggatacacgtatatttttgtgctgttttctgtattttgcagtattttatttttgaaaattaccaaaacaggccgaacacagtggctcatggctttaaccctggcactttgggagggcgaggcaggcagatcacttgaggccaggagtttgagactagcctggccaacaaagtaaaaacccatttctactagaaatacaaaaaaactataacaaaaatattttcggtgaattttttcctaccaaaaagatgcataagctctgtatagtatatttttaaacttttcaaatgtaaagatgccatataaatatggaatagctgacattagttgtgaattgaaatattgctgtatgagatagagggatgaaatgatgcttatcagttgaacttttgtactattaacagtaattgagctgttcttgcctgctagtgtgcctacaagacagtgtgctagctttctggaaacatggaatgcaaggtagaagttttagatctaatgaggtaagtaaattatgtccattaagtagtcacaagacattatcaaattccacttcaaacagttcgattcctaaatgatacaagtaatgcttgattggctaactttattaatacttactgtatttagtctattgataaagtcagtagcccatactctatgtccacctctctctctctccactactcaaacaactttagtgcatatttaatgtgcttccagataatcagtctgaaatttagaacaagaacttgctaatctgctaaaagtgagccaactatgattttctttcaactttcccagaggaaccccaggagcaagagtgctagtgctggctctctctggccttaagcaccttttctaccttgtacttcagaaataatgaccagcgcagactataagtaaagagtcctatatttctctggaagcccacttacctctttattttcaacatccttattcatttgacatgtatataattctttgccccctttacctttcctttttattaacctttagctatgcatctcatgaatccttcctacctcacagaaataatttaactccaagctgtgtgacatattcaagtcagttcaacatttatgccggaaagttctgaggttataaacatgaacaagatgtggcacttgccccctagaatgttacaagcacgtaaaattgtcagaaattcttccagtacccccaagccaatctcagtcatgtaacttggaaggaagcttatttgtttcttaaactgtcattcattaagctcagagcgtttatttctaacaaagtaagcaatataccacagtgttcatgagcctgggttccagagttgagacactaggcttcaggtctcaagttcagctagttagtagctgggtgaccttggcatgtcacctaacttctttctacctatattttttcatctgtgaattgagttgttatgattaaatgaaacaaagcgtgtaatgtgcttggcctggttcctgacctatagtaagtgtttaaaaggtagctgctggccaggcatgttggctcacgcctgtacactcagcactttgggaggccgaggcgggcggatcacaaggtcaagagatcaaaaccagcctggccaacatggtgaaacctcgtctgtactaaaaatagaaaaattagccaggcgtggtggcgcgtgcctctagtcccagctactcgggagaggctgaggcaggagaatcgcttgaacccaggaggcggaggttccagtgagccaagatcgcgtcactgtactccagcctggcgacagaacaagactccgtccccctccaaaaaaaaggtggctgctacgatgtttctaaaagtaatccccacaagtgggctcacactttctaaaatcacgtgaggaactgagcagggagataagaacagtcaacagctaataaacactagtcagagaaagaaaagcattacagacaaatacagaagtggtttaaaaactaaaaggaaaaagttcacccaaaaagtcacctgagaactacacaggcagcccatcaatacacacctccaaaaatgttagcttcttctagtaggcaaaccccaaaatatattggtaatcacagtcatgatgagccacaggcattgaagtgagcatgctgagcatgttgtttcctgcaggtatgctgggttacaacagaagctaagagtcattagtgtttctagaaaatctaattgtaggggtattgatggaataaatttaatttcaaatccattttttcttcagcctaccaaattttggggagatgctaactgcccttctaattcataatattttgtgttcagtaagctgtgaatagttggtttctctttttcttgtatatttattcttaattccccaactggtagttggtcacactgaggacttcttgaaggatatatggtcattagaaaatattatttcaagagaatggggaagaagtgggaaagataattattatgtattgagcacttccttagctaggcattatacccactaatccttataagaacactgcagggctctactgcatggtagatcttttctatcccatcttgcataaggcaaaaccatttctagcggattacatacgttgcccagtaagtgggagaactgacagtcaaactcaaggcatgtctgccttttaaatatttcctgttacactacgtggcagcctttttaagtaaaagaagcagatctaagtagcttactgctgccagtaaccttgccattagcgttaacataaatgatgaaagtttctaataaataaaatggatttagtgctttgcttttaagtttttcccttgaagtcttatgatttaacaaggaaatcattttcctttgcctgcattttatgattaactcaaaattaaccacatttcccctcgactaacaaattgatgtatctacatgctgactttaacaaacagtcatgcaggaatatgttttcatttttagcgatcatgtttcttttctgttgaattataatgaagtgcccattaaaaattttgtgtctttaatttcagaaattaaatttgtgttttaattgaacaggtaacacaagaaatttcagatagcacaagaattttcaggctgcttggatctgacaggtatgaaaacggactgtattaaatacacagtactaaacgtgttttatagatccagcatgaaacagatttctttttcaagagaattgaaatgtctgcaatatgttcaacattgaatttttcacactataagaattcacaggtcagaaagttagcctttgaaaatgtacctgatcttccaagtaacaggaatgtatggatctgtcagtactagtttccattaaacatactgacatctgatttgcagcagaagaaagaggaaataccatatgttaatgaacagaactttgtgttgttaatgccgataggattttggagacctgttctgattgactgtaagacattggtcagggtggtgggagagattataaagttataggaaatagacacaaaccttcttggaaggccagaaggtttgcatagcttcagtaaaagatttggctgaaggcagctgaattctcttaaaagcttagggcatagatacataggaatgtagaggagtttatctaaatagcttgtttactcatgttgtcctaaaaccaacctttgatcatgcgggcaggactgctctttcctggggagggcaacctgataaattacccacaagtaggttgactcaaagcctttgtcattaaatctgtgctgaataaatgcctgcagggacagctagtcagggcacacggccactacaactctttctgtgagcgccctggccccctagccagtctttcactgaataccagtgtctgggtacgttattcatccattgtgcagcgtgggtctctgggtcagaccctggcaatttagcttctggttcttgaactgcaaatcgtttttagaacttgtaataagaattaagttcccccaaataatttctaatataggtttctccccacttctgactcttagaagaacactggcctagaggtgggaggtagtggacagcaaaattacttcccagagctagaactggccctgtaatcacagtgatagcaaatgatttctgcccacgatcaaatgagcagcatttatagaggcacatattggagaagcaatggaaaatttgggagctaacattaattttcaggaataactttgttttgttatatgttttttattactttcagggtcgtggttttggaaagtaggccaactgataaccccacagcaaatagcaatttgtacatcctggcgggtcatgaaaacagttactgagaattgttgtgctttgacagttaactctagaaagaaagaacactaccactgcaacattaatggatgcttgaagctgtacaaaagctgcagtaacctgtcttcagttactttgtaatttattgtggcatgagataagatggggaaaattttgttttaagtggtatggatatatttagcatattgaaccacacaagtgcttaattcattgttatgtaatctttgtacatataggcagtattttttctgtgaaacttcatattgctgaagacatacactaagaatttatgtagataatgtacttttatgagatgtacaagtaagtgtcttatctgtacagatgtaaatgttgatgaaaatgcaattggggttaatattttaagaattctttagtatattcttgggtgtggctatattacaaaatgggatgctggcaatgaaacaatacatttaacactattgtatttttattatatgtaatttagtaatatgaatataaatcttgtaacttttaaaattgtaatggaggctgtaatcattttataatctttttaattttaatgcaagtacactggtgtttatatttgcacaaagtattgatatgtgatgtattaagtcacaaaagtaagctgtgacattgtctataagcatttggctccacaaatgtatttggattgttttctatgtgaagcaaaccaattataattaaccacatgttgtagtaactggtctttttatatttaagcagaatcctgtaagattgcttgtctttgcttaaaaacaatacctttgaacatttttgaatcacagaatagcggtaccatgatagaatactgcaattgtggtcagaattacagtatgcacaaagaattaattagcattattaaagagtcctcactaaacatttcatatgatcacactgaagaactgtaacattccatagagtgaagtggttcaaatttctcttggaatttttacttttgttggccttattttatgatccttttcatatttcttttgacttagagtattaatacatggccaaaataatttagttactacctcatacaaacaatataatggttactacacatcacaggaacttagttttggtttaagtcatttttgattgcttttttccaatggaatatgtatataccaggttttagcaaaatgcacacttttggctctttttggtatatgttctttatattttaatgtgagtatatacactaagaacaaactaaattgtgatttatgatcttcatttattttaatgataatggttttaaaatatgttcctgattgtacatattgtaaaataaacatgttttttaacatgctgttgtatagta

SEQ ID NO: 360 - DNA, 81189 bp, Homo sapiens
gtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaaggtagtagagtcccgggaaagggacagggggcccaagtgatgctctggggtactggcgtgggagagtggatttccgaagctgacagatgggtattctttgacggggggtaggggcggaacctgagaggcgtaaggcgttgtgaaccctggggaggggggcagtttgtaggtcgcgagggaagcgctgaggatcaggaagggggcactgagtgtccgtgggggaatcctcgtgataggaactggaatatgccttgagggggacactatgtctttaaaaacgtcggctggtcatgaggtcaggagttccagaccagcctgaccaacgtggtgaaactccgtctctactaaaaatacaaaaattagccgggcgtggtgccgctccagctactcaggaggctgaggcaggagaatcgctagaacccgggaggcggaggttgcagtgagccgagatcgcgccattgcactccagcctgggcgacagagcgagactgtctcaaaacaaaacaaaacaaaacaaaacaaaaaacaccggctggtatgtatgagaggatgggaccttgtggaagaagaggtgccaggaatatgtctgggaaggggaggagacaggattttgtgggagggagaacttaagaactggatccatttgcgccattgagaaagcgcaagagggaagtagaggagcgtcagtagtaacagatgctgccggcagggatgtgcttgaggaggatccagagatgagagcaggtcactgggaaaggttaggggcggggaggccttgattggtgttggtttggtcgttgttgattttggttttatgcaagaaaaagaaaacaaccagaaacattggagaaagctaaggctaccaccacctacccggtcagtcactcctctgtagctttctctttcttggagaaaggaaaagacccaaggggttggcagcaatatgtgaaaaaattcagaatttatgttgtctaattacaaaaagcaacttctagaatctttaaaaataaaggacgttgtcattagttctttggtttgtattattctaaaaccttccaaatcttaaatttactttattttaaaatgataaaatgaagttgtcattttataaaccttttaaaaagatatatatatatgtttttctaatgtgttaaagttcattggaacagaaagaaatggatttatctgctcttcgcgttgaagaagtacaaaatgtcattaatgctatgcagaaaatcttagagtgtcccatctggtaagtcagcacaagagtgtattaatttgggattcctatgattatctcctatgcaaatgaacagaattgaccttacatactagggaagaaaagacatgtctagtaagattaggctattgtaattgctgattttcttaactgaagaactttaaaaatatagaaaatgattccttgttctccatccactctgcctctcccactcctctccttttcaacacaaatcctgtggtccgggaaagacagggactctgtcttgattggttctgcactggggcaggaatctagtttagattaactggcattttggcttttcttccagctctaaaacaagctccatcacttgaaatggcaaaataaaatcatggatgaggccgagggcggtggcttatgcctgtaatcccagcactttgggaggccaaggtggtaggatcacgaggtcaggagatcgagaccatcctggccaacatggtgaaaccccctctccactaaaaatacaaaaattagctgggcgtagtggcatgtgcctgtaatcccagctactcaggaggctgaggcaggagaatcacttgaaccaggaggcagatgttgctgtgagccaatatggcaccactgaactccagcgacagagctaaactccatctcaaaaaaaaaaaaaaaaaaaaaaaaacatggatgatcggtgtcgttgagaggataggtatttggaagaacctttgtttgaaactggctctgtacatacaatgaaattacatacttatttacatacaatgaaatgcagaggttttttttttatataggatctctgtcgagaggctggagtgcagtggtgctatcacagctcactgcagcctcaacctcgtcaggctcaagcaatcctcccacctcagcctccagagtagcagggacgataggtgtgcaccaccatgcccagctaatttttgtatttttttttctttttttgagatggagtcttgctctgttgcccaggctggagtgcagtggcgcgatctcagctcactgcaaactctgcctcccgggttcatgccattcttctgcctgagcctcctgaatagctgggactacaagcacccactaccacgcccggctaattttttgtatttttttttcttttttagtagaggcgggatttcaccgtgttagccaggatagtcttgatctcctgaccttgtgatccacccgcctgggcctcccaaagtgctaggattacaggcataagccactgcgtccagccattcttgtatttttctgttgtagagatagggttttgctatgttggccatgctggtctcaaactcctgacctcaagtgatctaccctcccttggcctctcaaggtgctgggattacaggcctgagccattgcacccagccatggtctaaaaatcttgattgaaataccaccttttcatttccagacacccctatttaaaattaccacacccccagcacacactttatcttctattcctgctgcttctccataacactgattactagctgacattctatgtaatgtatccattttttatctctagtcccacagaatgtaaactccaggatgggatttttgttttgtttacatacatctgtatgttcagtagttagaacggtacttgggacctagttgccactcaataaacatttgtcaaataaataataaactaaactaaattagttctttaatttttttaaatatggtgatggttagtagtgagtaacattcaaaaaataagttgaaaagttgtaccattgcctcttacccacaataaaaaagggtaaattcttttctgctttatgaaagttgtttttcatatttgaagtcaagttaatcagattaaggaaaatgtatgttgtgttttcagagcgatacaagatttataaataaccatcctctcccttgcccttcaacattatagctaaacaaaaataagaggaaaacaggattcacaatttatcaatttattgaaaatcagagccagagaagcaggaaatgacattgtaggaaaaaactgcttttgaaaaagcacaaaacttactcatgacaatcagtgatcaggaaaatcctcaatagtgtggcatttggatacatttatgtttcatttccatgggagagagtcataaaaataggatgttctttctcattctggcaaattaaaccatcaattaaaaactcagatacataaaaattaaagatgtaagaatgaaaatgctaaattgttattttcaatcaactattatgttttctagcttttcattgcttttttctgtttcctgttaagattaatttctttttttttttttttttttttttttgagacagactttggctcttgttgcccaggctggagtgcagtggcacaatctcggctcactacaacctccacctcccgggttcaagcaattctgctgcctcagcctccggagtacctgggattgcaggcatgtgccatcacaccagctaattttgtatttttagtagagacagggtttctccatattggtcaggttggtctcgaactcctgacctcaggtgatcctcctgccttggcctccgaaagtgctgggattacaggcgtgagccaccgctcccagactttttgttttgttttgttttgtttttttgagacacggtctcgctctgctgcctaggctggagtgcagtggcacgatcttggctcactgccagctccgcctcccgggttcaggccattctcctgcctcagcctcccgagtagctgggactacaggcgcccaccactatgcccggctaattttttgtatttttagtagagacggggtttcaccatgttagccaagatggtctcgatctcctgaccttgtgatccacccgcctcagccttccaaagtgctgggattacagtcctgagccactgcgcccggcctggacctttttttttcggggtggggggttggagtctggctctgtcgcccaggctggagtgcagtggcgccatcttggctcactgcaacctccgcctgccaggttcaagttcaagcgcttctcctgcctcagcctcctgagtagctgggattataggcgcacgccaccgtggccggctaattttgtatttttagtagagatagggtttcatcacgttggtcaggctggtcttgaagtcctgatctcgtgatccacccgcctcggccttccaaagtgctggcgtgagccactgcgcctggcttaagattaatttttgtttgttttgtttttgagacggagtctcgctctttcacccaggccggagtgcagtggcgccatctcggctcactgcaagctccgcctcccgggttcacgccattctcctgcctcggccccccaagtagctgggactacaggcgtccaccaccacgcccggctaattttttgtatttttagtagagacggggtttcaccgtgttagccaggatggtctccacttcctgacctcgtgatccgcccacctcggcctcccaaagtgctgggattacaggcgtgagccaccgcgcccggccttaagattaatttttatggtgttttacattcatttgtatggaaagttctaggatagggatcatatttcacttccttttaatatagtacagtatagcacaatttgcagttatgtcttaatatgtgatcaggaatgatcatgactggaaacagtgttatttgtggtagctatagggtaggtaaggttttcagcctgttttaggtttcttgaactaaaattccttctgctgtcttctaagtcaatattggcagctatttctgacaattggtagttctttgtaactttttacctatgactataacatttttgactttcagaagaatttgctaaaatgtgttccccggtgggttgttgtttttcaacctaaacctagctgctttttccagtcacttatccgtattggaagctcaaaatgcaaatatacagtaggcctaaaatattgcctggtttgaaaagtgtttaaaatatttgaatcatttttatagtaaacatttactctcatcaggacctagaaggggaacattttaattttttttcttttcccttttcacagtcttccttcaacattcattacctttttacatatcggagttttcatctgttcaaagtttgtgtttacagtgtgtttatatagtttagattataattaccatactgaaatataattgtttcagaattgagtcagtggtgagaatgaaagccatctggtatgataactgaatccaatttttcttttacggagaatttctttgaaatgtagcttatctcagaaatagggatttagtaaccaatcagagttttctttgtcaaggttgtttttctttttaaagtcacatttggtcccagtaataataccaatgttggtacaagttatctcaggttgtgaagcatttttcccaagtcatctcaggttgtgaagcattttcccaagtagcatttaattttattcttgcaatagcccaaggagtctggcagggtgaatggcaagagaaggaaacaggttcaggtagagtggttagcccaaggtggctctgcttatatacacaactggtagtagaaacccagcctcctgacttagttcattgtttttcttttcactgccctgtgctatgtcaaaaaccccatgattacaagagttgtattacaacccttcacaataaggttactgtccacaagcttttcttgtgatccttttcttttttttttttctttttttgagatggattctctgtcacccaggctggcccgccttggcctcccaaaatgctgggattacagcgtgagccaccgcacctggcccttgtgatccttttctaaaaagttaaatatttaaggaaaaaaccacattcttgtcacactgccaggttagtcgttctttgatatcttgcctggactttatccaaaaaatccgtttcaaaaattcacatttagagctaagtgtagtggctcacgcctgtaatcccggtcgaggcagatggatcacttgaggtcaggacttcaagaccagcctgggcaatatggtgaaaccccttccctaccaaaaatacaaaaaaattagccgggtgtggcagcacgcgcctgtagtcccagctacttggaatgctgaggcacaagaatcacttcaatccgagaggcagaggttgcagtgagccaagaccacaccactgcactccagcctgagcagcagagtgagtgagactccatctccaaaaaaaaaaaaaaaggttcacattcagaagaaagctaaaggccgggtatagtagctcacacctgtaatcccagcactttgggaagccgaagcaggaagattgcttgatgccaggcattcaagaccagcatgggcatcatagtgagatcctgtctctacaaaaattaattaacattaaaaattaaaaagatggctggcatggtggctcactcctgtaatcccagtactttgggaggccaaggcatggtggtgcatgcctttagtcccagctactcgggaggctgaggcaggagaatcacttgaattcaggaggcggaggttacagagagccgagatggtgccactgcactccagcctgggcgacagaacgagactctgtctgaaaaaaaaaaagaaaattaaaaagaccagaataaagctaaagatttaaaatagcctataggttcctaccagaagttaccagctacctctctgatagtctttccctacaatatcctcctggattattacattttagcaccttgacctatctgatgtcctgcatacacaggcatggtcctgctcagggtttgccttctctgctccctctttcttggaatgctcttcccctaattgttgcatagtgtgtttctttacattattaagctatcctctagtctcacctcagtgaaacctttcctgactccccccatgtacatctcacccccacatagatattgaactacctgtttccccttaccctgcttaatttttctctttaatgcacttattcccatgtattctttaattccgtatcaactgtctaccacactagaatatgagctctatgagagcaggctttattttgtaaactgctacatttctatctcctagaatagtacttgaatatagtagtagatacttaataaacacttgttatattagtataataaatgaactaatctcaggaatgccttggttttgtggatagacaggtagggatgggaacttgggtgatgtattttctgaagtttttatttttaagcttattattattttgagatggagtccagctctgtcgcccaggttggagtacagtggcgcgatcttggctcactgcaacgtgcacttccccggttcaagcgattctcctgccttagcctcccaagtagctgggattacaggcgcatgccaccatgcccagttagttttggtatttttagtagagacagcgtttcactgtgttggccaggctggtctcgaaatcctgacctcatgatccgcccgcctcggcctcccaagtgctgggattacaagcatgagcccccgtgtctggccttattttcttttttttgagacagagtcttcctctgtcacctaggctggagtgcagtggcacgatattggctcactctgcaacctccacctccaggattcaagtgatccttctaccttagtctccaaagtagctgagaccacaggcatgcgccaccacgcccggctaatttttgtatttttagcgtagacagggtttcaccatattgtccaggatgatctggaactcctgagctcaggtgatccacccacctcagcctcccaaagtgctaggattacaggcatgaggcaccatgcccggccttaagcttatcattttctaaatttcctttagtgagtacttattacactgtttttacaaagtaatcacaaaccaaacatcatgcctcttctgaagtgatctaataagagtacacagtaccatctgtaaagtgttcttgccagaaagttgaacctgaatgattaagcctgtaagtctagtttataggaaataaggctagaggaacaagttaaacctcaccatagggttatacaatcagcaaaatccagaatgggggaaactccacaggtcaaatgacctaattttaaaaataaatgacaagggagaaaaagtaagagacacctatagatcagaagacacttggggctgggcatggtggctcacacctgtaatcccagcactttgggaggccaaggcaggcggatcacctgaggtcaggagttcaagaccagccggccaacatggtgaaaccccaactctactaaaaatacgaaaaatcagccgggcgtggtggcgcacgcctgtagttccaactacctgggaggctgaggcaggagaatcacttgaacttgggaggcagaggttgcagtgagccgagatcgcaccattgcatgccagtctgggctacaaaagcaaaaccccatctcaaaaaaaagaagacacttgggtttgggtgtgttggctcatgcctgtaaaccccgtgctgggaggattgcttgagcccaggagttcaaggctgcagtgaggtatgtttgcaccactgcactccagcctaggtgacagagtgtgaccttatcttaaaagtaataataattaaaataatctggggtaggggtggatatgggtgaaacagcttggccatgagttgatggttgttggaccagggtgatggtccatatagttcattttattattttatttacttgaaattttgaaatacttgaaattttccatattaagttaaaaaggcatttacagtaaacaaaaaaaagttctaggaaggaattcaaaagaaatataagcagaaaattttgtctttatggagcttaaagatgagatgtgcacccacagtgatagtgcagaaaaatatatcactggaaatgaattcgtacgaactattatcaactaatcttttaaatgctgatgatagtatagagtattgaagggatcaatataattctgttttgatatctgaaagctcactgaaggtaaggatcgtattctctgctgtattctcagttcctgacacagcagacatttaataaatattgaacgaacttgaggccttatgttgactcagtcataacagctcaaagttgaacttattcactaagaatagctttatttttaaataaattattgagcctcatttattttctttttctccccccctaccctgctagtctggagttgatcaaggaacctgtctccacaaagtgtgaccacatattttgcaagtaagtttgaatgtgttatgtggctccattattagcttttgtttttgtccttcataacccaggaaacacctaactttatagaagctttactttcttcaattaagtgagaacgaaaaatccaactccatttcattctttctcagagagtatatagttatcaaaagttggttgtaatcatagttcctggtaaagttttgacatatattatctttttttttttttttgagacaaagtctcgctctgtcgcccaggctggagtgcagtggcatgatcttggctcactgcaacctccgccccccgagttcaagcgattcttctacctcagcctcccaggtagctgggactacaggcacccgccaccatgcttggctaatttttgtacttttagtagagataaggtttcaccatattggccaggctggtctcgaactcctgaccttgtgatccacctgcctcggcctcccaaagttctgggattacaggcgtgagccaccacacccgactgacatatattatctattaggatgtaacatcattttgaacagtgttttgtattttttgtgtccatcagtgaaagcaaactgcaagcagttttgaaataagcacattgtgtttgagccttcccagtttctcctttctgttcatttctgcatatccttatgcattcccccttctaagggtcagtgtttgcccgctttgtaatcattgtgaagacaggaaaggacctgataccagtttctatttaggccaaaattcatttatagcagtgattcaagttatatttacgtatttgatgatcttgtcttttgaaatgaaaatgtttgtttcttaataaaagaatttcagaaaaagtagagtaggtaatttagtagaacaagtgggctttctccttttctttatgttaagctatggctcacatcttaccttaaatgtcaactaatttgtttttaagtatttatgtacctggtacataacctggtaccaggtacaaactatgtacttggtaaaaagtttattagcacaaaaaggtatatgatgcaaagtatacttccctcttaccctacaacccctgcctccctgttccctccccagacaaccacaatgatcaatttcttatgtatcctttgaggaatttttaaattccagagttcttaacttggggtttatgaatagtctttatgaatttcctagaattatatttaaattgtattcaaaactatggccatgtacatttttctgggaagatagtccataattttcatctgagtgagctaagatcatgccactgcattccagcctgggcgacaagagggagactcaaaaaaaaaaaaaaaagtcccagtatttactacagagagctaaagattaacctttaaagccctggggctttcaatttatctggatgagaatctttctggaatgaactgtatgttttcttgtcagcttgagtaacaaatgctgaacatactatactattattacagggactcaagggcccagtgtggtagctcctgcccataaccccagcactttgggaggccaaggcaggaagatcacttaaggccaggagttcgaagctgtagtgagctatgatcacaccactgcactccagcctagatgacagagtgagaccctgtctttttttttttttgagatggtgtttcactctattgcccaggctggagtgcagtggtgtgatctcggctcactgcaacctccacctcctgggttcaagcgattctcctgcctcagcctcttgagtagctgggattacaggcatctgccaccacacccagctaatttttgtatttttagtcgagacagggttttcaccatgttggccaggctgctctcaaactcctgacttcagctaccttggccttaaaaagtgttgggattacaggtgtaagccaccgcgcctggctgaccctgtctcttaacaaaaaaagagagattaagttatgaatatagttgctttgagaacttgtggaagaaggaaattataggcttataggcagagataataatacgagcaaatgtacaaataaaagaaaatagaggacgggcgcggtggctcacgcctataataccagcactttgggaggtcgaggtgggcggatcacgaggtcaggaaattaagaccatcctggccaaaatggcgaaacactgtctctactaaaacacacaaaaaactagcctggcatggtggcacgtacctgtagtcccagctacttggtaggctgcggcaggggtatcacttgaacctgggaggcagaggttgccctgagccgagatcatgccaatgcactccagcctgacaacagagtgagactctgtctgaaaaaaaagaaaagaaaagaaaatacatccaggaaaaataagctaactttgcatatgtgtataggagttgtgttagaaaaggaagaagccctcaaagatgggaagccatttgcaagaaagagaaggtccaagaggaggcagaagggattggaaatagaaaaaggatgtaagaaagagttgattattactcataaacagtaatgaaggaaaaggagagtaattctacaggaagatgctgaggtgctttgagcccagtgaagttggaggtaaagacagctgttgaggccgggcacggtggctcacgcctctaatcctagcacttttggagcccaaggcaggtggatcacctgaggtcaggagctcaagaccagcctgaccaacatagagaaaccccatctctactaaaaatacaaaattagacgggcgtggaggcgcatgcctgtaatcccagttacttgggaggctgaggcaggagaatcacttgaacctgggaggcggaggttgcagtgagccgagattgcgccattgcactccagcctgggcgacaagagtgaaaactgtctcaaaaaaaaaaaacaacaaaaaacagctgttgagattgagaggattagagttggcaactggagaagagtgagaagcttggtttcaagcttgtgatagtcaggattgtgatagtcaggaaagaaccagtcataaagatatatgtgtgtgtatacatataaatatgttatatatatgtgtgtgtgtgacacatatatatttttgtttgtttctttgagacagtgtctccctctgacacccaggctggagttcagtggtgtgatcatagttcacttttaccttgcaatctgggttcaagcaatctctcatctcagcccctcaagtagctaggactacaggtacatggcatttgcccagctaatttttaagtttcttgtagagatgggccagccatattttaaattgtgttttgaatgttatattagaattaaaagtccaaagccgggtgtggtggctcacgcctgtaatcccagcactttgggaggctgaggtgggcggatcacgaggtcaggagttcgagaccagcctggccaatatggtaacaccatctctactaaaaatacaaaaattagctgggtatgggggcacatgcctgtagtcccagctactcaggaggctgaggcagaggaacctcttgaacccaggaggcagaggctgcagtgagttgagatcgtgccactgtactctagcctgggcgacagagcaagattccgtctcaaaaaaaaaaaaagtccagtataatgcccatgtgatagatcgactttttcatgaaatctcttctgtaatatcaatataatctgaataacactttgatctatatgatgagaaagctgggagcctgggagcgatacccccatgcttttgttgtattaattgtattttctacggataaactctaattgctaaaaataaaacaactttattgacccaagcaagcctaaagttctgaaatcttttttttatttttgtttgtttgtttgtttgtttttgtttgttttgttttgagacggagtctcgctctgtcgcccaggctggagtgcggtggtgcagtctcggctcactgcaagctccacctcccgggttcacaccattctcctgcctcagcctcccaagtagctgggactacagacgcctgccaccacgcccagctaatttttttgtatttttagtagagaaagggtttcaccgtgttagccaggatggtctcgatctcctgacctcgtgatctgcccgccttggcctccctaagttctgggattacaagtgtgagccaccacgcccggctgtttttttttgttttgttttgagacggagtctcactgtgttgcccagactggagtgcagtggcatgatctcagctcactgccacctccatctcctgggttcaagcaaatctcctgcctcagcctcccgagtagctgggactacaggcatgtgccaccacacctggctaatttttgtatttttagtagagacggggtttcactatgttggccaggctggtccaaaactcctgacctcaggtgatctgctcgccttggcctcccacagtgccaggattacaggcatgagccaccttgcccagccagttctgaaatcttttatgaagcctataaaaaaagataataataccaatctagaaaatatttcttaaggcagtcatgcattagtttgaactttccaaacaaaaaaatgcaatgtgtaatacttttttttttttttttgagatggagtcttgttctgttgcccaggctggagtgcagtggtacaatctcggctcactgcagcctctgcctctctggttcaagtgattctcctgcctcagcctcccaagtagctgggattacaggcgtgcaccaccatgcatggctaatttttgtatttttagtagagacagggtttcaccatgttgacaaggctgatctcgaactcctgacctcaggtgatccgcccacctcagcctcccaaagtgctgagattacaggcattagccaccacgcccagccttttattttagtagagaccatgtttcaccatgttgaccaagctggtcttgagctgacctcaagtgatccgcccacctccacctcccaaaatggtgggattataggcatgagccaccgcacccagcctgtaatacttttttgaagatctagaaccacattgttcaaagagatagaatgtgagcaataaatgtaacttaaatttttcaacagctactttttttttttttttttgagacagggtcttactctgttgtcccagctggagtacagtggtgcgatcatgaggcttactgttgccttgacctcctaggctcaagcgatcctatcacctcagtctcccaagtagctgggactgtaagtgcacaccaccatatccagctaaattttgtgttttctgtagagacggggtttcgccatgtttcccaggctggtcttgaactttgggcttaacccgtctgcccacctaggcatcccaaagtgctaggattacaggtgtgagtcatcatgcctggccagtattttagttagctctgtcttttcaagtcatatacaagttcattttcttttaagtttagttaacaacctttatacatgtattctttttctagcataaagaaagattcgaggccgggtgcggtggctcacgcctgtaatcccagcactttgggaggctgagatgggcacatcacgaggtcaggagatcgagaccatcctggctaacatggtgaaaccccgcctctactaaaattacaaaaagttagccaggcgtggtagcgggcacctgtagtcccagctactcaggaggctgaggcaggagaatggcgtgaacccaggaggcagagcttgcagtgagcagagattgtgccactgcactccagcctgagagacagagcgagactccgtctaaaaaaaaaaaaaaagattcgaatccttatcttggttgatttttgcgtatctagttccactgaattatttatataattgtatagactacagcacgagacagcttagcttgtcactctactgtactatattctgcagtactatcataagggaatttcctccctacccctgctctgaattgttcaattgtactatttgctggagtaatgcttgatgccttcttgatccattatactagagtatatgtagtatttgtagattctgaaggagtgggagcctctattctgagttttaaaggtacttatgtacagtggaggtagctttttgacagcctcatcttccaaactatagagtcattgttttgttgagtgcaatatggtacttgaagcatctatatcggcgaagaaggacccaagtctccttgaccttacctacctacattcactttctctggtaggaagattgtgggtgcctctctccagacttagtttccatgtcaaaaaagaaaaaaggaagattgtgggctttgctacaatccaattctggatccaatataaccttcattgcttaattactgtgtgatctgggacaagcctctactctataaaaatgaagataaggccaggcttgatggctcatgcctgtaatcccagcacgttgggatgccaaggcaggaggatcacttgaggtcaggagttcgagaccagactgggcaatatagtgaaaccacatctgtacaaaaataaagatagaaagtagcccagcgcaatggctcacacctgtaatcccagcactttgggaggctgaagcaggcgatcacttgaggtcgggagttcaagactgtagacagatagataggtaggtagatagatagagatatagatatagttggggtttttttgttttgttttgttttgtttttgagatggagtttcgctcttgttgcccaggctggagtgcaatggcgcgatctcagtttactgcaacctccgcctcccgggttcaagagattctcctgcctcagcctcctgagtagccaggattacaggcatatgccaccatgcccggctaatttttgtatttttagtagagacagggtttctccgtgttggtcaggctggtcttgaactcctgacctctcccaaagtgttgggattacaggcgtgagccaccgctcctggccttttttttttttttttttttttttttgagacagagtcttcctctgttgcccagggtggagtgcagtggcactcttctcagctcattgcaacctctgccatcctgggttccagtgattctcatgcctcagcctcccaagtagctgggactcaggcgtgtgcccaccacgcctggctaattttgttgtatttttagtagagacagggtttcaccatgttagccaggctggtctcaaactccaggcctcaagtgatctgcctgcctcagcctcctgggattgcagacatgagccactgcacccggccaagagagggtaataaatgttaaattacctggctagtaaaaaatattctctaagtgtcttttctcacaattcccaatgccttttttttttttttggcacaatctcactctgttgcccaggctggaatgcaatggtgcaatattggctcactgtaacccccgcctcacaggttcaacttattctcatgcctcagcctcccgagtaactgggactacagtgcaccaccaccacacccagctaatttttgaatatttagtagagacagggtttcaccatgttggccaggctggtcttgaactcctggcctcaagtgattcacccaccccgcaagtgctgggattacaggtgtggaccaccgtgcacagccctagtgactttttttttagccccttaatcttttctttcctgggtctcttcattgtcagtgtctgctatttactccctacctagtcacccccttcaccagtatattatgtcctttatgttttattttgcaggatcttattttgcttttctattgaatcccctccatctagaatagtactagacatagtaaatattggttgtatgagtgaatcgctgcttttaattatcatcaccattgctctctctacttctggtctatgatccactttgagttaacttttgttatttggtgtgagataggagtataatttcattcttttacatgtggttatacttttgtctcaacactgtttgttaaaaacacaaaaagtattattttcccatttaatcatctttggcctgggcacggtggctcatgcctgtaatcccagcactctggaaggccaaggcagatggatcaatttgaggccaggagttcaagactagccaacatggtgaaactaaaaatacaaaaaattagctgggtatggtggtgcatgtctgtaatcccagctactcgggaggctgaggcacgagaattgcttgagcctaggaggtggaggttgtagtgagctgagattgtgtcactaccctccagcctgggtgatagagtgagtctgtctcaaaaaaaaaaaaaaaaaattaagaaaataaaaatcgtcggccaggcatggtggctcacacctgtaatcccagcactttgggaggcagaggcgggcagatcacgaggtcaggagatggagaccatcctggctaacatggtgaaaccccgtctctactaaaaataaaaaaattagccgggcatggtgctgggcgcctgtagtcccagctgctcgggaggctgaggcaggagaatggcgtgaacccaggaggtggagcttgcagtgagccgagatcgtgccactgcactccagcctgggagacagagcgagactccgtctcaaaaaaaaaaaaaaaaaaaattgtcttggtatttattattgttgaaaatcgcttgatcacagatgtatgtatgagtttatttctgtactgtcaattccattttattgatgtatgtgtctattcttatgctattaccacactttcttgattactatagctttgtggtgaggtgttgagattttaaactaattataagcatcttacatgaactacttaccgtttatatttgattatgcagcatgaaataattatgaatatatcattaaatatgccatattaacttttattaagttttatgtgatcataacagtaagccatatgcatgtaagttcagttttcatagatcattgcttatgtagtttaggtttttgcttatgcagcatccaaaaacaattaggaaactattgcttgtaattcacctgccattactttttaaatggctcttaagggcagttgtgagattatcttttcatggctatttgccttttgagtattctttctacaaaaggaagtaaattaaattgttctttctttctttataatttatagattttgcatgctgaaacttctcaaccagaagaaagggccttcacagtgtcctttatgtaagaatgatataaccaaaaggtatataatttggtaatgatgctaggttggaagcaaccacagtaggaaaaagtagaaattatttaataacatagcgttcctataaaaccattcatcagaaaaatttataaaagagtttttagcacacagtaaattatttccaaagttattttcctgaaagttttatgggacatctgccttatacaggtattagaaacttactgcctttctctaatgcttctagtgtaaaaacttgcagacttatgtaaagtagggctgtatcgccgtgcccccattgtctgttaatcttgtttttatatttttgattgtgtttccttttctttttttttttttttttaagacagggtcctgctctgtcactgaggctggagtgcagtggcgtgatctcggctcactgtagcctctgtctcccagcctcttcctgccttagcctcccaaatagctgggactacaggcacacgctaccatgcccggccaatttttgtattttttgtagagatgaggttttaccatgttgcccaggctggtaactcctgagctcaggtgatctgcccacctcggcctcccaaagtgctggggttcacaggtgtgtgtttatttctatctaattatttacacaaacacaatgtatttatatattgtgtatctcttctgctacaatgtaaattctatgagagtagtaattttgtctgtctcaacactgtttttcctaagtttggtacatagtaggcactcagatgcttaaaggaatgaatgaattgtgctttaattccactttactaaacccaaatctccctttggacattgttatctatgtgttttcaaagaagtataatcataatttgacagaaatccttgagaggcagaactaagtgagggattgggcagggttcagatgttaagaacagtaagctcagcagggtgtgattgctcatgcctataaccctagcactctaggaggctgaggtgggatgattgcttgaggccaggagtttgaaatcagcctgggcaacatagtgagaccccatcactaccaacaaaataaataaataaatgtacatggtggcatatgcccatagtcctagctacttgggaggctatagtgggaggatagcttgagtacagaagtctgaggctgcagtgagctatgattgtggcactgcatgctagcctgggcaatagagcaagaccctgtctctaaattaaacaaaaaaaaaagtactctagttttctatgcaatgcattatatctgctgtggatttagggcagtattatatcagataattttaggcatttggtaggcttaaatgaatgacaaaaagttactaaatcactgccatcacacggtttatacagatgtcaatgatgtattgattatagaggttttctactgttgctgcatcttatttttatttgtttacatgtcttttcttattttagtgtccttaaaaggttgataatcacttgctgagtgtgtttctcaaacaatttaatttcaggagcctacaagaaagtacgagatttagtcaacttgttgaagagctattgaaaatcatttgtgcttttcagcttgacacaggtttggagtgtaagtgttgaatatcccaagaatgacactcaagtgctgtccatgaaaactcaggaagtttgcacaattactttctatgacgtggtgataagaccttttagtctaggttaattttagttctgtatctgtaatctatttttaaaaaattactcccactggtctcacaccttattttatcaatcgtaaggtgcacatttttcacatcttaacatctctgaaattgggaacattttactattgagggtgtgtcatttgtttaatttgtgtgctttctttcttagtgatacagaaaataatagtgcaacttacattgttggtgtcttagctttagtgaaatacagtattgataggcaaatttcttagtgttaaggtagaaaacaaggactctaaataactttgatggtctgtgtatttgtttttgtttcctaggagtaaaatttccagttgattttttaaaatttgatttttaaaaaaaatcacaggtaaccttaatgcattgtcttaacacaacaaagagcatacatagggtttctcttggtttctttgattataattcatacatttttctctaactgcaaacataatgttttcccttgtattttacagatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttggtaaaaccatttgttttcttcttcttcttcttcttcttttcttttttttttcttttttttttttgagatggagtcttgctctgtggcccaggctagaagcagtcctcctgccttagcccccttagtagctgggattacaggcacgcgccaccatgccaggctaatttttgtatttttagtagagacggggtttcatcatgttggccaggctggtctcgaactcctaacctcaggtgatccacccacctcggctccccaaattgctgggattacaggtgtgagccactgtgcccggccggtaaaaccattttcatttattctggcaacatctctttattgagcattgtgaatatgttagtgaatgtgctagatgctcatagatttatataaaaagttagtgaagaaggaaagatggtatattaagtggttagacaagtgttctaatcagttagagttcagagaaggtcagggtacctgatataatcaagagagagaccttacagccaggtgaggtgaatgtacctataatcccagctacttaggaggctgaaatgggaggatcacttgagtccaggtttgagaccagcccaggcaacatagcaagatccccatcagatacaccaaaaagacagatttcttttttttttttttttttgagacagagtctcgctctgtcgcccaggctggagcgcagtgacacgatgtcagctcactgcaacctccgcctcccaggttcaagtgattctcctgcctcagcctcctgagtagttgggactacaggggtacgacaccagacctggctaatttttgtaattttagtagagtcggggtttcaccatattggtcaggctggtctcgaactcctgacctcaggtgatccaccctccttggcctcccagagtgctgggattacaggcgtgagccaccaagcccggccaaaaaagagagctcttataggcccttccttgctttggagctttatctgctctgtgatgcttatctaaaatagccataaggtcactgatatttttaagcatttggaaattacttcagctgggtgccatggctcatgcctataatcccaaccctttgggaggctgaggtaggaggtcctttgagcccagcttgggcaacacagtgagacactgtctctgcaattaaaaaaaaaaaaaagtagctgggtgccgtggctcacgcctgtaattccagcactaggaggcttgaggattgcctgagctcaggagttcaagaccagtttgggcaacatagcaagtccttgtctatattaaaagtttttttaaattatctgggcatggtggtgtgtgcctgtagtcccagctacttgggaagctgagacagaaggatcacttgagtccaggagatgtagactacagtgagctatgatcactccactgcacttcagcgtgggcggcaaagcaagatctagttgcaaaaaaaaaaagaactggctgggtgcggcggctaacacctgcaatcccagcaccttgggaggctgaggccagtggatcatgaggtcaggagattgagaccaccctggccaacatggtgaaacccggtctctactaaaaatacaaaaattagctgggtgtggtggcacgtgcctgtaatcccagctactccagaggctgaggatggagaatcacttgaacctgagagtcggaggttgcagtgagccgagattgcgccactgcactccagcctggcgacagagcgagactccgtctcaaaaaaaaaaaaaaaaaagcttcacgcctgtaatcccagcactttgggaggccgagtcaagtggatcacgaggtgtggagatcaagactatcctggctcacatggtgaaagcccgtctctactaaaaacacagaaaaattagctgagcgtgatggcggactcctgtagtcccagctactcgggaggctgaggcaggagaatagcatgaacccgggaggtggagcttgcagtgagccgagatcccgccactgcgatccagcctgggcgacagagtgagactctgtctcaaaaaaaaaacaaaaaaacttagctgggcgtggtggtatgcacctgtggtcctagctacttgggaggctgaggctggagcattgctttaacatagagagtcaaggctgcagttgagctatgactgtgccactggactccagcgcaggtgactgagaccctatcttttaaaaaaagggaaaattacttgaacttaaaaggtgtaattgttaaagaaaatgtagtgatttgctctgttgttacttatatgtgcatgaatgatggagatcttaaaaagtaatcattctggggctgggcgtagtagcttgcacctgtaatcccagcacttcgggaggctgaggcaggcagataatttgaggtcaggagtttgagaccagcctggccaacatggtgaaacccatctctactaaaaatacaaaaattagctgggtgtggtggcacgtacctgtaatcccagctactcgggaggcggaggcacaagaattgcttgaacctaggacgcggaggttgcagcgagccaagatcgcgccactgcactccagcctgggccgtagagtgagactctgtctcaaaaaagaaaaaaaagtaattgttctagctgggcgcagtggctcttgcctgtaatcccagcactttgggaggccaaggcgggtggatctcgagtcctagagttcaagaccagcctaggcaatgtggtgaaaccccatcgctacaaaaaatacaaaaattagccaggcatggtggcgtgcgcatgtagtcccagctccttgggaggctgaggtgggaggatcacttgaacccaggagacagaggttgcagtgaaccgagatcacgccaccacgctccagcctgggcaacagaacaagactctgtctaaaaaaatacaaataaaataaaagtagttctcacagtaccagcattcatttttcaaaagatatagagctaaaaaggaaggaaaaaaaaagtaatgttgggcttttaaatactcgttcctatactaaatgttcttaggagtgctggggttttattgtcatcatttatcctttttaaaaatgttattggccaggcacggtggctcatggctgtaatcccagcactttgggaggccgaggcaggcagatcacctgaggtcaggagtgtgagaccagcctggccaacatggcgaaacctgtctctactaaaaatacaaaaattaactaggcgtggtggtgtacgcctgtagtcccagctactcgggaggctgaggcaggagaatcaactgaaccagggaggtggaggttgcagtgtgccgagatcacgccactgcactctagcctggcaacagagcaagattctgtctcaaaaaaaaaaaacatatatacacatatatcccaaagtgctgggattacatatatatatatatatatatatattatatatatatatatatatatgttatatatatgttatatatatataacatatatatatgttatatatatgttatatatatataatatatatatgttatatatatgttatatatatatatacacacacacacacatatatatgtatatatatatacacacacacacacaaattagccaggcatagttgcacacgcttgtagacccagctactcaggaggctgaggcaggagaatctcttgaacttaggaggcggaggttgcagtgagctgagattgcgccactgcactccagcctgggtgacagagcaggactctgtacaccccccaaaacaaaaaaaaaagttatcagatgtgattggaatgtatatcaagtatcagcttcaaaatatgctatattaatacttcaaaaattacacaaataatacataatcaggtttgaaaaatttaagacaacagaaaaaaaaattcaaatcacacatatcccacacattttattattactactactattattttgtagagactgggtctcactctgttgcttatgctggtcttgaactcctggcctcaagcagtcctgctccagcctcccaaagtgctgggattataggcatgagctaccgctcccagccccagacattttagtgtgtaaattcctgggcattttttccaggcatcatacatgttagctgactgatgatggtcaatttattttgtccatggtgtcaagtttctcttcaggaggaaaagcacagaactggccaacaattgcttgactgttctttaccatactgtttagcaggaaaccagtctcagtgtccaactctctaaccttggaactgtgagaactctgaggacaaagcagcggatacaacctcaaaagacgtctgtctacattgaattgggtaagggtctcaggttttttaagtatttaataataattgctggattccttatcttatagttttgccaaaaatcttggtcataatttgtatttgtggtaggcagctttgggaagtgaattttatgagccctatggtgagttataaaaaatgtaaaagacgcagttcccaccttgaagaatcttactttaaaaagggagcaaaagaggccaggcatggtggctcacacctgtaatcccagcactttgggaggccaaagtgggtggatcacctgaggtcgggagttcgagaccagcctagccaacatggagaaactctgtctgtaccaaaaaataaaaaattagccaggtgtggtggcacataactgtaatcccagctactcgggaggctgaggcaggagaatcacttgaacccgggaggtggaggttgcggtgaaccgagatcgcaccattgcactccagcctgggcaaaaatagcgaaactccatctaaaaaaaaaaaagagagcaaaagaaagaatatctggttttaaatatgtgtaaatatgttttggaaagatggagagtagcaataagaaaaaacatgatggattgctacagtatttagttccaagataaattgtactagatgaggaagccttttaagaagagctgaattgccaggcgcagtggctcacgcctgtaatcccagcactttgggaggccgaggtgggcggatcacctgaggtcgggagttcaagaccagcctgaccaacatggagaaaccccatctctactaaaaaaaaaaaaaaaaaaattagccggggtggtggcttatgcctgtaatcccagctactcaggaggctgaggcaggagaatcgcttgaacccaggaagcagaggttgcagtgagccaagatcgcaccattgcactccagcctaggcaacaagagtgaaactccatctcaaaaaaaaaaaaaaagagctgaatcttggctgggcaggatggctcgtgcctgtaatcctaacgctttggaagaccgaggcagaaggattggttgagtccacgagtttaagaccagcctggccaacataggggaaccctgtctctatttttaaaataataatacatttttggccggtgcggtggctcatgcctgtaatcccaatactttgggaggctgaggcaggtagatcacctgaggtcagagttcgagaccagcctggataacctggtgaaacccctctttactaaaaatacaaaaaaaaaaaaaaattagctgggtgtggtagcacatgcttgtaatcccagctacttgggaggctgaggcaggagaatcgcttgaaccagggaggcggaggttacaatgagccaacactacaccactgcactccagcctgggcaatagagtgagactgcatctcaaaaaaataataatttttaaaaataataaatttttttaagcttataaaaagaaaagttgaggccagcatagtagctcacatctgtaatctcagcagtggcagaggattgcttgaagccaggagtttgagaccagcctgggcaacatagcaagacctcatctctacaaaaaaatttcttttttaaattagctgggtgtggtggtgtgcatctgtagtcccagctactcaggaggcagaggtgagtggatacattgaacccaggagtttgaggctgtagtgagctatgatcatgccactgcactccaacctgggtgacagagcaagacctccaaaaaaaaaaaaaaaagagctgctgagctcagaattcaaactgggctctcaaattggattttcttttagaatatatttataattaaaaaggatagccatcttttgagctcccaggcaccaccatctatttatcataacacttactgttttccccccttatgatcataaattcctagacaacaggcattgtaaaaatagttatagtagttgatatttaggagcacttaactatattccaggcactattgtgcttttcttgtataactcattagatgcttgtcagacctctgagattgttcctattatacttattttacagatgagaaaattaaggcacagagaagttatgaaatttttccaaggtattaaacctagtaagtggctgagccatgattcaaacctaggaagttagatgtcagagcctgtgctttttttttgtttttgtttttgttttcagtagaaacgggggtctcactttgttggccaggctggtcttgaactcctaacctcaaataatccacccatctcggcctcctcaagtgctgggattacaggtgagagccactgtgcctggcgaagcccatgcctttaaccacttctctgtattacatactagcttaactagcattgtacctgccacagtagatgctcagtaaatatttctagttgaatatctgtttttcaacaagtacatttttttaacccttttaattaagaaaacttttattgatttattttttggggggaaattttttaggatctgattcttctgaagataccgttaataaggcaacttattgcaggtgagtcaaagagaacctttgtctatgaagctggtattttcctatttagttaatattaaggattgatgtttctctctttttaaaaatattttaacttttattttaggttcagggatgtatgtgcagtttgttatataggtaaacacacgacttgggatttggtgtatagatttttttcatcatccgggtactaagcataccccacagttttttgtttgctttctttctgaatttctccctcttcccaccttcctccctcaagtaggctggtgtttctccagactagaatcatggtattggaagaaaccttagagatcatctagtttagttctctcattttatagtggaggaaataccctttttgtttgttggatttagttattagcactgtccaaaggaatttaggataacagtagaactctgcacatgcttgcttctagcagattgttctctaagttcctcatatacagtaatattgacacagcagtaattgtgactgatgaaaatgttcaaggacttcattttcaactctttctttcctctgttccttatttccacatatctctcaagctttgtctgtatgttatataataaactacaagcaaccccaactatgttacctaccttccttaggaattattgcttgacccaggtttttttttttttttttttggagacggggtcttgccctgttgccaggatggagtgtagtggcgccatctcggctcactgcaatctccaactccctggttcaagcgattctcctgtctcaatctcacgagtagctgggactacaggtatacaccaccacgcccggttaattgaccattccatttctttctttctctcttttttttttttttttttgagacagagtcttgctctgttgcccaggctggagtacagaggtgtgatctcacctctccgcaacgtctgcctcccaggttgaagccatactcctgcctcagcctctctagtagctgggactacaggcgcgcgccaccacacccggctaatttttgtatttttagtagagatggggtttcaccatgttggccaggctggtcttgaactcatgacctcaagtggtccacccgcctcagcctcccaaagtgctggaattacaggcttgagccaccgtgcccagcaaccatttcatttcaactagaagtttctaaaggagagagcagctttcactaactaaataagattggtcagctttctgtaatcgaaagagctaaaatgtttgatcttggtcatttgacagttctgcatacatgtaactagtgtttcttattaggactctgtcttttccctatagtgtgggagatcaagaattgttacaaatcacccctcaaggaaccagggatgaaatcagtttggattctgcaaaaaagggtaatggcaaagtttgccaacttaacaggcactgaaaagagagtgggtagatacagtactgtaattagattattctgaagaccatttgggacctttacaacccacaaaatctcttggcagagttagagtatcattctctgtcaaatgtcgtggtatggtctgatagatttaaatggtactagactaatgtacctataataagaccttctgtaactgattgttgccctttcgtttttttttttgtttgtttgtttgtttttttttgagatggggtctcactctgttgcccaggctggagtgcagtgatgcaatcttggctcactgcaacctccacctccaaggctcaagctatcctcccacttcagcctcctgagtagctgggactacaggcgcatgccaccacacccggttaattttttgtggttttatagagatggggtttcaccatgttaccgaggctggtctcaaactcctggactcaagcagtctgcccacttcagcctcccaaagtgctgcagttacaggcttgagccactgtgcctggcctgccctttacttttaattggtgtatttgtgtttcatcttttacctactggtttttaaatatagggagtggtaagtctgtagatagaacagagtattaagtagacttaatggccagtaatctttagagtacatcagaaccagttttctgatggccaatctgcttttaattcactcttagacgttagagaaataggtgtggtttctgcatagggaaaattctgaaattaaaaatttaatggatcctaagtggaaataatctaggtaaataggaattaaatgaaagagtatgagctacatcttcagtatacttggtagtttatgaggttagtttctctaatatagccagttggttgatttccacctccaaggtgtatgaagtatgtatttttttaatgacaattcagtttttgagtaccttgttatttttgtatattttcagctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtattggaaccaggtttttgtgtttgccccagtctatttatagaagtgagctaaatgtttatgcttttggggagcacattttacaaatttccaagtatagttaaaggaactgcttcttaaacttgaaacatgttcctcctaaggtgcttttcatagaaaaaagtccttcacacagctaggacgtcatctttgactgaatgagctttaacatcctaattactggtggacttacttctggtttcattttataaaagcaaatccaggtgtcccaaagcaaggaatttaatcattttgtgtgacatgaaagtaaatccagtcctgccaatgagaagaaaaagacacagcaagttgcagcgtttatagtctgcttttacatctgaacctctgtttttgttatttaaggtgaagcagcatctgggtgtgagagtgaaacaagcgtctctgaagactgctcagggctatcctctcagagtgacattttaaccactcaggtaaaaagcgtgtgtgtgtgtgcacatgcgtgtgtgtggtgtcctttgcattcagtagtatgtatcccacattcttaggtttgctgacatcatctctttgaattaatggcacaattgtttgtggttcattgtctccttaaattagactgtaagcaccttgatggaactcatactaccttttatttcacacacacgcacacgcgcacacacagcctacacatacactgcctagctcattgtagcatactaaatactgattttaatgaataagctaaaccttcgaaacccatttgctaatcccagcactttgggaggccaaggtgggtggatcacctcaggtcagaagtttgagaccagcctggccaacatggtgaaaccccacatctactaaaaatacaaaaattagctgggcgtggtggccaatgccttgtaatcccagctattctggaggctgagacaggagaatcgcctgaacctgggaggcggaggttgcactgagctgggattgtaccactgcactccagcctgggtgacaaagtgagactccatctcaaaaacaaacaaacaaaaacacatcatttcccctatagcaaaaacatgacggcacttactgtatcaagagaggtgagaaaaaggagccacagcaggatgattcaagggactctgcatagctccattttaagaatatgcctactgcaggtcagagaaggtaagcaaactgcctaaggccacacagccaggtacagaactctcaccaatattattgccagcaatcgcaattttggtgtttattcttggtaccaagttggagactatagggttctcttcctaatagagaccatctagcctttcactgttttgtggatacttctttctcttcttctttttttttttcccttttaaaatctagttatttttttctttttggtttctttgacacagggtctcttactctgttacccaggctggaatggagtagtgcagtcatggttcactgtagctttgacttcctgggctcaagcgatcctcctacctcagcttcccgagtagctgggaccacaggcgcccaccaacacctccagctaatttttaagtttttactagagacaacatctcactatgttgcccaggctggtctcaaaatcctgggctcaagtgatcccacctcagcctcccaaaatgctgggattacaggtgtgtgcaaccacgcctggcctattttttttttaattgctcataaatcatcttttttctttaaaaaaaagaaagatgggaggctaaagcaggagaatcacttgaacccaggaggcggaggttgcagtgagctgagatcatgctgctgctctccagcctgggcaacaagagtgaaactccatctcaaaaaaaaaaaaaaagaaagtacacaattttactttctggacctaatggtcaaggccaataatttggtcacctatgaaataaataaaagctttaccatatatatgaccatttgataatgtaatatgaaatgtttatgtactaaaggcagaatagtctagaaaaaacattctgtatcacaacgtctaaaaatgaatatcatcttcatcatagaaccaggctctttctcctaatttttttttttgagatggagttttgctctgtcacccaggctggaatgcagtggcacaattttggctcactgcaaccttcagctcccaggttcaggatcaagtgattttcgtgcttcagccttctaagtagctgggattacaggtgactgccaccacacccagctcatttttttgtatttttttagtagagagagggtttcaccatgttggccaggctcgtctcgaactcctgacctcaaataatccacccgtctcagcctcccaaagtgctgagattacaggcgtgagccaccaggcctggcctcctaatttttatttgtagaagtggcaccaaaattttccaagttctcatgcaaaaattcaggctcatctcagtttatttttttcatttatttatctcccactaaattgacaacttctaataattaggttggttctttgtattcccagcacagggttctatgcagaatacacacacagcagttgctggcaataatattggtgagagttctgtactgggctatgtgatcttagacagtttgcttatgttctctgacctgccgtaggcacattcttaaaatgaagctgttcagaccccctcgattcatcctgctgtggcttctttttcccacctaaatcttaaatacccttttagctgctagtaagtgaatgatgtttttttatgaactttctgaagtcagattagatgaagttgagaaaagcctgatattcttataaagttatatatgtgcatcatagaaaacttagaaaatacagataaacaaaaatcatccatggacgaaccttgaagacattgtgttaactgaaataaaccggacaccaaaggacacatgttatatgcttccacttatatgagatacctagaatagttacatttggttactctgggtacattgcctatagataagccttgctccacaaggagcagttaaaaaaaaaaaaaagataaattcataggatggaaggtagaatagtggttactagggacttggggagggggaaatggggagttactgtttgatgagtgcagatttcagtttgggatgatgaaaaagttctggagatagatagtggcaatggtaacacaacagtgtgaaaataatgccactgaactgtacacttaaaatgattaaaatgataagttaattgtaatttgtgttatccagaaatggttagcaatttattggtgtatattcttttagtattcctgtgtgtgcacaggggtgcttgtatatactttatctttaaaatatatccaggaagctaggcacagtggcttacacctgtaatcccagcactttgggagggtgaggcaggaagattgcctgagccccggaggtcaaggctgcagtgagttgtgatcacgctactgcactctgttctgggcaacccctgtctgggaaaaaaaaaaaaattagtgaggcttagtggtgcacacctgtagtctcagctacttgagtggctggggtaggattgcttgatcccagcaagttgaggccgtggtgagccatgatggtgccactgcactccatcctgggtgatatggtgagaccctgtctcaaaaacaagaaatccagataattctgtgcattataatctagcttttactggatcattaaaattcttttttctttttttttttttttttctgagatggagtttcactcttgttgcccaggctggagtgcagtggtgtgaccttggctcaccgcatcctctgcctcccgggttcatgcgattctcctgcctcagcctcccgagtagctgggattacaggcatgtgccaccatgcccagctaactttgtatttttagtagagacagggtttctccatgttgaccaggctggtctcaaactcctggcctcaagtgatccacccacctcggcctcccaaagtgctggggttacaggcgtgagccaccgcactcagcctgggtcgttaaaattcttaagtgacttcatttttaattactatatgggattctatctttccagtgtatcatgatttatttgacctattgctgaatgttggaggtttcagggtaagaggcacagtttgctattatgtacatcactatagtggcatcctgatagctaaatatttgcctacatccctgattatttccttagtctaaattactgggactaggattttggtgtttgatacatgttactaaattgttttttagaaagattaaaccagtttatgctcttccagcccctgtggtatatgatagttcccattttcctgtaccttgccaacactgggtgatatccagttttaaaatctaaatcttgcattgctatgagaactacaattagagaaggcttatcttctactgcccattctctgtacagagcaaatccctctagacctgaagccccttggagttgtcaagaaacctttgagatgactccccactctgtatctgagctgtcaccagtattctccacttcttcaggattgccatggcaactaaattgatgaaaagatttaggaggccttttctctctttgcaattcctatgatcctttttgaatgtgggtttgggactctgtcaatatacccatcatctaattctgtccattgtgttttaaagtttaaggttgcaatttctgattacatctgccttagccatactgtattatatttgacattcaatatacaatgtccttgtttttctgtatttctaatcttattcccagagatgtgtctatttgttcaggattcattttgcaacgtgtttttactaagcatctacccaaaaccgttgaagtcagatttcaggctgtcttacgtctaaagtagcacaggcaggaaaaactattgaagtgggatttttttttccctttttgtactgaaccgagaaaaagtatatagatgatagagaattcctaatttggtatcattgatatctgggtttttgtttgtttttacagaagactgattaactatacttatttattaatttatcttctcattaataaacacttgctgagtgcttactgtctgctaggcattagggagacaaatatgattaagggaagcttcctcctatcaaggtcatgtgttccatttgggtatactaatgcattagcaatgtaaatcaagtagtgagagatcatctgttcccgataggagatggattattggtggggacttctgtgtgtgtgtgtgtgtgtgtgtgtgtgtgtgtgtgtgtatgtatgtgataaaataaatataggaaatgttaattatagattctaagtagtagatatataaacactcattgcaaagttgcttcaagttttctgtatatttgaaaatattcacaacatgtcgacaaaactagcatgataaagccactatttgtgctaagacttcagcttgtatctggattaggcttattatgtagtagtaggaacattagaaatagttttaactcattaaatacacatgttttatgggaaggttttatatatatatttatatgtaatgaatgtgaacaaacaagggtcagatatacactctgcttccctccagaccagttccggctgctctgctgcacatttcaggagtcttattagaattagccacattctgcccacttgcccttacttctcatatttcacaactcctcctggtggggacttaaggagacattcaaactaggccttgaaagatgagaatttttccaagtggaaaaagaggagtggcagcaagtaaggtaaaggtacagagtcatggaattcccaggaaacgtaaagttgtcatgtgttataggaaaacaacttgtgtgaggggtgttgggagaaatgagagataataccagggtataaagggccttttgaatgctatgttgaggaattttatcctaatggcagtaatgactaacaattatatagtgttcaaaaagtataaatcagcagtggtataccactaagggtttttttcttttctttttttttttgagacagagttttgctctgttgcccaggctggagtgccgtggcacgatctcagctcactgcacttccgccacctgggttcaagtgattcttctgcctcagccagtgtttcactgtgatggccaggatggagcactaagggtctttatggaagaaaaagacatgataaacaaggcttttagggaacttctacagtaatgtagctgtattaaaagtagagatcagagcagcatagtagaagtagaaggctagagctaattgaaggagcacttcagaattagaatcaagaagtcttagaaacctattggttttattctccctaatgtatttggccacttacctgctggggaatttgtctaagttataaaaaataattcctttgggaaacccaaaggaaagttatctattaataattaccccactactttttctgatttatgtaatggccacgtagaggttagatgtgatggttgtgacagtagtgactaatacagcctgtgaagcattttggtcagatatctatgtgctttcattccaggttgactgaggcaagactttggctagggtttgatcagtgatgtaactactcacgagtaccacgtggtggcaatggcattgctgcagaccttggcagcaaagcagtgttagagtagcagtagaaacctttgtgaagctaggaatacattttctggtcataaaaacctcctgaaaattgtgaactcagtgtagcaggagaaagaagatggcttgtttttagtaaagggcaaagtcatttttaaggatcagaagaagaaacggagagtgaaacaatgtgttcctgccctactcccccactggactttttggcaaccattgctgttccttctaaaagtgatttttaaacatgtatattttgaagccaggcacagtgactcacgtctgtaatcccagcactttgggaggccgaggcgggcagatcacctgaggtcaggagttcaagaccagcctggccaacatggtgaaaccccgtctctactaaaaatacaaaaattaggccaggtgtggtggctcacgcctgtaatcccagcactttgggaggccgaggcgggaggatcatgtggtcaggagatccagaccatcctggctaacacggtgaaacaccatttctactaaaaatacaaaaaattagctgggcatggtggcgggcgcctgtaatcccagctactcaggaggctgaagcagaagaatggcttgaacctgggaggcggagcttgcagtgaaccaagattgcgccactgcactccagcctgggcaacaaagtgagactccgtctcaaaaaaaaaaaaaaaaattagtcgggcatggtaacaggtgcctgtaatcccagctacttgagaggctgaggcagggagaattgcttgaaccaggtaggcggaggttgcagtgagccaagatcgcaccactgcactccagcctggggcaacagagcaagactgtctcaaaaaaaataaataaataaaataaattcttaagaaggatattttggaaaactccttacatacctaaattctttgtttatcaaatacttggacttagcacactcttctttgaaatggaccaataaacaacaggagcccataagcaaaaagaactcattattttaaaaacagtaactatccttacaggctttctcagggctctttctgttggatccttccctctcacaggtccttgctaatgatctctaggtggacacattctagatgagatgtccctgtctagaatggcagcaccatgagggctatatcctcagtactaggacagcgcctggtgcttaatagatagtaaatagttgtctaattaactgagcaaacagatagattcatgaattagctttttgctttttctgttagaaactaaaggttcaggtcaggcacaatggcgcatgtctctaatcccagcactttgggaggccgaggcgggctgatcacttgaggtcaggagttcaagaccagcctggccaacatagtaaaaccctgtttctacaaaaattaccaaaattagccgggcgtcttggcaagcacctgtaatgccagctacttgagaggctgaggtgggagaatcgcttgaacctgggaggaagaggttgcagtgagccgagatggtgccaacctgggtgacagagggagacttaaaaaaaaaaagaaagaaagaaagaaaagaaactaaaggttcaaagaatcccagaaaaggaagagtcctcacaagccagtaatctaggcaggattactgatagtatttttatatttgttgtatttttataaaatgccatagatagagggcttttttcaacattacatcagtctaaaaatcacacatttttatatgaactaacctaaatgtctgatgaatctcacaacaccaagtctttgaaatgtgcccatataaataaaatgttaacagattcatgctaattttaaatatcgatagtgtttaaatgccttaattattttttcactccctagctttaaaagaaaataaccaacttcaaaaggacatcacaataacatcaagtctatttgggggaatttgaggattttttccctcactaacatcatttggaaataatttcatgggcattaattgcatgaatgtggttagattaaaaggtgttcagctagaacttgtagttccatactaggtgatttcaattcctgtgctaaaattaatttgtatgatatattttcatttaatggaaagcttctcaaagtatttcattttcttggtgccatttatcgtttttgaagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaaggtgtgtattgttggccaaacactgatatcttaagcaaaattctttccttcccctttatctccttctgaagagtaaggacctagctccaacattttatgatccttgctcagcacatgggtaattatggagccttggttcttgtccctgctcacaactaatataccagtcagagggacccaaggcagtcattcatgttgtcatctgagtacctacaacaagtagatgctatggggagcccatggaagatacatggtatacaacatagctcttgctctattggaagctaagtggaatgggagaaattggtgacaggcaaccccataatttcagaaagctatgaaaaagtactcagacatattccttataacactggtgtcacatcacaaagacctatttaatgtgcttctgatttatagggagagacatcctatacttcaggaactgcactttgatccacagaaagcctagtgatgtagagctcctgttagttcaaaaggaaaagaaaagaacaacacagaaagcctaattatgcaatagagtcaagtgctttatagcaatgttacagttatcaaaaaaaatccagatggacctctgagaggatgccattggagtaaccaggcagatgcagttgatcagagctgacttcctataagaagtgagcactgagctgaggaataatggcataaatgaaggaaagtgagatggaaatttgagtttttaattggaaagacaatacatcaggcagatttttaaataggggcaaacaaacagacacataggagatgctaggcatggggtccccactaggatgctgcttagaaacatgcaggggtggtgagtactcccaaagtacacttcattcctagctcagtgattcttatctgagtgttaaagttccttcttcagcaccccgttccacagtccaactgggaactttaagacctttcttggagtctttctaggaactcaagtctgctacttatacagaacagtggctttggtccccagttgtgccttgcagtatttttgtgttcaggaagaaacagtagctcttggataaagaagctagctagaaactctgttgctatggcagtgcttcaaaatgtatttccttaaatgctttctttgtaactatcttcatttagttcatctctcagataatgagagatcagagtcccatccccagtataatactcttctttagggtactttcaccatcttcagtctaaacacagactagactttcaattataatgtgtaagatttaaaatgttattattgtgtgactttgaatatctgtgtaaatctactatctcctctttggtatatacgtgtgtttatttttttctggagatctgtaactgaaatgcttaatttctgaattgttttggatatcacaacttaataccaacataagttttgagcctttttctccctaaatctggtgtgagtctaactgaaactcaaatgaactttttaaaaataattttttcttttctttaattttttttttaagtagagacagggacgcactgttaactaggctggtcttgaactcctgatcttgagccatcctccccgacctgagcctcaccttatagagagggtcttgctctgttgcccaagctggagggcagtggcataatcacagctcactgcagcctctcgacctcctcaagcgatcctcctgccttagcctcccaagtagctgggactataggcgtccaccaccatacccagctaatttttttttttattttttgtagagacaaggtctccctatgttgcccaagttggtctcaaactcctggactcaagcagtcctctcacctcagcctcccaaagtgctggggttacaggtgtgagccatggcacctggccagaacttctagtaaaaagaatattgttgccgggtacggtggctcacgcctgtaaccccagcactttgggaggccaaggcaggcgaatcacctgaggtcgggagctcgagaccagcctgaccaacatggagaaaccacatctctactaaaactacaaaaaattagccgggcgtggtggcacatgcctgtaatcccacctacttgggagctacggtgcctggcctagtttattatttcttaatatctgttgtcttccagtgtcttccttaattcttcacaataccctgtacaatgcttagcacacagtgggcagtctgtaagtttattaaatgtttggtgtggcccatacttcctatccacaaagaatgtaacatgttaagacatctagatgagggaatgatttaagaggaactacaataatattctgaaacttggactctggatctctgcatttagactttcctaaaccagccagcaagtagatcatcatgtcacaaggcttaggttgggcttgctgttcagagaatgaattaaggattaaggagaaaaaaaagcagaaaggttttgctctgtttttcaggttctattgagttgttaacttctaacaagttatcttatttgcttcattgcatgaggcccattgtagtaagaagaggaatttatatgctaaatgttctggtgatagaatgacttttctttttttttacagtccaaaggtcttttttttttttttttaacacctattatgccatgaattcatagggaataggttccagctgctcaggctccttcccattggttctcacaaagtgtgcttctctgggtggagcaggctggtgcttcagttgaacccacgtacctttctctttggcttctttctttttctgatcattttccttcacgcgtttcaggaagctgtcttggctcttagagtgtttaatgtgctcaatacgcacattaattctcttggcaagaatcttgcccttaacttgtttacagcgatgccaacagcatgctgggtcacgttgtagacttttccagttttgccatggtaacacttgtggggcattcctttttgaacagtacccgttcccttgatgtctacaatttcacctttcttacagattcgcatatacatggccaaaggaacaactccatgttttctaaaaggcctagagaacatatatcaggtgcctctcctctttccctttgtgttcgtcattttggcaaattactgaaagatggtggttctggccaaaaggaggaatgactttttaatagctgtgtttgtatctgagccttccctctgcctttcattttttttgttttgttttgttttgtttttgtttgagatgaagtttcacttttgttgcccaggctggagtgcaatggtgtgatttcggctcattacaatgtccgcctcagcctcctgggtagctgggattacaggcacccgccaccacgcccagctaatttttgtatttttagtagagacagggtttcaccatgttggccgggctggtctcaaactcctgacctcaggtgatctgtccacctcggcctctcaaagtgctgggattgtaggcgtgagccacatcacctggccacttttttaactctttccaatggttaattccgtttgatatggttccttggaacttgcacattaccctttatcaattatcaccctgtattgggggtggggaggatgatacctctcttcatagttagatcctacttactttcaacagagttcttaacaatcctagaaactcacaggtccagaaaagacaagcataaaggaaactataaataatgcatttgaagactaactcaggaaatcaatgattatttccccccaggctacccagtgtcttaaaaaaacagtttaattaatacaatcttttgtttcaattttctacctatatttatggcttttagcttttctaataaaagctcaaaatgaattacagtcatcagtgactttttaatgaatagaagacttttgcaatttttaactatttgtttttacttattaaatatttccgccttggccaggcatggtggctcacgcctataatcccagcactgtgagatgccaaggcaggaggatcacttgagtttaagagttctagaccaggctgggtatggtggctcatgcctataatcccagcactttgtgaggccaaggttggcggatcacctgaggtcaggagtttaagaccagcctggccaacatggtaaaaccccatctctacaaaaaatacaaaaattagccaaggggtggtggtgggcacctataatcccatcttcttgggaggctaaggcaggagaatcgcttgaacctggaggcagaggttgcagtgagccgagatcatgccactgtattccagcctgggtaacagagcaagactctgtctcaaaaaaaaaaaaaagtttgaaaccagcctggtcaacacagcaagacacccatctcgttgaaaaataacggtcgggcgcagtggctcacgcctgtaatcccatcactttgggaggccgaggcaggcagatcacctgaggtcgggagttcgagaccagcgtgaccaacatggagaaaccccatctctactaaaaatacaaaattagttgggcgaggtggtgcatacctgtaatcccaactacttgggaggctgaggcaggagaacagcttgaacctgggaggcagagaggttgtggtgagccaagatcatgccattgcactgcagcctgggcaacaagagcaaactccatctcaaaaaaaataaataaataaaaataaataaataagtacttctgcctttaagccacttcctagaaggcagtggcacaaagtgatacatttggaggagtaaatatattacaaaatgaattaggctgggcgcagtggctcatgtctgtaatccccgcactttgggaggccaaggcgggtggatcacttgaggtcaggagttcgagactagcctgatcaacagggtaaaatcccatctctactaaaaataccaaaaaaactagctgggcgtggtggcaggcacctgtaatgtcagctactaggaaggctgaggcaggagaatcgcttgaacccaggaggtggaggttgcagtgagccaagattgcaccattgcacttcagcttgggcaacagagtgagactccgtctcaaaaaaaaaaaaagaactaacatgccagaactttgccttcagtatgttttgtgatttttcccttcttgtgccatttcatcattagttccatgtattatttaagatttcttatcaaccagcaccttgggatttttttgtgtatgtgttggtttagggggtttatttgtttttttcttttttttcggtaattgaaaatgtgaagcaaaatgtcacctgttttttctttcatgtctgacactcatgtcttgtttacccccgacatgcagaagctgaaatccccatttcatacagtcttcaatgtggaggcagtagggatggagaaaataatgtactttgtgctctccggtactctttctttcctattgtctgaggggatttgggcataatttattttgctgcagagataaaaatttgttatatatattttttatcattcagggccaaggaatatagattttttttttcagccttgtctcagctgggtgtctttatttactctgtcttaaagtgttccttttattatcattattattttttaatcattgaattccatttggtgctagcatctgtctgttgcattgcttgtgtttataaaattctgcctgatatacttgtttaaaaaccaatttgtgtatcatagattgatgcttttgaaaaaaatcagtattctaacctgaattatcactatcagaacaaagcagtaaagtagatttgttttctcattccatttaaagcagtattaacttcacagaaaagtagtgaataccctataagccagaatccagaaggcctttctgctgacaagtttgaggtgtctgcagatagttctaccagtaaaaataaagaaccaggagtggaaaggtaagaaacatcaatgtaaagatgctgtggtatctgacatctttatttatattgaactctgattgttaatttttttcaccatactttctccagttttttgcatacaggcatttatacacttttattgctctaggatacttcttttgtttaatcctatataggttttttgaacctataacataagctacaacatgagaaatgtgcggttagatagatatgtcccttctgaaggtcagaaaaaaatataatggaggtaaaacctgaacaagcttggaaactgatggtagacttcttcaaggcagcccttgccctaattaaaattcttgtctttctagaaaaagtctagctgttgatttaccacagaaaataataataataattactattattattattttttgagacagggtcgccctgtgtcacctagattgcagtggtgcagtcatggctcactgcatcctccgtttttcaggctcaagcaatcctcccaccttagcctcctgagtagctgggtccacaagcatgcgccacccacacccactaagtttttgtatttttggtagagatggagttttaccttgttgcccaggctggtctcaaattcctggactcaagtagtccgcccgccttgccctcccaaagccagaaaacatttagaatatctttcagagatgtgtatttacaccactattaacacagggctgtatagcagtccagtactggactatgtagtccagtactattcttttccttactggagggccaggcgtggtggcaggtgcctgtaatcccagctactcaggaggctgaggcaggagaattgcttgaacctgggaggcagaggttgcagtgagctgggaccgtgccattgcactccagcctgggcgacagagcaagactccgtctcaaaacaaaaaaaaaaagagagagagagcagtaattcaggtctcacccatcttcaatccagggggcctagccttagtatttgacccatagtaagcacccaataattgtttaaattaattaacctctgaggccctttaaatctgttgataagtatcttattttgcaaagtcctaagcacttggaagagcagaggaactatttactgggtgtgtatgcttttctaacaatattttatagctggcttttgtttttagaatgaatttgaacattgaaaaggcaggcaatagggatgattctgtgaattctgctaaaactgagtagaaagaatgagtgtagagatgtcgacattgatcaactttctatcttcataagagatctgattctaacatatccatttagactcaagtagaatattgtgtatagagtgagtggcagtgagtaatttggtaaaaatttgctgacctgcttttattctttcctcctttctttcttcctttccttccttccttccttccgtcctttcctttcctttccctcccttccttccttctttccttctttctttcctttctttcctttcttcctttctttccttcctcccttccttttcttttctttctttcctttccttttctttcctttctttcctttcctttctttcttgacagagtcttgctctgtcactcaggctggagtgcagtggcgtgatctcggctcactgcaacctctgtctcccaggttcaagcaattttcctgcctcagcctcccgagtagctgagattacaggcgccagccaccacacccagctactgacctgcttttaaacagctgggagatatggtgcctcagaccaacccaaccccatgttatatgtcaaccctgacatattggcaggcaacatgaatccagacttctaggctgtcttgcgggctcttttttgccagtcatttctgatctctctgacatgagctgtttcatttatgctttggctgcccagcaagtatgatttgtcctttcacaattggtggcgatggttttctccttccatttatctttctaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctaggtaatatttcatctgctgtattggaacaaacactttgattttactctgaatcctacataaagatattctggttaaccaacttttagatgtactagtctatcatggacacttttgttatacttaattaagcccactttagaaaaatagctcaagtgttaatcaaggtttacttgaaaattattgaaactgttaatccatctatattttaattaatggtttaactaatgattttgaggatgagggagtcttggtgtactctaaatgtattatttcaggccaggcatagtggctcacgcctgtaatcccagtactccaggaggccgaggcaggtggatcagctgaggtcaggagttcaagacctgtctggccaacatggtgaaaccctgtctctactaaaaatacaaaaaaattaactgggtgtgctagtgcatgcccgtaatcctagctactctggaggctgaggcagcagaatcacttgaacccgggaggcggaggttgcggtgagccaagatcacaccactgcactccagtctgggtgacagagcaagactccatctcaaaaaatatatatatatatatatacacacatatattttatttcaactgttagacaagagtccaaaggccaaagaataaagttttaggccagtcctttattagaaaatgagtcaaatcccaaagcaagttttttttatgagttaatgaatataaatgactacatattttatgccttaaaaatcacttttaatgaatggtgttttatggcttgtaaatcagagttttaatcagtaaagaaagtttttaatcctcaaaaacacgttatcataaaagacactgtttggcatcaaatgtggtatttggccatgttcattagggtcattttaggaatctcatacattctacttagctatgcttaattcctgataccatggcattttctgaaatgtttcaaggatgacatctctgctgtttttaatttggtaatgatatctgctgatttattaagtgaaaaaagtaatggtgtcattaccttggatgaagaaacaaaaataaagcatttgccacatttttcaacttttttttcctttcttacaaaattgctataagctcattgcccccaaattggacaatatagggaataaaaaagataatttggggtggggttagacacgggtcttgttatgttgccgaggctggtctctaactcctggcctcatgcaatcttcctaccttggcctcccaaagtgctgggattataggtgtgagccacttcaccaagctgagatgccacctcttaaaagataaaataaggacagattacagccactgctcatgcctgtaatctcagtactttgggaggccaaggtgggagaattgctcgaggccaagagttcaagaccagcctgggcaatgtagcgagacctgatctctataaaaagtaaaaaaaaaaaaaaactagctggggccaggcgtggtgggtggcttacgcctgtaatcccagcactttgggaggccgaggcgggcagatcacctgagggcaggagttcaggaccaacctgaccaatatggagaaaccctgtctctactaaaaatacaaaattagccaggcttggtggcttatgcctgtagtcccagctactcgggaggctgaggcaggagaatcgcttgaacctgggaggcagaggtttcagtgagctgagatcgcgccattgcactctagcctgggcaacaagaatgaaactccatctcaaaaaaaaaaaaaatcagctggaaggtggcaaacacctgtggtcccagctactcaggaggctgagacaggaagatcacttgagtccaggaggtcaaggctgcaggtgagccatgtttgtgccactgcactgcagcctggatgacagaccgagacccttctcaaaaaaaaaaatattacccgtactcttttttgagacggagtttcactcttgttgcccaggctggagtgcaatggcgcaatctcggctcagcgcaacctccgcctcctgggttcgagcgattctcctgcttcagcctccccagtagctgggattacaggcatgcaccaccacgcccggctaattttttgtatttttagtagagacagggtttctccatgttggtcagactggtctcgacctcttgacctcaggtgatccgcccaccttggcctcccaaagtgctgggattacaggcctgagccaccgcacccggcctgtactcttattctttaataataaaatatttctgtgtttctttagtcattttacataaacttttatttatttatttatttttatttatttatttttttgagacggagtctcgctctgttgcccaggctggaatgcaatggctcaatctcagctcactgcaagctctgcctcccgggtacacgccattcccctgcctcagcctccctagtagccgggactacaggcgcccgccaccacgcccagctaatttttttttttgtattttcagtagagacagggtttcactgtgttagccaggatggtcttgatctcctgacctcgtgatccacccgtctcggcctcccaaagtgctgggattacaggtgtgagccaccgtgctcggcccataaacttttatttttaaaataatgtcatgataaataatattgcttaggtgtctttaatatattagtaacatttctgttttattgtacatcaacatttatattcaaattaatgggtgaagagtactccattggactaggtatatcgtaatttaatctcctattattggacaactacattgtttctaaaattatactattcctatgactaaacctttgcatatatcttttatctccctaggatatatttctaaaactagcattgttgactgaaagtgtaaatacgtgttaaggtgtttgctacataatgccatatttcctttttaggaaactaagctactttggatttccaccaacactgtattcatgtacccatttttctcttaacctaactttattggtctttttaattcttaacagagaccagaactttgtaattcaacattcatcgttgtgtaaattaaacttctcccattcctttcagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttgtgagtgtatccatatgtatctccctaatgactaagacttaacaacattctggaaagagttttatgtaggtattgtcaattaataacctagaggaagaaatctagaaaacaatcacagttctgtgtaatttaatttcgattactaatttctgaaaatttagatctagataaagctatagtgtggattattttatgtatatttacttgagaaaataattattaaatattagtggaaaagctatactttgggtatgatataggactttcgaattggaattttcctttctatctgtaaaagcaagtaggtatagttttattccccagaaggcatctttttctcccccttgtctcacatgggtgaatttaccagcatatttaactaaattcagactggttccaaatgtactgccagatagtagcatttctctagtgtttgttttcatcctggcttgtaagaatgccctgccacttctgccctgcaatatcccttgctattaggattttggcatcaccttgggtccttaatgccagaaatgggaattgcttcatactgtggaaaaatacccattaaaatattaagaccagtaaaacctcgtttctgcttgggctatttgtggatttcagacatcctgagaagtttaccacccctgtaattaattgtcattgtcatcacttcataataaaaataattgcatggccgggcatggtggctcaagcctgtaatcccagcactttgggaggctgaggtggtcagatcacctaaggtcaggagatcaagaccagcctgaccaacatgaagaaaccccatctttactaaaaatacacaattagccgggcgtggtggcgcatgcctataatcccagctactcaggaggctgaggcaggagaattgcttgaacccgggaggcggaggttgcggtgagccgagattgcaccattgcactccagcctgggcaacaagagcgaaactctgtctcaataataagaagaagaattgcgtgaatatttctttaaaactatgatgagataacataccagattatcaaatggattcagtagtgggtgtgccatttattgcacactgagagatgaccaagtcattctgaaatatctttattaatatatccttcctaggatttttcatcctaacttctccataggtagttacttagcataacatctctgtggccagatgtatcccactactaaaagggcaaagtaagctgtggctgccctggtagatacaatgagtaagtgcacagtgatggctataaatgttttcatctcataatcccatgtccagaccagcaatttgctctgaaagctcttacctgtgtctgtttcaatggctcttgatcacttgcctgcacgtccagaattccttatttattcattgaaaattagcgttctttatccctttgttttgcaagttcagctttttagagatggctaaaatggtctaatctttcttggcaaaggcaattctgagctgcagattagactacaagtggcttgggtacatgttgtctttaaacaagcgaagaggaaaactttgagctctattcagacttggtgaagtgtggtaaatttatgatgaaagctactgactgtattacacatgattaattctgaagcccatattaagatgatcttttcagcagttcagcattgctcttctaactgaacagtttcaaggctgggatttcagcaattaatcagttcagaattgctaatgatcctggcggagggtggtagcaaaagggggaggatgtcattagcttctctagcctgccttttttcagtgccctgtggcagtatggagtgaggcaacatgaaagaaagatggcctgaccttcatggcagtattgtgcaacacgtaaatactggtgtgagtggctgtggctatggctagtaaatgatggcccttggtaaacaaagttatttatcagacaatacctaccagctaggtcaactgtgcccataattgatctggttaatttcttttgctgcctattgatttttatttggttgatagataatagctagaggactctaaatttctttggggaagaacatgaaccccttctaagccttcttacgagagaattgatcgcttttgcactgacctttagtaacatcctgatttcagtgttttgtaactatcagagggttgagtcttggttttaagccatgtatatctgtagcataactttctgtgtaggctagttacctctcagcttataaagtgtaggctgataaatttatagtacagtagagtgtcactatgcaaagaaacgatcttagggaatcgaatgatatctgctattaaagcaaaattaatatatattttttctttttacttttttttttttttaaagacatgaaatctcactgtattgcccaggctggtcttggtctcagactcttgagctcaagcagtcctcccacctcagcttcccaaagtgctgggattataggcatgagctgccgtgtctggcccagtatatattttttaagttttaagttttgtggtacgtagtaggtttataatattattttgaatccttagttgtaattttatgtctgctgatgtgtacataatttttattaaactatttatttgagacttcaggtatcttttttttttttttgagacggagtctcgcactctcgcccaggctagagtgcagtggcgccatctcggcttactgcaagctctgcttcctgggttcacgccattctcctgcctcagcctcctgagtagctgagactacaggtgcccgccaccacgcctggctaattttttgtatttttagtagagacagggtttcaccgtgttagccaggatggtctcgatctcctgaccttgtgatctgcccgcctcagcctcccaaagtgctgagattacaggcgtgagccaccgcgcccagccgagacttcaggtgtcttagaattttttaaatgtaccctttctgagaaaaacagagacttaaagctaggataactggtattctattttttttttttttttttttttacctccagcctgggtgacagagcaagactctgtctaaaaaaaaaaaaaaaaaaattcactttaaatagttccaggacacgtgtagaacgtgcaggattgctacataggtaaacatatgccatggtggaataactagtattctgagctgtgtgctagaggtaactcatgataatggaatatttgatttaatttcagatgctcgtgtacaagtttgccagaaaacaccacatcactttaactaatctaattactgaagagactactcatgttgttatgaaaacaggtataccaagaacctttacagaataccttgcatctgctgcataaaaccacatgaggcgaggcacggtggcgcatgcctgtaatcgcagcactttgggaggccgaggcgggcagatcacgagattaggagatcgagaccatcctggccagcatggtgaaaccccgtctctactaaaaaataaaaaaattagctgggtgtggtcgcgtgcgcctgtagtcccagctactcgtgaggctgaggcaggagaatcacttgaaccggggagatggaggttgcagtgagccgagatcatgccactgcattccagcctggcgacagagcaaggctccgtctcaaaaaaaaaaaaaaaaaacgtgaaaaaataagaatatttgttgagcatagcatggatgatagtcttctaatagtcaatcaattactttatgaaagacaaataatagttttgctgcttccttacctccttttgttttgggttaagatttggagtgtgggccaggcacggtggctcacacctgtaatctcagcactttgggaggccgaggcgggtggatcacctgaggtcaggagttcgagaccagcctggccaacgtgttgaaaccccgtctctactaaaaatataaaaattaggtgggcgtggtggcaggcacctgtaatcccagctactcaggaggctgaggcagcagaatcgcttgaacccaggaggtggaggttgcagtgacccaagatcgcaccattgcactccagcctggggacaagagcgagattcttgtctcaaaaaaaaaaaaaaaaaaaaaaggtttggagggtggtgagctgagatagtcaactattaactcctatctacctgctgggactacactggtgaggtggagcctaagtcctaaaacaacaagtgaggcagctggacgcggtggctcgcatcagtaatcccagcactttgggagcctgaggcgggcagatcacaaggtcaggagttcgagaccagcctggccaatatggtaaaacccagtctctactaaaaatacataaattggctgggcgtggtggtgtgcacctgtaatcccagctacttgggaggctgacacagaagaattgcttgaactctggaggctgaggttgcagtcagctgagatcctgccactgcactccagcctggcgacagagtgagactctgtctcaacaacaacaaaagaaagaacaagtgaggcaaaacctggagaccccagcttcatgtaacacctagtttgagtattgttgagagtttttcaggaaaaaagtctgataacagctccgagatagtcttaacatatgaaaaagcaaaaaagggaggagacagatcatttgtcctatacctttctcttttaaggttttaattataacttgtgtaatacaggagacctctgggtgtttttagttgactataaactaaatctgagtacacatttcagggctgctaaaaatgcttatttgaaactgggccgtattaacacaagcagaggctctggagcaagtgaagtacagatccagagccccactgtattctccaatggagtgattgcctgaaagatgatgtcagttttaagcaccgtgcttggtttttaacatggtcactgacaaattggagagtgtttatccagaggtagatggtaaagatacataaaagtaacttgaaatactgtcttttgaagaagaaatgagaagatttaaggaaataagacactgtcttcaagtatctgaagaaccgttacccggaagagaactgttatctggaacaggattaagactcactcatggggctccagaaagcagacgagtgcatggaggacgcagaagatgcagattgtgtggctcaactctaaaatctttctaacaaaattagttctctggatgtgttccagttcacttgatgatgattcttttgtttttgtttttgtttttgaggtgtagtttttcactcttgttgcccaggctgctggagtgcaatggcacgatcttggcttgctgcaacctccccctcccgggttcaagcgattctcctgcctcagcctcccgagtagctgggattacaggaatgcaccaccatacctaattttgtatttttagtagagacagggtttttccatgtcagtcaggctggtcttggactcccgacctcaggtgatccacctacctcggcctcccaaagtgctgggattacaggtgtgagccatcgcgcctagcctatgatgattcttttcacagagatacaggcacttaaggagaggatctaaaccccttggacacattgccgttgaacttctaagatcttaggtttccacttactcatgaaaattataccacagggtcagagggtagtgttcattggagccaggtgccagaacaagttattacaaactactattttagagaaaaatgtcattaaagtttaagataccttaagctataggtttgcatcaaagttaatgaaaggtaaaaagatgccaagcgtggtggctcaggcctgtaatcccagcgctttggggggccaaggcgggcagatcacgaggtcaggagatcgagaccatcctggctaacacggtgaaaccccatctctagtaaaaatacaaaaaattagccgggcatggtggcgggcatctgtagtcccagctactcaggaggctgaggcaggagaatggcatgaacccaggaggcagagcttgccgtgagctgagatccagccactgcactccagcctggctgacagagcaagactgcatctcaaaaaaaaaaaaaaaaaaaaatgcaaatcaaatctaaagtagttcagtctttaaactcaaagccaatacatttgctttgaactacaaatgaactgaagtttttaagtgtaataaatgttactaaatcggcttttgtagcagttaaacaaaaaacttcaaaaattgtaaggattctgtgagggagcatggctgctgctgctgctgctgcttgcagatagcctgctgtgtttaggatttagttaaatacatttctcctgtttaaaactaaatggtctttccttagtttgcttagttcttcagaagggcctttgaaacactgggaaataaacaagtgattctttagctactgctttctgaaatacttatataaaagctctgcactgtattctcccatccctctcaggggaatattagagggttaggactccccaggtagacattctaggggtgaaaatttgtcattacattgacatttcagatttaggttttcaacaatactgttttcttctttcacatattgccatctagtaatatagatgttctccgtccacattaatcaaaactattgacatggataattcctaattccttgaacactataatggagatctatagctagccttggcgtctagaagatgggtgttgagaagagggagtggacagatatttcctctggtcttaacttcatatcagcctcccctagacttccaaatatccatacctgctggttataattagtggtgttttcagcctctgattctgtcaccaggggttttagaatcataaatccagattgatcttgggagtgtaaaaaactgaggctctttagcttcttaggacagcacttcctgattttgttttcaacttctaatcctttgagtgtttttcattctgcagatgctgagtttgtgtgtgaacggacactgaaatattttctaggaattgcgggaggaaaatgggtagttagctatttctgtaagtataatactatttctcccctcctccctttaacacctcagaattgcatttttacacctaacgtttaacacctaaggtttttgctgatgctgagtctgagttaccaaaaggtctttaattgtaatactaaactacttttatctttaatatcactttgttcagataagctggtgatgctgggaaaatgggtctcttttataactaataggacctaatctgctcctagcaatgttagcatatgagctagggatttatttaatagtcggcaggaatccatgtgcagcaggcaaacttataatgtttaaattaaacatcaactctgtctccagaaggaaactgctgctacaagccttattaaagggctgtggctttagagggaaggacctctcctctgtcattcttcctgtgctcttttgtgaatcgctgacctctctatctccgtgaaaagagcacgttcttctgctgtatgtaacctgtcttttctatgatctctttaggggtgacccagtctattaaagaaagaaaaatgctgaatgaggtaagtacttgatgttacaaactaaccagagatattcattcagtcatatagttaaaaatgtatttgcttccttccatcaatgcaccactttccttaacaatgcacaaattttccatgataatgaggatcatcaagaattatgcaggcctgcactgtggctcatacctataatcccagcgctttgggaggctgaggcgcttggatcacctgatgtcgggagttcaagaccagcctgaccaacatggagaaaccccgtttctactaaaaatacaaaattagccgggcttggtggcacttgcctgtaattccagctactcgggaggctgaggcaggagaatcacttgaacctgggaggcgggggttgcagtgagctgagatcgcatcattgcactctaacctgggcaacaagagcaaaactccatcaaaagaaaaaaaaaatcgggtgcagtggctcatgcctgtaatcctaacactgtgggaggccaagacaggcagattgcctgagctcaggagttcgagatcagcctgggcaacatggtgaaaccctgtctctactaaaatacaaaaaattactcagcgtggtggcatgcgcctttagttccagctactcaggaggctgaggcaggagaatctcttgaacccgggaggtggaggttgcaatgagccaagatcgtgccactgcactccaacctggcaacagagcgagactccgtcttaaaaaaaaaaaaaattttgcagcgcaaaccaggatatcctctgttctcatttgttctagatttcaaaagaaacagtcctttctttggggaaaagagaaaggaaaaggagttttataaaaggaaagaaaagattcataagaacaagaagtgggcccacttgcatatacctttgtagaaaactgttcactgttgttgaagaaaagctcttcatattaatatgcagtccagatgcagtggctcacacttataatctcagccctttgggaggctgagacaggaagattacttgaggccaggagtttgaaaccagcctgggcaacatagtgagactctgtctccacaaaatttttttttaattagccgggcatggcagtgtgcttctgtagtcttagctactgaggaagctaagccagaagaatcacttgagcccaggagttcaaggctgcagtgagctatgatcataccattgcactcttgcacttgcacagagcaagaccctgtctcttaaaaaaaaaaaagtgtgtgtgtgcatatgcatatatacatatatatacatgcaaatgtatctgtttataattcagattgcttcaaaaagatgttgcactttatgatactgagaacagtgagaagtaaataagatagagtgtaggaggaggaataatttcagaacagccatctgagaacttctgtgacaacagatcaggcaaaatgaaatgtgaaagtaattttataggccaggcgtggtggctcatgcctataatcccagcactttgagtggccaaggcaggtggatcacttgaggtcaggagttcgagaccagcctggtcaacatggtgaaaccttgtctctactaaaaacacaaaaaaattagtcgagcgtggtggcatgtgcctgtaatcctagctgctggggaggctgaggcaggagaatcacttgaacccgggaggcggaggttgcagtgagcctagattgcaccactgcactccagcctgtgagacagaatgagaccctgtcttaaaaaaaaaaaaaaagtaattttataaactattgtgcacaattcgatgtattcataattaattaaatgattatttttgttggttttaacttttattcagtggctatttattgggagcctactgtgttctgggcactaggaatgcaacagtaaataagactaactaagtccctggtaggattcaggttctgtcgaggggagatacacaataaagatgaatttaagataacaataaatgctatggagaaatatacagaacagtggaatagtattagctgtcaaaggttgttgattactttcgtttaaggaggccagggaaagcctttctgaaaaaattgagctgagacctaaataacaagaaataattgtccttgaaaaatgaagggaatgcatcttataggcagaggaatagcaaacataaaggtcttgaggtaataatgagtgtggttttttgatttctgtattttggtttttttgagatggtgtctccctctatcccccaggctggagtgcagtggcacaatcttggctcactgcaaactctgtctcctgggttcaagcaattctcctgccttggcctcctgagtagctggtattacaggcacgcgtgctaccacacccgactagtttttatttttagtagagatggggttttaccacgttggtcaggctggtctcaaactcctgaactcaagtgatccaaccacctcaacctcccaaagtgctgggatcacaggtgtgagccactgtgcccggccagagcttggtttattttttaaaagataggccaatgttggtcgtgtgtggtggctcgtgcctataatcccagcactttgggaagccaaggcaggcaaatcacttgaggtcaggagttcgagaccagcctggccaacatggtgaaaccccatctctactaaaaatacaaaaaactagcatggtgtggtggtgtgtgcctgtaatcccagtgcctgtaatcccagctactccagaggctgaggcaggagaatcacttgaaccgaaaggtaggagttacagtgagccaagatcgcatcactgcactccagcctgaacgacagagcaagactcctgtctcaagaaataataatgataaaaggttcgggcacagtggctcacacctgtaattccagcactctaggaggccgaggcaggcagatcccctgaggtcaggagtttgagaccagcctggccaacgtggcaaaaccccatctctactaaaaaatgcaaaaattagctgggcacggctgggtgtggtggctcattcctgtaatcccagcactttgggaggtcaaggcggacagatcactgaggtagaaaccctgtctctactaaaaatacaaaaatttgcccagcgtggtggcgcgtgcctctaatcccagctacacgggaggctgagacaagagaatcacttcatcaacccgggaggtggaggttgtggtgagctgagatcgcaccattgcactccagcctgggcaacaagagtgaaactccatctcaaaaacaaaaaaaaattagctgggaatggtggcatgtgcctgtaatcacagctacttgggaggctggggcaggagaatcgcttgaacccaggaggcggagattgcagtgagctgagattgcgccactgcactccaggctgggcgaaagagcaagactccgtctcaaaaataataataataataataataggccagtgtagctggagtaatttgcaaattatgtgtggaggcagagattacacaaggaatgggagaaggtcatagatgagggccagatcacatagtatttggtggtaaggaattcagattttatccttgtggtaattggtggtgtggagatggttaaaaacaaggttggtttgggatgggtttgaagagaggacttgctaatggattaaatttggaggataaggtaaagagaaattgaaggagtgacacttgggttttggcttgaacaatagatcttgttagtaatattaaattagatgaagaaggcatggtagggaatatgggggagtgggaaaggcaggaagcaggaatggaaccaggaactctgttttagatgtgagaatttgttgttgttgttgttgttgttgttgttgttgttgttgttgttgtgacagcatctcgttctgttgcccaggctagagtgcatggagtgcggtagcacgatctcagctcactccaacctccgcctcccggttcaagtgattttcctgcctcagcctcccgagtagctgggattacaggcacctgccacaatgcctggctaatacttgtatttttagtagagatggggttttaccatgttggccaggctggtcttaaactcctgacctcaggtaatccacccacctcggcctcccaaagtgctgggattgcaggtgtgagccactgtgcccggccagatgcatgaattttgagatgtatactagacttctggatagagaagttaagtaggcagttggacacattgtatgaagctcaggggtacaaggaggactatgaacatgggagtcttctgacaaatttatcactagactcctcattcaagtaactaggaaatgtcagatattcttcccctagtaatagccagtggttatactcttgcctttagttttcttcacaatactcttggcaacacataaggccttccctacaatctgagtttcagtcagaattgtttctgagcgttcttcctcaaatttctccccagtctcattattctttattctcatgtccatgaccagtcataatagtaattatgaaaaacctctaactttctttagtgcattgaatgtatattttatcattttggttgtgttaactgtaaatctctcagtggaaatctgaaaagcctttatttccttagatgataatatacaattgatttaggagatagggaatttttcagttacctttataacagcacagtattagcagtctaatctaaatgctaagtgaatgttttgagaggagatagatgttgaaaattaaaatacattaagtcccagtgaggtgaaaagccgattgttaagttctgcacacaaaagatttgcttcagtgaattgatttcaacagctgagatcctagtcatttcacctggtctaccaaaaagaatgattttacttgcttttggtcaaatctctgcccagcaattctttttctttctttcttttttttgttttatgtgtgtgtgtgtgtgtgtttttttttagcagagtctcactttgtcacccaggcgggagtgtggtggtatgatcacagttcactgcagcctccaactcctgggctcaagtgatcctccagcttcagcttttcaagaaattgggactgcaggcacatgcaactatgcctggctgaggttttatgtatcttttttctagagaaggggtctcactgtgttgcccagctgggtctccagctcctggtctcaagctgtcctcctgcctcagcctcccaaagtgccaaagtgctagggttataggtgtgagccattggtgcccagctactgcctgcctggcaattctgaatgccttaaattttttttttttttttttttttttttgagacagagtttcactctgtcacccaggctggagtgcagtggcatgatcgtggctcacagcaacctctgcctcctggattccagcaattctcatgcctcagcttcccgagtagctgggactacaggtgcatgccaccacgcccagctaatttttggtttttttgtttgtttgtttgtttgttttgagacggagtctcgctcagttgcccaggctggagtgcagtggcgtgatctccgctcactgcaagctccgcctcccgggttcacgccattctcctgcctcagcctcccgagtagctgggactacaggcgcctgccactacacccggctaatttttttgtattttaagtagagacggggtttcaccgtgttagccaggatggtctcgatctcctgacctcgtgatccgcctgtctcggcctcccaaagtcctgggattacaggcgtgagccaccacacccggcctaatttttttttttttaattttatttttaattttttgagatgcgagatggagtctcgctctgttacccaggctggagtgcagtggcaccatctcagctcactgcaacctccacctcctgcattcaaaagattctcctgcctcagcctcccaagtagctgggattacaggtgcctgccaccacgcccaactaattttttgtatttttagtagagatgaggtttcaccatgttggtcagactggtgtcgaactcctgacctcaagtgatctgcctgcctcagtctcccaaagtgctaggattacaggggtgagccactgcgcctggcctgaatgccttaaatatgacgtgtctgctccacttccattgaaggaagcttctctttctcttatcctgatgggttgtgtttggtttctttcagcatgattttgaagtcagaggagatgtggtcaatggaagaaaccaccaaggtccaaagcgagcaagagaatcccaggacagaaaggtaaagctccctccctcaagttgacaaaaatctcaccccaccactctgtattccactcccctttgcagagatgggccgcttcattttgtaagacttattacatacatacacagtgctagatactttcacacaggttcttttttcactcttccatcccaaccacataaataagtattgtctctactttatgaatgataaaactaagagatttagagaggctgtgtaatttggattcccgtctcgggttcagatcttagctgataagtggaagagctgggactttaagcagatgagaatctaaagactttgctcttttcacttcactggggtgtctttctctctctctctcttgctctctctctctctttttttttttcccaagacggagtctcactccattgcccaggccagagtgcagtggtgcgatctcagctcactgaaaactcatcttgcccaggctggtcttgaacccctgaccttgtgatcctcccgccttggcctccccaagtgctgggataggcgtgagccaccgtgcccagccaataatagctaaaatttatataatgttcactgggccaggcacagcggctcgttcctgttatcccagcactttgggaagctgaggcaggcagatcgcttgagccaaggagttcgataccagcctgggcaacatggcaaaaccccatctctaccaaaaaaaatatacaaaaattagccaggcgtggtggcatgtacttgtagttccagctactcggaaggctgagttgagagtatctcttgagcccaagaagaggggactacagtgaacggagattgcgccactgcactccagcctagacgacagacagaagatctcaaaagaaaaaaaaaaaaaaaagatcactttatgctgggactgctctaaaggcccaaccatgttttaactaattaacaattttatgacaactctatgagctatgtactgtaattatgcctatattacagatgtgaaaattgaggctcagagaggttgaataagttgctcaaagtcacacaggtaataagtgatggaactagaagttgaactcaggaagtctagctccaagtctaaattctttgttaatttatttttcgggccagagtcttactctgtcacccaggctggagtgcagtgccactatctctgctcactgcaaccttcacctcccaagttcaaaccttgttcaattcttgtgccttggcctcccaagtggctaggattacaggcatgtgccacaacaactagctaattttttgtctgattctgttggccagtctggagtgcagtggcgcaatctcagctcactgcagtctccagctcccaggttcaagtgattctcgtgccttagcctcccaaatagctgggattacaggcacgtgccaccacaccgagatagttttttgtatttttaatagaaacaaggtttcaacatgttggccaggctggtctcaaattccagacctcagatcatctgcccgcctcaggctcccaaagtgctgggattacaggcatgagccactgcacccggccttaatttttatatttttattagagatggggttttgccatgttggccaggctggccttgatctcctggcctccagtgatccacccgccttggcttcccaaagtgctgggattacaagcatgagccactgcacccggcctccaattctaaactcttaacaacaatactatagtttcttgaaaagttgttgaaggcttcacggagggaaaaaaaatggagcattctaacaactttgcagatgagacccaagaagactcaatgactttctcctgatcatattgtagcagatgacttagccagaactctgacttcctcacagggagaaagtctgcaagatttcacacttacctgtcaggcctgagctggctgctttctcagctccctaagtgctatgttcccagtctgcttttcttcctttttcaagtgtgcactaccaggcatttcagaacatcccaggctggtcgcggtggctcacacctgtgatcccagcactttgggagcccaaggcgggtggatcacctgaggtcaggagttcgagaccagcctggccaacatggtgaaaccccatctctactaaaaatacaaaagttaactgggcgtggtggtaggcacctgtaatcctagctcaggattactcgggaggctgaggctagagaatcggttgaacccaggaggcggaggttgcagtgagccaagattgcgccactgcactctagcctggggacaagagggagacttcatctcaaaaaaaaaaaaaaaatcccagctgggcacagcggctcacttctgtaatcccagcactttaggaggccaaggcaggaggatcacttgagcccaggagttcaagactagcctgggcaacatagtaagaccctgtctctacaaaaaaatttaaaaattaattgggtgtcgtagcacactcttgtattcccagctactcaggaggctgaggtgagaagaatgcttgagtctgggaggtcgaggctgcagtgagccatgatggtgctactgcactccagcctggccaacattgtgagaccttgtctcaaaacaaaacaaaacatccttctactgagcactttctgtccctttatagaaacttaagagggaaccagtagaggtaatttcctaaggaaaactgctttgggacatgatcacaaatgaagcctggagttttgaactgctgaggtcagcctgtttttaccttctgagcctatcaagtaattgttccagatgccaagaaaagctgctggccttatttctgcttctgcctttaccacaggggagcgccatgtgagccagtcctctgtttttcctccactgtatgctaggcagtattagcaccagattcttcccctctttaaaaagaaattctagtgctttggattttttcctccatgcagaatagcaatgatggaaagtatgtggtcaaagtaatgacattctgaaaatactaaatgtcaccatagtatttttctctggaagagaaatgtatatgtagaggtgaaacttcaaatttctttttttttttttttaagacgaagctttgctcttcttgcccaggctgaagtacaatggcgtgatcttggctcaccgcaatctctgcctccagggttcaagtgattctcctgcctcagcctcctaagtagctaggattacaggcatgtgccaccacgcccagctgattttgtatttttagtagagatggggtttctccatgttggtcacgctggtcttgaactcccgaccccaagtgatccacccacctcggcctcccaaagtgctaggattacaggccaccgcgcccggcctgaaacttcaaatttctttttttttttgagacagagtctcgctatgtcacccaggctggagtgcagtggcgccgtctcggctcactaccagctccactccacctcctgggttcacaccattctcctgcctcagcctcccaagtagctgggactacaggtgcccgccaccatgcccagctaattttttgtatttttagtagagacgggttttcactgtgttagacgggatggtctccatctcttgacctcgtgatccgcctgcctcagcctcccaaagtgctgggattacaggcgtgagccactacgccaagcccgaaacttcaaatttcttatctcataactaggcatcctcatcactgagtgttagcctggatataaacattcctaatcttttgtacttttcatgtcagcatttggctccacttggctgcctggggagaacttctagcattatgagcatgcaggtcctatcaacaggttgggggtgcggtttattcatacaggtagtgagagtggcacagatggatgctgtcccttaaaacaaacagacttgtctttgggagcctgaggcgggtggatcatgaggtcaggagttcaagaccagcctggccaacatagtgaaaccccgtttctactaaaaatacaaaaaattagccgggtgtggtggtgtgcacctgtaatcccagctactagggaggctgaggcaggagaatcacttgaacccaggaggtggaggttgcagtgagccgagatggcaccattgcactccagcccaggcgacagtgcaagactgcgtctcaaaaaaaaaaaaaaaacacacagacttgtcctactgccatttcttttcactctggcggtaaagtaagagagtgtgtgtgtgtgtgtgtgtgtgtgtgtgtgtgtgtgtgtgtgtttctgtccgtctgtctgtcaagggggagggtgaccactttctaaaaggccatccgtgtatttttagcttcctgatttttttctctatcgcagtctctttgaagccaggtgaattttaggccttggcaattttctttttattgcaatgggaaggtcaagacactgagagtcacccaaaacatatccatccaaaatgatacaattttagggtttatttttaagtgatacccaagttatttgctaagaacctatgccagtgtgtttatgagaatttgcactgtcccacactgttgccaccagccacatgggactgtttaaatttaaattttacaaattagccagtcatggtggtgtgcacttgtagtcccagctacttaggaggctgaggcaagaggattgcttgagcccagaagttcaatactgcagcaagctatgatcgtgccactgtactccagcctgagtgacagaatgagacctcatctcttcaaaaaaaaagaaaaaaattaaaatatgaagtttagttcttcattcaccctaaccacatctccagtgctcaataactatatgtgactcatggctaccttattagcatagatatagaacattgtgactatcacagaaagttgttttgaacagtgttgccaagccctgtaagtggaagaggcagtgcagtgtgatctgtgtcttcaggaaaccaggtagtcagactagttcaatgaggagaggcagaacctggcttcacttctagattaaaaactgcttaggtggcctaaagatacaatggccattctcagagtagtgagaaggaaggaacagatgtttagggggctagaagaaagtcagagagggccgggcgcagtggcttatgcctgtaatcccagcactttggaaggccaagacaggcagatcacgaggtcaggagttcgagaccagcctgaccaacatggtgaaaccctgtctctactaaaaatacaaaaattagccgggcgtggtggtgcgcgcctgtaatcccagctactcaggaggctaaggcaggagaatcgcttgaaccctggaggcagaggttgcagtgagcccagatcgcaccactacgctccagcctaggtgacagagagagactccgtctcaaaaaaaaaaaaaaaagtcagaggagacaaggagcatgtacacctaaaatcaacatagacccctctgttgatggggtcatagtgagtacttgaggtaccaagtctggataaacatcaaacttcagccaataactttgagtttctagccatccaagcctcttattaaacatacagaaggaccttttttcccttgcatctaacaagttaaagcacctgcagagatcattagggaggagccttggcctgattggtgacaaaagtgagatgctcagtccttgaatgacaaagaatgcctgtagagtgcaggtcaactacatatgcacttcaagaagatcttctgaaatccagtagtgttctggacattggactgcttgtccctgggaagtagcagcagaaatcatcaggtggtgaacagaagaaaaagaaaagctcttcctttttgaaagtctgttttttgaataaaagccaatattcttttataactagattttccttctctccattcccctgtccctctctcttcctctcttcttccagatcttcagggggctagaaatctgttgctatgggcccttcaccaacatgcccacaggtaagagcctgggagaaccccagagttccagcaccagcctttgtcttacatagtggagtattataagcaagatcccacgatgggggttcctcagattgctgaaatgttctagaggctattctatttctctaccactctccaaacaaaacagcacctaaatgttatcctatggcaaaaaaaaactataccttgtcccccttctcaagagcatgaaggtggttaatagttaggattcagtatgttatgtgttcagatggcgttgagctgctgttagtgccaacatgttagtgagaaaatatctttggataggtaaaaatcaaggaggagttctcctcttcctaaaccatcttaatttacttacatagaagaaagcacagcagctggcccaccacggacgggcccagagcaggggaagattctcggtgaacatttctttttttttttctttttttttgaggtcgagtctctgttgcccaggccagagtgcaatggcgcgatctcggctcactgcaacctccacctcccgggttcaagtgattctcctgcctcagcctcccaaatagctgagactacaggcgtgtgccaccacgcccgactaattttttgtattttttttttagtagagacggggtttcaccgtgttagccaatatggtcccgatctcctgacctcgtgatccacccgcctcagcctcccaaagtgctaggattacaggcatgagccactgtgcccagccctctccatgaacattttctaattaaacttgacacttaatacaatgttatgcttaggactgctataaagcttacctctggagttgcgcagcacaaaggccttggtgtgtgtataaatttggtttgttcttttcacagcaaaagctacccacctttgcctcctgtgcctgcttctgcccagggacttaggtcctcttacaccttagagaaaggccttagcatctggtcacaggcagatgagtgacagcaagaaaacctggctgcaatgtaattttgtttccatcctctttattagttatcaattggatttttatgaaatttccaagttccactcaaggatttctcagtgtttttttactttggtatagtggaaaccagggttgccagaaagtattattttgggggtgagttagtcaaccttcgttcagtcagacagacaggagcacctcagcaattcccagaaacgggctgatgggaaagagcaacatacatgaatgtcttgaagaacacagccaacagagcccattgggcagttctgattttccaggtacacagcatctccacagtctcttctgatttttattcccctgagtatatggattccagctcagcatgtagcctttccctgctgagtctctaaccaggataacatgtatttttttgactggatgaattatcttcccatctcttgacatttacagtaattaccaccaagtatggtattttcagtggccgtgattatcagttaccaacacagaattaggatgaagggaggaagggagggaaggaaggtgggtgttttttcacacagtgtcttagccagcaatttagcaaattaatggaaattagatctttgatttttttttctttcaagcattttatttgagagactatcaaaccttataccaagtggccttatggagactgataaccagagtacatggcatatcagtggcaaattgacttaaaatccatacccctactattttaagaccattgtcctttggagcagagagacagactctcccattgagaggtcttgctataagccttcatccggagagtgtagggtagagggcctgggttaagtatgcagattactgcagtgattttacatctaaatgtccattttagatcaactggaatggatggtacagctgtgtggtgcttctgtggtgaaggagctttcatcattcacccttggcacagtaagtattgggtgccctgtcagagagggaggacacaatattctctcctgtgagcaagactggcacctgtcagtccctatggatgcccctactgtagcctcagaagtcttctctgcccacatacctgtgccaaaagactccatctgtaagggatgggtaaggatttgagaactgcacatattaaatatactgagggaagactttttccctctaactctttttcccatatgtccctccccctcctctctgtgactgccccagcatactgtgtttcaacaaatcatcaagaaatgatgggctggaggctgggcatggtggctcatgtctgtaatcccagcactttgggaggccgaggcaggtggatcacttgtcaggagtttgagaccagcctggccaacatggtgaaaccccatctgtactaaaaaaaaaaaaacaaaaagtagccaggcctggtggagcatgcctgtaatgccagctatttgggaagttgaggtgtgagcatcgcttgaacgtgggaggcagaggttgcagtgagccaagattgcaccactgcactccagactgggtgacagagtgagactttgtctaaaaaaaaaaaaaaagagagagagagaaaagctaggtgcggtggctcacgcctgtaatcccagcactttgggaggctgaggtgggcagatcacgaggtcaagagatcgagaccatcctggccaaccaacatggcgaaaccccgtctctactaaaaatacaaaaattagctgggcgtaggggcgcacgcctgtagtcccagctacttgaggggctggggcaggagaatcgcttgaaccccggaggcggaggttgcagtgagccaagatcgcgccactgcactccagcccgggcgacagagcgagactccgtctcaaaaaaaaagagagagagagaaatgatgggctgggccagtgccccacccctgtaatcacaacactgggaggccaaggtgggagaatcgcttgagcctgggagctgaagaccagcctgggcaatacagtaggacctcatgtctacaaaaaaattattaaaaattagccaaggctgggtgcggtggctcatgcctataatcccgggggtgaagttgagcccaggagtttgagaccagcctgggcaacatggcaaaaccctgtctctaccaaaaatacaaaaaaattagccaggggtggtggtacgtgtctgtagttccagctacttaggaggctgagatggaaggattgcttgagcccaggaggcagaggtggcagtgagctgagatcacaccactgcactccagcctgggtgacagagcaagaccctgtctcaaaaacaaacaaaaaaaatgatgaagtgacagttccagtagtcctactttgacactttgaatgctctttccttcctggggatccagggtgtccacccaattgtggttgtgcagccagatgcctggacagaggacaatggcttccatggtaaggtgcctgcatgtacctgtgctatatggggtccttttgcatgggtttggtttatcactcattacctggtgcttgagtagcacagttcttggcacattttaaatatttgttgaatgaatggctaaaatgtctttttgatgtttttattgttatttgttttatattgtaaaagtaatacatgaactgtttccatggggtgggagtaagatatgaatgttcatcacaaaaacataaatcaaggccgggcatggtggctcatgcctataattccagcactttgggaggtcaagatggaggtcaaggtgggagcctagaagttcgagaccagcctgggcaacataaggagacttcatctgtacaacaaatttaaaaagtagctgggtgtggtggcagatgcctgtagtcgcagctacttgggaagctgaggtgggaggatcacttgagctcaggaggttgatgcttcagtgagccacgatcacaccactgtactccagcctgggcgacagagcgagaccgtgtctcaaaaagaaaaaagaaagtataaatttacacaaaaacaataaaataatcccagtaattccaccacttggagatgatcaccataaaactccaccaggcatatgtgcgtatatatacacgtgtattttataaaatgtgatcataattacactgttttgcttttttccttaagatattacatacatttttccacatcgttaaattacagtgctgttttcctggtggctttcctttaacagattgaagttcatgttaatacagttgccagaggctgtgggctttcactgtcaccaggagtcactcctagggcctcttcagagcaaggccttatgtcctgaagcattgccttttttttttttttttgaggtggagtctcactctgtcacttagcaggctggagtgcagtggcccagtcttggctcactgcaacctccgcctcctgggtttaaatgattctcctgcctcagcctcagggcggatcacctgacatcaggagtttgagaccagcctggccaatatggcgaaaccccatctctactaaaaatactaaaaaaaattagccaggcatggtggcacgcacttgtagtcccagctacttgggagactgaggcaggagaatcgcttgaacccaggatgttgaggttgcagtgagctgagatcacaccatcacaatccagcctgagtgacagagtgagactccatctgaaaaaaaagaaaaaacaattagcctggcatggtggcaggcacctgtaatccctgctacttgggaggctgaggcaggagaattgcttgaacccgggaggtggaggttgcagtgagctgagatcgtgccattgcattccaggctgagcaacaagagcaagactccgtctcaaaaaaaaaaaaaaaaaaaaaaaaaggccaggtgcagtggctcacgcctgtaatcccagcactttgggaggccaaggtgggtggatcacctgaggtcaggagttccagagcagcctggccaacattgtgaaacccccgtctctactaaaaatacaaaaattagctgggtgtgatggcatgtgcctgtaattccagctactcaggaggcagagacaggagaattgcttgaacccaggaggcggaggttgaatgagccgagattgcgccatcacactctagcctcggcgacagagcaagactccgtctcaaaaaaaaaaaaaaaaaattagcttctacctcattaatcctaagaactcatacaaccaggaccctggagtcgattgattagagcctagtccaggagaatgaattgacactaatctctgcttgtgttctctgtctccagcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttcca

SEQ ID NO: 361 - DNA, 43828 bp, Homo sapiens
gcagctgctgactggcgggccgccaggcgcgtgcgtagagacgcccacacgcccgctgatgcgcacgcgccctgggccgcgcgtgcgcgcgtggggttccggaatgagccggggaaagcaaggggaaggtttggggttggctcccggtttcgcgcatgcgtgcactgcacaaaccatttggcgggtttttccggccactcagttctgccaccgtcactgagaagctcagcggtagcttttgggaagcaggacgttctcaccaggagagcgtcctctcgagatttctgctccctccattcagggcgtttgggagccaccccttcattttttaaaaaaagtatttctctgtgaccgacggccggggccttctgacggtctgaggtcttgcttgggccagtcacctcctgtcacggtccgcggaggggggaaggataagagggcgaggagctcatcgctcgccacccccgtgggcttcttgggcgcaggtcggagctgggtgggccggctccccggcccctggcttgggcgaccatgtccgcatccgcccagcagctggcggaggagctgcagatcttcggcctagactgcgaggaggctctaattgagaaatgtgagtcccgcacccctcccgccctgcagccgtgctccacgctctcgcccgagttcctcggcgcctagaaccgaaagtggagcgcttccaatttccacttcccctggagcagagttctcggtggctgtgagatgaagaatcaaacttgagttttgagatttaggatgtggggactttgaaatgcccaccgggtaccgcttggatgccaaatcaaaaataggaatatgcagcacgattttaaaccaactcgaagttcccgaaaggcggaattgggatgtgctagatagagactaggcactggtggcacctgagtttggaaattgttgaagccccggtaacaaagcaacagatgtgggggttttgaaatgtagctttttattcttggctcctccctttccagcctacaccttaaacctctgctgatccatcagttattttatcatagctgttggtggtctgtgcaaatatgaatcccttgaggtaggttcctaaaattgaatttgagctgtggaaggagctttagggagctttacagatggagaaacagacaaggaaagctaattgcctgagctgtctgtgaagccaggtgtcctgccttggagtcccgtgctgcatcatacgggtccatcgtgttggtcaagctgtagagcagtgtaaggagtcatttgaagcaaagcctgggagatgtggaagttctagaatcggtatgaatgtgcacctgccttaaccactcaacactttgaacttcttatatacaaaaagataacgaaacgttaatttatggtgagaaattcctttcagaaaccagaatacttcaagtcttcatgcccagtgccttctctctctctctttttttttttttttttttttgacagtcttgttttatcacccaggctggagtgcagtggtgcaatctcggctcacttcagcctccgcctcccaggttcaagcgattctcctgcctcagcctcccaagtagctgggattacaggcgcccgccaccaggcccgactaatttttttttgtacttttagtagagaaggggtttcaccatgtaggccagactgctctcgaactcctgacctcaagtgatccacccaccttggccttccaaagtgctgggattacaggcataagccagcaggctcggtccttctctttttaaaagaagactagccaggtgtggtggctcacgcctgtaatcccagcattttgggaggccaaggcaggtggataatctgaagtcgagaatttgagaccagcctgaccaacatggagaaaccctgtctctactaaaaatacaaaattagtcgggcgtggtggcgcatgcctgtaatcccagctactcaggaggctgaggcggaagaatcgcttgaacatgagaggcagaggttgtggtgagccgagatcacaccattgcactctagcctgggcaacaggagcgagactctgtctcaaaaaaaaaaaaaagacttaagtggaaaacctgatcatagtcagaaatgtatgtggtaagcatgaaatcagcatgagagaaattagttatgtgaaccagatttgtaaaggcttcaggccaagatgccagttgctttcatctcatggcaatggctttggaattgtggactttggatcatcagtaacttcagtggcaccttaatgtttcctgacagtcaaccgtatttccctgttttttttgttgttgtttgttttgttttttgagatggagtttctcattgcccaggctggagtgcaatggtgcaatcttggctcactgcaacctctgcctcccgagttcaagcggttctcctgcctcagcctcccgagtagctgggattacaggctcccgccaccacgcccggctaattttttgtatttttagtagagatggggtttcgccatgttgggcaggctgatctcgaacccctgacctccagtgatcctcccacctcggcctcccaaagtgctgggattataggtgtgagccaccacacctgttctactttttgtattttcagtagagacaaggtttcaccatgttggccaggctggtcttcaactcctgacctcaggtgatccgcccaccctggcctcccaaagtgctgggattacactgcgccaggcccctggtctctttactctgagtcttccagatgattgttttccaccttctcctgtaacatccttctgtcccaccctcactctcagctgacaaatttctattatttgctgaaaaatgtagaagcattagaaaacttcgatcagctaccaccattatgtctcactgacccatatctgtggcatatacctagccttctttcctattataatgaataagctttccgtattcctagcaaaatccaagtcctccacttgagtcctaaaccccattccttctgaagcaattaaggacatcactggtaattctcctgtcttacatattttctattttccttgctacaagatttttttcctactagtatagaaatgtgcttccaatcttgcctttaaaatactctgttgaccctacttcccactccagttctctccttcccaattacagcagacctcaaaagggtcggccgggtgcggtggctcacgcctgtaatccgagcactttgggaggcggaggagggcggatcacaaggtcaagagatggagaccatcctggccaacgtggtgaaacccggtctctacttaaaatacaaaaattagctgggcatggtggcgcatgcctgtagtcccagctacttgggaggctgagacaggagaatcgcttgaatcggggaggtggaggttgcaatgagccgagatcgtgccactgcattccagcctggcaacagagtgcaactctgtctccaaaaaaaaaagggggggggccttgccatctttaaatatttcctccttaaatccatttcagtaagttcttttgttgccaccacttcaccaaagctgctctactcaaggtcaccagtgaccttcaccatgctaaaaccagtgatgaattttcagtcctcatcttgaattgaattagcaccggcacttgacactgtttgtcattttttctttttttaaacacatttttcttttagcttcttagacactactagtttttctttcttttttttctgagacagggtcttgctctgttgcccaggctggagtataatgggcaaatcacagctcactgcagcctcaacctccttggctcaagcaatccttccacctcagcccccaagtagctgtaactacaggcacatgccaccaagcccacctaattgttgtattttttatagaaacggtttcaccctgttgcccaagctggtctcaaacttctgggttcaaacagtctgcccacctcaacctcacaaaatactggattacaggcgtgagccactgcatccggcttactcctagtttttcttcagctttgcttgtgtcaccgcttctcaggctttgccgattcatcctcagaggccctaaggcgccccaagactcaagcctgggatcttttctcccttctagatacgctcactcccttggcgatctcacctggggtctcatagctttatatcccatgtatttactgatggttcccaaatttatacctccgcccacaacccttgcctgaactacaggctggtttgttcagcctgctgtctccagttggatgtctaaatggcacctcaaactctgcatgtctaaaactaagctcctggtatctcctctctctcctcagagtagttcctctggctcttttccccatctcagttaatagggacgccactcttcctgttgcacaggctaaaaatatcagcatcatccttgactttctttttctcataccttacattcagttagcagatcccactggcttcacttccagcatgtaaagtcctatccagagtccagccacttctcgccatctccactgccaccaccttgatccaagccaccatcatctctcacctgggcttttccatgattctttaattggtccccctgattctgcccttatcctcttttgtctcccctcagtggtgagctttgtaaggacaaggatgcttctgttttctcattgcccaaaacagtgcctggcactaatagattctgaataaacattgatggagtaaaccaggattatttttgcttttctaggtgaaacttcgagaaatgaactaagtttttacttgtccaattttcctttctacagtggtagagctttgtgttcagtatggacagaatgaggagggaatggtaggcgagcttatagccttctgcaccagcacacataaagttggccttacctcagagatcctgaactcttttgagcatgaggtaagaacaaaatgaaagcaaactaataatgtgattctccatttctgctctacaggggaggcattgtgatatattgagaggagtgtgggctttcgagtcaggcctggattccagtcccagtgtgagcttggacaaactatgtccctgagcctcagtttccttttctgacattgggtctaataatctgtattttttatgattgttataagaattaaatggggctgggcgccgtggctcatgcccataatcccagaactttgggaggccgaggcaggcagatcacaaggtcaggagttcaagaccagcctggccaacgtggtgaaaccctgtctctactaaaaatacaaaaattagttgggcatggtggcaggcgcctgtaatcccaggtactcggaaagctgaggaaggagaatcgcttgaaccgaggaggtggaggttgcagtgagctgagattgcgccactgcactccagcctgggacagagcgagactccatctcaaaaaaaaaagaaatgagaatggacataaagcacttaaaactatgcccagcaggtgataagtcttcaccaaataattggtattattaggattgttatatgttatagacagtcatgggatgtctttgtttttagtctgtgtgtatcttaattctttgaggaatgttagatctttgattatattttgaataccttttattatctcaaggcttttgaaaacacctctgctattacttgactatgaagtactgtattcactatcttttctttttcagtttctgagcaaaagattatcgaaagccaggcatagtacctgcaaggacagtggccatgcaggagctagagacattgtttccattcaagagctgtatccttttctgctgaaggtctttgcaccaagctacatgttgtattttataatttgtctgtagtcgcatgtgtaatttaaaaacaaataataaggccgggcacggtggctcaggcctgtaatcccagcacttttggaggccgaggcaagcagatcacttgagcccaggaatttgtgaccaacctgggcaacatggtgaaaccctgtctctatcaaaagtacaaatttttttttttttttgagttggagtttcgctctttttgcccaggctgaagtgcaatggtgcaatctcagctcactgcaacctctgcctcccaatctcaagtgattctcctgcctcagcctcctgagtagctgggattacaggtgcacaccaccacacctggataattttgtattttttttggtagagacagggtttcaccatgttggccagctggtctcgaactcctgacctcaggtgatccgcctgcctaggcctcccaaagtcctgggattacaggcgtgagtcaccgtgcccggccaaagtacaaattaaaaaataataataataagctgggtgtggtgatgtacgcctgtagatccagctagttggtaggctgaggtgagaaaatctcttgaacctgggatgtggaagttgcagtaatctgagatcaggccactgcactccatcctggacgacgaggaaaccccatctcaataataataatagtaaaaattgcctaatattgagatttcttctagcaatcagcccttgccttatatgaaagtttattattattattattattttttttttttgagatggagtctcgctgtgtcgcccatgctggagtgcagtggtgtgatctcagctcactgcaagctccgtctcctgggttcatgccattctcctgcctcagcctcccgagtagctgggactacaggcgcccggctaattttttgtattttttttagtagagacggggtttcactgtgttagccaggatggtctctgtctcctgatctcgtgatccgcccatctcggcctcccaaagtgctgggattacaggcatgagctaccgtgcccagccattattgtttttcttaaccagtgttcttagaattgaagtggaagaagaagaggaaatcctcttgaactcttacaccacaccttcaaaggtaagtaaacagtgtttggacattgcattttacaagtaacattttaaaatagtttcacaacatttgaagatctgagggaaaaaatcaaccactctcatgcatttcctactatatttccacttatacatcttcctttctgatcatatgtctaaatgttttacataatggcagtccttataaacatatagttatcctgcttttctcagcacaacataaaacatttctataaacataatttctccataattgccctttttgaatagtttcatagttttatactataattgaataattcagttctgtgttggatcccagtgtgaaaggtcaagtagggtagtggaaaagcattgccttcaaagtctgagtcagaagacctaggtgacctggagtgagttgttttatctctctgagacagtttccttatccataatatcaggattcattcattcagttatccagcaacaactatgtggccaggcgcagtggctcatgcctgtaatcccagcactttgggaggctgaggcaggcggatcacgaggtcaggagatcgagaccatcctggttaacatggtgaaactctgtctctaccataaatacaaaaaaagaaattagccgggcgtggtggtgggcgcctgtagtcccagctacttgggaggctgaggcaggagaatggcgggaacctgggaggcagagcttgcagtgagccgagatcgcgctactgcactccagcctgggcgacagagcgagactccgtctcaaaaaaaaaaaaaaaaacaacaacaacaactatgtactgcactagacattgagtaaacaatggtgaatgaaacagacatggatgggctctgccctcaagaagctgacagccagtgcacaatatcccccatcttggagggcttgaagaggaaataaataggtaaagtatcaggccctatgcaatgtattcagtaatggtaactattctttatactaactaaataagtttgtagacattcataaacatggagtgagccttaattattcaaagtaaactacatcataagaaagaggtaatttacattgccctatgcaatgtattcagtaatagtaattattcttttttgttgttgttgttgttgttttgagatggagttttcctcttgttgcccaggctggagtgcaatggcacgatctcgggtcactgcaacctccgcctcccgggttcaagcaattctgcctcagcctcctgagtagctgggattacaggcatgcgccactacggccagctaatttttgtatttttagtagagacggggtttcaccatgtcagccaggctggtctcgtactcctcacctgcggtgatccacctgcctcggcctccaaagtgctgggattacagatgtgagccaccgtgcccagcccagtaattattctttatactaactaaataaatttgtagaaattcataaacatggagggagccttaattattcaaagtaaattacatcataagaaagaaggtaagggctgggtgcagtggctcatgcctgtaatcccagcactccgggagaccaaggcaggaggatcagtgaccagagatcatgccgctgctctacagcctggatgacaaagtgagaccctgtctcaggaagaaagaaggtaaatagtttagatatgcctgtggagagtaagagggccaaaaatgtgccccatgaagttgctaacacaaaaccaggtgcatataatattaaaagaaataattaggtgtttgttagagtttcttaaaattggagagactataactcatttgattttcctcctaaagtggttttctgagtccatatcccagtgaaggacacctccgttcttccattgactcaggccaagaaccttggagacctccttaaatcctttttctctcacaccccacatccaacttagctaccagtcctgtcatccctctccaggatctggccacctctcaccatttccactgctaccaccaggtccacagcatcattgtctcctgaatgattgggacagcctcctaactagtccattggcttctttctgccatatccacctctaaccacctctccacccagcagccagagtgctcctttccagcaaaaggtcaggttttcttgctcacatctctcccactggcttttcgtctttcctcctgatatgcaaagtttgaaccagcatatgtgaagttctgtaggagctggccccctcctccttctgtcctctttccctgctcccctttgctctctgcttctgccgtgccaaatatgggttcatttcctatgtctccttgtcagggaacaagcctgcctaaaagaacaaagcccttcttctgttttattttcttgctttatttttctccttattattctcttgctttattaccaccaaacatgttatatacttacttttttgttttagtcggccttccctccattagatggaagctccttgagaatagagactttgtttttacttgctgctgttttcccagcaccctggcatgttaatagttgttgaaagatctctgaataagggagtgtggttggctctctcaattgcaataccaatgggaccaccacggttttatctggttaacagcttcacagatccagaattttatgtaatttgtctgtgtatccagaattgatcatattccggagtctgactcatggtaacccagctgtcagtagactgatgcgtaagccaggtgcaaatttgtttactttactattgaagtagatacccttccaatgactgaaatcccatatttaggataccccattcctgctatggaaatacttaggagactaaattgtgaatcaaagtttgtgactgtgaggccgagtgcagtggctcacacctgtaatcccagcacttcgggaggctgaggcaggtggatcacttgaggtcaggagttcgagaccagcgaaactccatctctactcaaaaaattagctgggcatggtggtggtgcctataatcccagccactcaggaggctgaggcaggagaatcgcttgaacccgggaggtggaagttgcagtgagccaagattacaccactgccctccaggctggatgacagaaccagactccgtctgaaaaaaaaaaaaaaaaaaaagtttgtgactgtgaattccacgctaaatgagttggagtgaaatgttgagcaaacaatatgtccaggctagagatacgtaaaatgcttagaacagtacttatcacatggaaattgttcagtcactgttaggccatgcatcaatggcagcatgataaaatagtcaaagtgtggccaggcatggtggctcacacctgtaatcccagcactttgggaggccgaggtgggaggatcactggaggtcaggggttcgagaccagtctggccaccatggtgaaaccccatcgctacaaaagtacaaaaattagctaggcatgatggtgggtgtctgtaatcccagctactcgagaggctgagacagaagaaacacttgaacccaggaggcggaggttgcagtgagctgagatcatgccattgcacttcagcctgggcgagaaagtgagactccatctcaaaaaaaaagaaaagtgtgaatgttggcctttccatacaaacagtgccaggctgaggttgcctgacccttgtcaggtcttgggaacaggtgtccctctgctatagaggtaaatatgatatgtcagtgattttagcttatcactattaaatatttcacctgtacgattgacagctgttcttttgcttccgtgttcaccataaatctgctgatgatttggctgccatgtccctaacggagagaatgtgttagcctgaggacttgacgttcccatacccttggcaattatatttctagtaaattaataaactggcatccttggttataatttgattttctctgtgagtgtgagaatgtgcttaccctaggatatgaaaatatggtaccattggtgactacatttctgattaaaaatgatgaaaccggccactgcggtggctcacgcctgtaatcccagcactttgggaggctgagatgggtggatcacctgaggtcaggagttcaagaccagcctggccaacatggtgaaaccctgtctctactaaaaatacaaaaatattagccgggcgtggcagcgggcgcctgtaatcccagctactcgggaggctgaggcaggagaattgcttgaacagaggcggaggttgcagtgagctgagatcgtgccactgcactccagcctgggcaatcagagcaaaactccatctcaaaaaaaaaaaagaaaagatgaaactagccaggcgcagtggcttatgcctgtaatcctagcactttgggaggccaaggtggatggatcacctgaggtcaggagttcgagaccagcctggccaaaatggcaaaaccccatctctactaaaaatacaaaaattatcccggcatggtggcacatgcctgtaatcccagctactcaggaggctgaggcaggagaattgcctgaacccaggaggcggaggttacagtgagctgagatcatgccactgcacactccaccctgggcaaccctccgtctcaaaaaacaaaaacaacaacaacaaaaaaacatgatgaaattggcattaagtgttaataatgaatcgtatgagcttggttaaagggagcgcatccttgagaactggtactggagttggtgaacactattggatttcagccctgaggctgaggactagaacaccagactgtgccttgtttaccaaagtgctgtcaccttgccacgtcttgcgagacagactgtcattctctcaaaatatccctgccccacaacactggccgtggagtgttgtagcccactgtatattaggagaatcttttggagggatagtttgagaaaatgtgttaaaattataaaatcttttttttttaattataaaaaaaataaaggcagggtgtcactatgttgctcaggctggtcttgaactcctgagctcaagtgatcctcctgcctcagcctcctaaaatgctaggattacaggcacgagccaccatccctggccaaattcataaaatctttttctatcatttgacccagtaattctccctagggggaaaaaaaaaactcttctgaagaaataattcaaattatgggaaaagctgtatgcatgaagatacgcattttagcatttttttaatttaaaatcttaatttgccaaatcacttttcacctgagactcagcattacttgtaatcactgaaaattacaagcaacccataatccagcaatagagaagtaattatgtaaatcattgtaggtcagtttaattaaataacacagctactaaaaaggataaagacctgtaatcccagcactttgggaggccgaggcaggtggatcacctgagatcaggagttcgagaccagcctgaccaacatggcgaaactcacatctctactagaaatacaaaattagctgggcgtggtggtgcatgcctgtagtcccagctactcaagaggctgaggccagagaatcacttgaacacgggaggtggagttgcagtgagctgaggttgcagtgagccgagatcgcacatcgcactccagcctgggcaacaagagcgaagtgaaattccgtctcggaaaaaaaaaaagggaaaaagattgggtcaggtgcagtagctcatgggtgtaattccagcattttgggaggccgaggcaggtggatcaattgaggtcaggagtttgagaccagcctggccaacatgacaaaaccccatctctactaaagatacaaaaattagctggatgtggtggcgggcacctgtagtcccagctactctagaggctgaggcagcagcatcgcttgaacccaggaggcagaggttgtagtgagccgagatcttgccactgtgccccagcgtgggtgacagtgactccatctcaaaaaaaaaaaaaagattaaaaatgtaacagtgtgggaaaatgttgataattaatatagagtgaaaaaattcagcacataaaatacttaggtttatatttaaactaagattatgactataatttgtatattctaatttgtgtatttgtaatcttaatatacaaattataaggcaccacgcctggcttttctttttcctcctcagacatgaggtctcgccgttgcccaggctggtcttgaactcctgggctcaggtgatcctcccaccttgacctcccagagtgctgggattacaggcatgagccaccacccctggcctagaaaaatattaaaataccattaaggaatattcaaaactggttattatatcagggtagtagaataagggattttttttttaatctattttccattgcagctggttttgatggttttgaatctgttctctggcattctgtcctgcagttgccaccagctgaccactctgcaatataacttcttaaacttgcagccaggaggagccctagggcagggaaagctgcagactagctggcttcctggctgctatccaggcaaggattttgttttctctattacagtcgattatcctagactttagggagcaataggtctctggactgtaggtttcagcctccgttctgggcttatctttggattcttgttgatgagtcaaaaaaaaaaaaaaaaaaaaggagtgaccatcagatgtttgctaactcttcaagtatgagctcaaccttgttatctgcctggagtcatttcctttgaaaatgtatggtagactttgccaaagtaagtagtaatgtcccattccttctcaggaaaatgtgtacacatagatcaaaactatgcattgtaaaactcatatctgtttgaaaacatagaggtagggacagaaagtaaacatatgaaggatttgacaggacacattaccagcctggtggtcctttttggaaaatgtttgctttctcgtaattgccttcaaaatagggacagtgtcctgaatgttggttacagttgttgaagatttctttttgagattatgcttggatgatggggccttaagaagagaacccacccagtcctattttgtgccttcgtttggacatgttctcccttttcttccaaggtactatacacttaattagtattgggtctagtaggactgagattttgttttccttttttttccctagggttctcagaagcgagctatctctaccccagaaacccccctaacaaaaaggagtgtgtcaactcgtagcccccatcagctactctcaccgtcaagtttctctccaaggtatggatcataattcattcaagtgccataaagctggcctcccctcccctttctctggctatctgaggaaggctaacagcagagttattaattaactataggtgggcatgtacctctgcagtgaattggcttgaaagcctattgctctctgccttccttgctctccttttctttgtggaaaattactgtttcttacggtaattaaggaaactcactttccacccacttttctagggctcatttcctagatcgggaactgatatcttgtattgaaaacaacctgtctattcagaagtctaagagtcttaacaggtcttgtcagtagaggcaagtaggtttccacctgcttctgtttgtgttttgttgggtttctttttctttcttttcatctaaagtttttttttttaaagaaaagcacatatctttgttcataatgtttcataacctgtttattgtttccaagtcaggttagaactagtttctgagagttttcttgtcactgtgactctgccctgacttaattggtattttgtccctctgccaccattgcacataaatccacaaagatcatatgtaattttttgaaatccataaatgacacgtctcatattagagaattccataggcaagtgctctgctgagtagatgggtttttaggagtttccacatcaagatgaggctccggagcagtagtattaacccttcagggaaacaccaactgccaggagtcattacctctactttggatcacttctagatgaaccagagcttaagattgttcaactctatcactttttttttttttttttttgagatggactctcactctgtcacccaggctggagtgcagtggcaccatcttggcttactgaagcctctgcctcccggttcaagcgattctcctgcctcagcttcccgagtagctgggtctacaggcgctcgccaccatgcctggctaatttttgtatttttagtagagacgaggtttcgcctgttggccaggctgatcttgcactcctgacctcaggtgatccacccgccttggcctcccaaagtgtaggatgtcaagcatgtgccactgctctcggccttttcagctctatcactttagaaaggtggtgatagaagctctgcagtcattcaaggtgagtggtcattggattttttttttcttttctttcttttttttttttttttaagataggcttttactctgttgcccaggctggagtgcagtggcacaactatagctcactgtagccttggccttccaggctcaggtgatcctcctacctcagcctcctgagtagctgggactacaggtgtatgctaccaagcccagctaatttttataatttttgtagagatggggttttaccatgttgctcaagctggtctcgaactcctggcctcaagcaatctgcctgccttagcctcccaaagtactgggattacaggcatgagccagcatgcctggcagtaattggattttgaaggacagttttactttagggtagtctactgctgctttggggagttctcaggctttttggaagaaagctttctagacttaagagcatctttgcaacctggtatgtagggatggttcttatagacgtgccagcaccattgcaggagttatattctccaaatgtcaatacaatgctctgaaacctgtagatctgtttacaactgtcctcatgtgagcatcttgctgcattaaagggcctgctgtaatggatggctcatggagcttcccagggaagagcttggagaagctggcaaaatgctgcctagtcattttttaatgcacactaataaagctgacagcagaaactggttttgtaatgtatgaaagtaacttctaaactattcacgtagaggtggcactggagattgagataattaattgagctcattttctgtaggctgtgaaaagaaagaatgatggcattaattgcgatggtgccccacataaaactggttcccgcagagtttcagtgcattaaacaaagcctgttttaaatagacctctctgtacggcgtgtttacaaccagaggattagaagacctcactgtcatctaagcagatcagcaatatccatgtgttcttagaggtataatttaccagtcagggagtggaaatgtgagaacttggcagttgagcctagaaaaatgggaatgtttgcacatcaccagactgttaattcattacttacccacctccatagacactggggaaaattgattaatttgaatttcattttattgttgtttctaccttgaaccatattgtgagtttttatatatgctcagcaagttttagcttatccacagttgcaggctcagatgatgttccaataaatgctaaaaattcatgagaagaaaaaaatgggacttaaagtttgccttttaatcaattcagaatctggggatctttttgccttgcttagttttaatgccaagagaacgacaactttttaaaatacgtttctgtctctaaacttctctaaaaatgtttggtattcctcagcctggtattcctcagcccttcattcctgaaattccttaaaggtctgggtatgtccaaccccattaaactgattcaatttataaactatgaggccaccttccttttctccagtccccatttccaaaggtaacctcattttattcttctctccctttagatatgaacacagtaatattaacctgttttgcttccaattagtgctactccctcccagaaatacaactcacgaagtaaccgaggagaagtggttacctccttcggcttagcacagggagtatcttggtctgggagaggaggagctggaaacatcagcctgaaggtcttgggatgtccagaggcactaactgggagctacaaatccatgtttcagaagctcccagacattcgagaaggtgattgtttttccctttgaaattctggtggatataaaaccacctagaagggtgtagagtaacaaagcttcagctaggctggtagaacaagttccaaggttgcctttcaatgtatgagttggtagatgtcctcatggaagccctagtaatggagggacacgggcaatactatcagtgattgccccaagtcacttcactttgctaaaacgcacataaccattcccagcagcaaaaacttgaacgatgtaaaggaattcaacttaaagatattcatggttccttcgttagaagccttcttcaggttggccttgacttgcctaaaacctcagtgaggacttgagtaaagggcagacttggagatggggtggggttcatgctgattccctggaattgtgctatggggtctcctgtggccagatggaaggccagattcagcaaccaaatatcggaaaattggcaaaggttttagaaggtttaaactggccagatgtccaggcacccttcctgcttctgtaaaatgactgactttaatattttacaatgtgctgtattttctcttcttggcaagtgaaatgtcttaaacataatacttttttccacttctgggattgtagttctgacctgtaagatagaagaacttggcagcgaactcaaggaacattacaagattgaagctttcactcctttgctagccccagcacaggtaagagttgttctaatagttctcactaattaatattacgtttttaaatcgatgaccaagaggcatccttcttgcttcctttttcacttcttgtctgtgttctagtttgaacatctgtcttggttgaatttgggaaaatgggcccttctgaagaaagatttgtaagtgctgtctggttttgtggccagagagtgattttcttcccacttggattagagtcttgcacataagcagagactcaaggccttgtttcccttggtggtgagtcaggtagctccccggggatttcccacaaatagaagcattcacgtatcgagataaaaggacagcagcgacggtggggttttcagaatcttgttctctggacaatgactcacagtctctcccctggtttggtctcttgttatagacaaactgctgccaatagtatctttatatcatagtttaatctggcatatataccagtgctttctctctagaatgttttctaatctaaggggaaatatattctagaagtttctttaaagtacctttgtcaatgtttacattcaaagaatgatcagttggggaagtgatgcagaactgtgtcatagaaggaagtgttagaggacttggaaggaagtaattgagggaaggcagggaggcacaatcactgggaaagatgagacttcctctgttttctcccaagagtgggaacagaacagaggaagccatggagacagagattttagctcaattaataaagaacttcctgttaagaggttgtatggtatgtggctaaggatatggctctagagccaaatttctggtttcaaacccaagcttcacccacagtttgaccttgactaaattatctaacctttctgttgcttgttttcctcatctgtaaaatggatacagtaatatccacccgatggttgttgcaaggattaaatgagttaatacatataaaatgcctaagaatacattttagaacagtgcatggtatttagtaagctcaagaaatgttagctattattaagtagttatagctgcccaaagatgcagtgggctgccctggggtggtgaggacagggtggggtaggcatccaggggcaagttcccctacactagagatgctcacacttaggcagcctcctaggaaggctcaagtgctgggtggatgggtggacaagatgccctttcagagttcttccatcctgagagtcagtgatgacgcggtagtcacctcagggtcaaagcaatgccctgccaagaaatgtatttgttgtttgcagtttgttttgctattcaccctatcgacttcagattttgagctcctgctccaaagactgtcattcttatgctgtgaccttcctttggtaggagcctgtcactctgctgggccagattggctgtgatagcaacgggaagctgaacaacaagtcagtgattctcgagggagaccgggaacattcctcgggtgctcaaattccagtggatttatctgagcttaaggaatattctctgtttcctggacaggtgagattggaggagttccaccagaatgcaggcgcactctttacccctgtagtgtaggtgctgtgccatgcgcagctgctcctcagttcctgtctctgctgccatggggtgcagctggagcacatgccccagagcagacaccactgttgggattcctgtttcccccatgctctgacccaggctctgggacctgactgcgcagcctcaaatcccaactccccgctccatgaggtgcatgactgtgcacaaggtacttaaccatctaaactacagtttcttcactcacaaaatggaaataataattcttacctcataggattgttgtgaaaattagatcacttatatagagcataattattattactaatgcaacgcccttaattcgttttctacaaaaatgccctaagtttatgattacagaatgagagtagttggacaatgcttttaactgcctcaaaataatgtattccagacctcattgatctccactgcttagcaatcctgtttgtttttgtctttcaggttgtaattatggaaggaatcaacaccactggtaggaaacttgttgccaccaaactctacgaggtacacagcagtacccccacttgcctcttggtttgcttcagacaaagtatgtctggaagctgtctgttctagaaactggtcctttttaggagcccatttatttgttagtcagttctccatctgtaagtgggaacccacccctaggccaggggtcagcaaaccctttctataaagggccagacagtaactcttttagactttgtagctatatggtctctgtcacaatgactcaattctgcctttgtctacaaaagcagccatagaggactcttaaacagatgactgtggctgtgttcccataaaactttatttaaatagtgggctgcagccaaatttggcccagaggccgaaaggttacctatccctgctctaggcaacaatcctccagagattttcgtagaatgccaggaaaagtagcaagaaaccattctctcccatccttgcctagaagtacactgatactttaggcacctgttttgctcccacttgttgctgggtattttatgacaattgagtagtgacctcccattacctgggtttctttgccctctgagcagtatagaaaaatggcaggtcccatcagatccagggagcaagacagaggcacatccttcccctgccctctcgctcctccccactgtcctcccatcacacacctgcaccacccccaacctggtgccctcccctttccttaccaaggtgatgcctggcgcaagaccttacttgagcttttcccctgtttttagggtgtgccacttccattttatcagcccactgaagaggatgcaggtgagtttcggttcaaatattgttttgccaacaatgaggatggtagacatgagtccaggagtgcagtttcccaagcccaagaaagctgcagaagctgctgaagagcaatgtgaccaagcagtgagggcgccaccatcatgagttcgtaggttttttgtcacaagacccctggtctgagcccagtgagcgttggtcgtgctgtcgcctgagttctgcctacatgaagcatgttgtttaaagactaatgtttaacaggtatttttgaaggttgccttggaaaggaaaagatgtacgatttcaaaaagaatttatttacatgcagcatgggcagatgcggtggctcacacctgtattcccaacactttgggaggccaaggtgggaggatcacctgaggccaggagttggaaactagcctgggcaacatagggagaccctgtctctactaaaaattaaaaaaaatattagctgggcttgtggtgcatgcctgtagtcctagctaatcagaggctgagacaggaggattgcctaagcccaggagttcaaggttgcagtgagctatggtaacaccattttactccagcctgtgtgacagagcgagactctgactcttaaaaaaaattaaaattaattaattttttgaaagtataatgtggcatcctggattggatccttgaagagaacgggaacatcagtggaacaactagcaacatctgaataaagccaggaatttacttttttatttttctggctctaacactcaacctcgagaatccaggaatttagttaacagcgatataccagcattaatgccttaattttgacaaatgttcatggttacctaacatgttaagattaggggccactggtgaaagacacacaggaactctgtactatcttcataacttctctacaattctaaatttgttctaaagtgaaaacttaaaaataacttcctttttttttttgagatggagtctcgctctgccccccaggctggagtgcagtggcaagatcttggctcactgcaagctccgcctcccgggttcaggtgattctcctgcctcagcctcctaagtagctgggattacaggcgtacaccacacccggctaatttttgtatttttacaaaaccccatagtgatggggtttcaccatgttggtcaggctggtcttgaactcctgaccttgtgatccgcctgccttggcctctcaaagtgctgggattgcaggcatgagccaccatgcccggccaaaaagaatttctttaaaaccctagtgttatgtggtaactaatctagttgtggaaaggcaaaaagaaagtttgacaaactttgcttctaaatatttcaacataatttcagcacttcacagggctgaggtgggaagatcacttgagcccaggagtttgagaccagcctgggcaatatggcgaaaacctgtctctacaaaaaaaaaaaaaaaattagctcggcatggtggcatgtgcctgtggtcccagctgctcaggaggctgaggtgcggggatcacttgagcctgggaagtcaaggctacagtaagccgtgatcatgccactgcacttcagcatgggtgaaagagtaagacactagatagatagatagatagatagatagatagatagatagatagatagaatttatttatttcaaggtggccaggtgtgatggctgacttctgtaacccagcactttgggaggccaaggtgagagaattgcttgagcccagtttaagtttagcctcccggcacatagtgggtctgcatctctacaaaaaataaaaacaaaaaaaatcagcttggtgtggttgtgcacacctgtatagtccccactacttgcgaggctgaagtaggaggattgcttgagcccaggaagtcaaggctgcagtgagccatgattgtgccattgcactccagcctgggtgtcagagtgagaccctgtctcaaaaaaatatatgtatgtatttctgtatttcaaggcattgttttttttttcttttttttttttttagacagagtttcactcgttgcccaggttgtagtgcaaggcgccatctcggctcaccgcaacctccacctcccgggttcaagcgattctcctgccttagcctcccaagtagctgggattacaggcatgcacctgtaatgcctggctaatttttgtatttttagtagagatggggtttctccatgttggtcaggctggtctcaaactcccaacctcaggtgatctgcccgcctcggcctcccaaaatgctgggattacaggcatgagtcaccacacccaaccctcaaggcatttttgtaagcacagtggagcactgttaaggattagcaaccagatcactgatactagcatgttgtcaacaccccatgcatgtaacagtggccagagccattcttggagatgacctagaatcaggagtgaaatttaggaccttgtgatattgcacattttatcagaaaacacaagtttggccgggcgtggtggctcatgctggcgcaggaggattgcttgaccacaggagtttgagagcagcctgggcaacatggtgaaacctcatctctacaaaaagtacaaaaattaggccaggcgcagtggttcacccctgtaatcccagcactttgggaggccgaggtgggcggatcacacggtcaggagatagagaccattctggccaacaagctgaaaccccatctccactaaaaaatacaaaaattagcttggcttggcagcgtgtgcctataatcccagttactcaggaggctgaggcaggagaatcgcttgaacctgggaggtagaagttgcagtgagccgagatcgccaatgaactccagcctggcgacagagctagactctgtctcaaaaaaaaaaattagctgggtgtgggcatggtggcatgtgcctatagtcccagcaacctggaaggctaaggtgggaggatcactctcctgagtccaggagttcaaggctgccatgagccatgatcataccactactgcactccagcctaggagtgagagtgagatcctatctcaaaaaaaaaaaaaaaagaaaaagaaaaaaaagaaaatacaaatttatagggggcaagggtggcatgctggtattaggtcaacttcaggtaatgaaatcaacctggctgagataccaggagcctgagctgtgtaccagagaagcctttggaaacagtttaacaggttgttaatgaacttttgtacaaggaattaaatgaggcactcatggagatacagaataagacatggccctcgccctccagagactcactgcttacactggggctcacatctcctgtaggcttctcagagccaaacttaactttgtcccctaccccaccaccacatgaaacctgctcttcaccttgaatgctctgtcagttcatggtattattaccatgatagactgaatcacagccccaggaatccctggaacctgtgaatattttaccatttgtggtaaaggagactttgcccgtgtgattaagttaaggctgttgagatgggggattagcctggattatccaggtgggtccactataatcacaagggtccttataagaggaatggcaagagaatcagagtcagagcttagaaatgttaggctgctgtgatttgaggaagcctaaagaaaaattttatttcaaaatagagaaatcttaggcttctggctttgccgctgcaggtggggccatgaaccagggaatgcaggtggcctctgaaagctggaaaaggcaaggaaatggattcttctctagaacctccagacaggaggaactcagccctgcccacaccttcagtttaggatttttgacccctggaactgtaatataataaattcgtgggcttttttttttctttttttttgagacagtctcactggagtgcagtgggcatgatcacagctcactgcagcctcaacctcccaggctcaagcaatcctcccacttcaagtaactagaactataggctcaggaggtacgcaccactctgcccagctaatttttgtattttttgtagaaacagggtttcattatgttgcctaggctggtctcgacctcctgagctcaagggatcctcccgccttagcctctcaaagtgctggaattacaggcgttgagccaccacacctggccaaattcgtgttgttttaaggcactaagtttgtgataacttgttatagcaacaataggaaactaacacaacagcatgttaagaagccagggatctttggattttgttgttgtaagccacagaaactggctcagactaacaagaaagcaggaatttattaggggagatccaggtagctcacagactggacacgtggctagaaaccgaggcttggaaccaagatgagagcccaggaactctagcatccaggtagcaggaattccccagctgtctcatctgggcacctcagctggaataggttagctctaatcttttttctctccttggatcgttcacctcaagattgcagaccctgggaggagagtgtgaatggccttgtgccattctgggtcatgtgcctgcccttggctagaggaagacagagcacccaatttacagccccatgtagactgccttgtggagggatgggctgattctccaaaaggaaagcagctgctgttaggaaaaaggcaaagcgtgatgggtggcccctgcaccccatcaccctggagtctcccgttccagtctcccattccccggcctgtctttctgggctcttcagtaccccacattctccagccacactggacgaccagacatttcctaacactgagcacactcaggtctcagtgctatcctgtaccctgccttgcccttgatccccaaaaattctcaaacgtgttagcaaattccaccttggtaaattctttcctgactgccactttcctcgaatctttcatgtgcacagctcataaagtttctactgcatgttctaggtattcgtgtacctgcctgtctctgtctctatcacctagtggagtgttcttggagggtggacatgaggtcttccttaccttgggtccccagagtttcacacataaaggactcaatgagttaaatcctgtggcatttcccatcattgtcctttctcctcccaccattctaatactagtcctcttctaatcaagacctataacctctgtcttagactttgagcaaagcatggtcctggttgcctgtggaccatacaccacatctgacagcatcacgtatgaccccctgcttgacctgattgctgtcatcaaccatgaccggccagatgtctgcatcctggtaagaggcaccagtgggaaagctgaggagtcagccttggaaaatggctttaatgaagttctaaatttttaggaagcatgtcagtccctcctccttttagaaaatatcttttcattcttaatctacatctttggagaggtatatatatctatgggcctttgctagatttaaaagcccaactttggccgggcgcagtggctcacgcctgtaatcctaacactttgggaggccgagatgtgtggatcacttgagggcaggagttctaagccagcctggccaacatggtgaaaccccatctctactaaaaatacaaaaaaattagctgggcatggtggcaggcacctgtaatcccagctacttgggaggctaaggcaggagaattgcttgaacctgggaagcagaggttgcagtgagctgagattgcaccactgccctccagcctgggcaacagagtcagactccatctcaaaaaataaaaataaaagcccaactttttttttccacccttcgttgattttacagtattcttacttctttctcattactccaacttctgaactaatctctttttaaagctcaaaatactattattagtatggtgatcaatttaccttgctagatttagaaagtcagaaaacccagtgtgcatttttattgttcgtttgttttttgtttttttttttttttttgggacagagtttcactctgtcacctaggctggagtgctgtggtgcgatctcggctcactatagcctccacctcctgggctcaagtgagcctcccctatcctccctgagtcttccgaatagcttggactacaggcacacgccaccatgcccaactaatttttgtatttttttgtagagagagggtttcaccatattgcccaggctagtcttgaactcctgggctcaggcaatctgcccacctcagcttcccaaagtgctaggattacagatgtgagcccagtgttatagtggttatggggctctgggagcctccctccatctggggcaaacgtgtttctgcctgtgaaattggcttggcgccccgccagcccatctgctaactgtccccaggctctacaggcagccttggagggacagatgagccctccacagagaactgccagaggaggtatctgaagtcattcacagacacaagtgattctgatttgttcttttggtgtctttgtttctccccttgcagtttggccctttcctggatgctaagcatgaacaggtggaggtgagtgggctggggtgggaaggggtcctgggtacttgaatccagtcaggctctcacttttcattttttagtgtttatcccacatctgtaacaaacacattaagtcctgtggctaatcagaaaatcattttagcagagcactttattaataaagatctggaatccaagggcctcctttcaccagaatacaaggctgtctggaagctgggggagggacatataagtcctaatgttcctttgtttgtgatgcctgctgctaaggcacaagagcactagcacaaatgcaggtgtctggcagtcatgggctgccctgtgaaagaacctgtcctggccaataccccaagcttataactcatcttgctgtcctttgcataaaacacgaatggtccttcctgggacatctccatggctgaggtctgggacctccaatccttcgtctcacgatactttaccttccatggaaaatatttcaaagtactctttcttttagtctctctcagattgcattcaagagggttaattcccacatctcttctcctcccttcgactagacttagctccttaagacaaagaccatgtctttttcatctttgcgtctccttcagctcctagcccaacagctgacttctatgggtcacctaacaatgttaaacaagtgaataaacaccaaacatctgccgtctaaatctgtctcctttcctttcttgcagaattgtctactgacaagtccatttgaagacattttcaagcagtgtctacgaacaattattgaaggcacaagaaggtcagatttcaaaatactggacagaaccttaagcttcttaggtttctccagagcttcccattaagaaactgaaactgcttaaaagtcgtggcagggccaggctcagtggatcacacctgtaatcccagcactttgggaggccgaggcgggcacatcacctgaggtcaggagtttgagaccagcctggccaatatggtaaaactctgtctgtactaaaaatacagaattagccaggcgtggcggtgggcacctgtaatcccagctacttgggaggctgaggcaggagaatcacttgaacctgggaggcagaggttgcagtgagccaagatcgtgccgttgcactccagcctaggcaaaaagagcgcaactccatctcaaaaaaaaaaaaaaaaaaaagctgggcgtggtggctcacgcactttgggaggccaaagcaggcggatcacctgaggtcaggagttcaagaccagcctgatcaatatggtgaaaccctatctctactaaaattacaaaattagctgggcgtggtggcacatgcctgtaatcccaactactgcggaggctgaggcaggagaatctcttgaacccaggaggcagatgttgcagtgagccgagaccacaccattgcactccagcctgggcaacaagaacaaaactccttttccaaaaaaaaatcatggcagttcctattctttccttccttttgaactaccgagatcagctagaacccttgaacttcaagtgcaagttaagaggcatctctgtaaaacacaaagataaacatacttgacaaggctgcatcggctctcactctttggttgctctttctcttctatacttagttccttttctcactcccttttgtataaactaatattccacgggaatcttcccaggatggttttgagaagtgtttgatgacttacgcagtgaaatcctgtgagaccccaaacatcttgttgtgtaagtgattgtattgggtaagcccaagttcctcccaagtcagtgcttccccagggtgcgtgggaagctgccagtggctacagctggtggtgatagaaactctcagtgagggtggggccttgaatccttgccatagaccaaacggaaggaactgtgagaggttacagcagtgatgagagagctgtgcagttctcatttgagaggaaagtcactgttccaggaagaggctaaagccggaagtggaaagttattcagaaatctgacatcctccattcctgtcccttttccccagtgccagggtttgaaagaagttggtataggtggtagatctcctcacaagatctgcatgcttgtagctgagctaataaaatacaaatattcctgaggctaagcatttaaaaacgagtctgtcacaaaggtggtttttaaaataagatgtctaaccttccgccttttagccatgagaactgatcccagaatcaataagttgtaacattaccttcttgtaccagcagtgtgggccaggatggtagatgtcacagctggaataaagaacatcccccaactcaccccagaatcagagacttgggttgtgccagtgacaaccatgtctggttctgccctttcctcccctgcctccctcagatgaaggtgatgcaggtgccttccctcttccccagatttgctgtgatcctggtcaagttcatcaggcctggagagtggttggaactcctcaggagatagacccccaaaacacaggagcagggctgtgttcttttgtcagcccttggggataggcagggactgtgttgtagtgccctaacactggctgggtgctttcagtttgaggtcgggttctgtttttggttccttaccccgtgtggtattgacagcagtgatagaaataaagcacagatgaggcattgtcacactggggatgagagcccagcaccaccaggcactttcatctatggccagtgtgtgccacagggcagggggagctgccccacccttctagaaacagtatataaacagttcttgggcagagaatttctttgtattcctgagaggtcagaaatgcagagcattaagctgagtcatcattagtaaaagtcagagccaggctaagcacggggctcacgcctataatcccagcactttaggagactgaggcgggcagatcacttgaggtcaggaattcaagaccaacctggccaacacggcgaaaccccatctctactaaaaatacaaaaattagccagatgtggtggtgggtgcttgtagtctcagctactcgggaggctgaggcagaattgcttgaacccaggaggtagaggttgcaatgagccgagatcgcaccactgcactccagcctgggcgacacagcaagactccatctcagaaaaagaaaaagagccagtgagaaagcacctcagagaaagcgagcagagcccgcggttctcgtcctgtttgcgggagcagctggaggaccctcccgctgtgacgtacgaggttgtgcaatgctgagcatagttgggatgtttttctgatccctccttctataggcgctttctaaccatgagcaggaaggctatttcctccttaactattgcccttccaaagcctacactgaaacagggcaattttgtcccttgagagcagccagctgcacctcagtcctttgtgtttatcacagatgtcaagcccttgagatgtggagcacagattgtcccattcaagttaccctgtggcctgtttaccagaccctggcacccaaatggtggactggatcaccctagtgagcttctcagtgtcaaagggacaataatgaatatgcaaacacctttggtctcaggattctgattttctgttatagacatctcagttcacactctgagaggacaccacaaacagtgataagggtgacagctgtcaccagcacctttatcacatgtgaaagtgtatgtatgcctgagaagtccacatgttttaagcaagagacagagatggaagtgagagctattggtggattttaaacatgcccgcaaagtaataccttatgcctatttgatttataaacggcccctctgccaaggtcatcttaagggaaccaaggaaacggggctttcttcctcttttgtgtggctgggaaaaataaatagttggcccccagagttacaactttcttcttcacttgtatgttgtaaccctagagattctcctgctccatcaaaggaaacatctgctgtcatctgtgcttttactgttgctgttaaatatttctttcatttttgcatgacaacctgctgagaaatagaaactcagggcattatttccatgtgtgagaggggagggatgcgatggctcagggagaggccgcttgggcttttctgcctcccactggaaatgtctgtgtctcggttgtccagtaattatggcccagtgttcagtcagtcagagggtttcagctggatcttctaaatacgaagccaggccaggtgtggtggctcacacatgtaatcccaacactttgggaggccaaggtcggtggatcacttgaggccaggagtttgagaccagcttggccaacatggtgaaaccctatctgtactaaaaatacaaaaattaggtgggtgtggtggtgtgcacctgtagttgtagctactcgggaggctgagacacaagtatcacttgaacccaggagatgaggttgcagtgagcccacatcatgccactgcactccggcctgggcgacagagtgaggctctgtctcaaaaaaaaaaaaaaaaaaagcagtctcagggtctttttagtatgcctgccttctccctaggaaaaatgccccagctccatgcaccctaccaaggtgtggcagggacactgtttactgcctgcaggctacacctgcttagaaggtgtaatgagtccaagctgtggtttaaactctggctctgaggctgtgattctttattcacatccttgtctttctagactttctagatctccatttctttgcccctttttctgccaaaaaatagtctccatcctctcagtagaaagccacacagagcaacaagaaagtgtcccaggcaatcggagcctgtccagatggatgggtgtgaagtagaacaaactgtcctttactcccagtgtcccatgggaaacagcgtctctgttcataacagagtgcagttctgagctgcctccctcggggtgggctctgcctccagcctgaggcatcccacctgttgcgcagctgttctaactcaactgcactcacttttctcactcttctgtttgttcttttgccatactagctccggctcccaccttgtctttgtcccgtcattgagagatgtgcaccatgagcctgtgtacccccagccgcctttcagctactccgatctgtctcgagaggacaaaaaggtagcagcacccactccttgaccagcaggcagccagaatccagcatgcctctgccactagctctggccctgaaggggagggtggagaggcctctttagggtgtgcgtacagcctgaatcttaaactcctttttttaaacaggcaaatgtgtccaaaagcttgatgtatgttggtttggtccccctttccgtggtctccccagccctcagacaacccccactttcatgggaagatgtttctagctttggcatacaaatgtttgtttcaatccgttctcattttagcaagtacagtttgtgtccgagccctgcagcctctccataaacggagtgatcttcggcttgacatccacagatctgcttttccacctgggggccgaggagatcagtaggtaagaagtgtgttccaggccccaagcaggatgactggctttctggtcccagccctttctgcagccaagaaaatcaaggggctgcttaacggtcttgaccagagagagctgaaagcagcaagctgtgccagaccctctagccatctgagtttctctgtacccaaggggaggggttggatgcattagtttctgttaccacctctctaaactgcgtttgagaccccaaagaaccacgtccattctgtctttgcacttaaaggcatcaaaattcatctacattttcttttctgctccccttttttttcatttcccaaatttgtgacctgaaaacaaatgtggacatcctgtttgtggaggataaactgggaattttctctgaaggattttcttcactaccagtacaacatccagctctgcagagaatcaggccctgacaaatttgttgagttgaagttgggcagctccgttctgccgtcatccttgatgggaaggggcatgtgaagcgactcgcgtgtgaagcgagacgggtgcggctccttggctgaggtttgagattcaggtcagcctggctacacacccgcctcatgatggtgccaactttgcatcctcttgcacagtacggtgctggctaatggccttccttgatcttgattatgagggattcctgtgctttcccttctcaacctggtgtcctgcgtccctcctcatgtggggacagactgagctccttgtgggtgggtctttaaacttccccagaggcatcctcctcttgttgctgtgccttggccatttaccttctctctggtttattaaattctccagtcctccctgaagagaaatgggctgaaaaacagagttctgttttcatgctttcttttctttcccagttcttccggaacttcagacagattcagccgaatactcaagcacatcttgacccagaggaggtgagcttgccgctgggacccctgactgtggagagagtgccttggggtcatggagctatgacaagcatgactgtaagagccttcaccaggctaccagcagggaactttaccctgtgatgacaagcctgcattctgccccacacacacagagaaaaagtcggtctgtggatgccagcagcacgaaagccagtacctagggggactctgtctgagaagggggccccccggtcagctagtgctgacaatttctctctgtctctgtagctactacccactctacccgccccaagaagacatggccattgactatgagtcgttctatgtttacgcacagctgcctgtcaccccagatgtcctcatcatcccgtcagagctgaggtacttcgtgaaggtaggtttgaactctgctttttcccagaaacaccagaacccagtctttgactttcccttctagaccacccggcactcacccctcatgggtcagctgatggggatggggcctctagcaccctgccctgtggccttgtttctttggggaggtggtgggaccagaaaacaaacaactctgtcagtaaaatgcttgagtaaacagtgtcctctcctccctccccaagagaacgagagcccagatgactaggaaggccctcaaatgagggctttcaccaggccacatagaggtgacctggggaagatttcatatgtacacttgcctgtcctctgcctcccaaattctgatatgacctccaagtgggctcagctgggaataccttgaagaagctattgggtcattttgatctctgccaccctttagccctgcctgccttggagttaggtcccttacaaggaatctgcctagaccagtccccctcttgccaaacaagagttagttcaatctcaagaggttaaaaaaaagtttttcacatgagaaagcagtaaacagctagatcaggtttgtctccaagtttaggagctgattgtcattctgccaagtcacctcattcttctgtttgaaagacttaaaaggaattcaaagctttctagtgacaagttaacatatgtgactgaggccgggcgcagtggttgacaattgtaatcccagcactttgggaggccgaggtgggtggatcacctgaggtcaggagtctgagaccagcctggccaacatggtaaaaccccatctctactaaaaatacaaaaattagccaggcatggtggtgtgggtgcctgtaatccaagctacctgggagcctgaggcaggagaatcgctggaacccgggaggtcgaggctgcagtgagctgagatctcaccactgcactccagcctgggcaacagagcgagactccatctcaaaaaaaaaaaaaaaaaaagtgactgaaaatgtgtctggtgatttggttgccttcgtttccattttctaaaaccctctttggggtccagccatgtgatggcacttctttttcacattggttcccagttagttgaggctctccaaacctgtcacctctcctctcctccccaggatgtcctcggctgtgtctgtgtgaaccctgggcgccttaccaaagggcaggtgggaggcaccttcgcccgactctaccttaggaggccggcagcggacggggcagagaggcagagcccatgcattgctgtgcaggtcgtcaggatctgaggcttctgtcctctgctgttctctgctgtgtgggcccttaaagtcttagccaagagccaagacatagccctgtgacaaggtgaacagttgggtgggaaaggagagaggagccagccagggaggggcagctgcagtgaccaggcccagcagggaggacttgtgcagccgggcctgcctctgagtggtgcctctcctggaaggaagctcttgcttctcagtccatgctccgtgtccagaagtaagccagctgtggatcccgcccactcagaaaaggcgagaaggctttgtgattttctacatgaatcaaacacagaaacaacttttggagaaattaaattctgagtgtgacttctgagtttgacctttcttctattttcttttatttatttattttgtttttagacggagtctcgatctgtcgcccaggctggagtgcagtggtgagatctcggctcactgcaagctctgccgcccgggttcatgccattctcctgcctcagcctcctgagtagctgggactacaggcacccaccaccacgcctggctaattttttgtatttttagtggagatggggtttcaccatgttagccaggatggtctcgatctcctgaccttgtgatctgtccgcctcagcctcccaaagtgctgggattacaggcgtgagccaccgcgcccggcccctttcttctattttctttatcctggtagtagacaaagaatgttgcctatttgacctatgtccagagaaggcagagtgtcagtcacactgggtttctatccagccccagtcctgtccagtgggtaactctcagccccactcctcatcccccaaaggccccagtgacctctatgctgcagaggtgcactgggtgggccctagagctgggctgcagagcaagcaactggctgcatgcctgggcctccctgcgcagttcctcacatgcatgctgtggtcccagcctgacctctccatctggagggggccgcctcgctgggctgttccaaagctggagtcctggtggcagctgctttgccaagtcgcgcagtagccagggcttgcctgcagcccagaacactcagacagggtcaggccttccagggttcacagcacgtcccatgcccctatgtcctggcatctggggaaaagctgtcactggccagacgtggagtggcttcctgccctaagctggcaggctgtcctgcctcacatgccagagccaagaccggcaaaccccagctgtcagggcagggaagtgggcaagggggcagcaagctgctggtgtctatgccttgactccgagataaatagatgacctaacagtggccaacttttgcctctcacctttctgacggtgaaatggaatcgagccccagacctgaccagggtacagtaaaaggtcttcctttaaacacaaggagcagctgttttatttcattagttttataggcacctcctctgaggccaagaattagaaactcatccctgcgtggggagtggatttttccgttctcccccagctcctccacacatgaagcagccagctgtgttccacgggggcaccatgacttgtcagcctccggatgtggaattttgggagcccaggcaatggttgcctggataccagtcgtgtgactgttggaaatgatctgggagggccgggagggccggagcaggcatttaagagtcagacaaagagaaagcgggatgctaacaccagagcagacaggtctggcaggcgtgcctctgccaccagacagttcctttttgctcttgtcaggaaggtgccaagtgactgctggctgaccgtccctagaccccacttcagctgtgtcaccagtttccccaggcatctgtcatcccaggtattctcaagcaggctctgggggcgtgtcagtgacggagggtgggagggtgcccaggaggtcaggcccgtctgcctcagccccctttggtggcctctccctgatctggtcatggcccctgcccttgagacaccaactagacggtcctgaagaaatagtcccgagctcttgccaggatttgcctcccatgcccatgcccttgccctgcctctgccctggcagaaggagccgccctcccttacccgcctcgtggcttccctttagggttccagtctctgagagggagagggagagctgctgagggaacagaagccactcctagttgctgttcctgggaacccaagtgggtgccaagaatgcagcgagggaattagggcctcgaggggcacccaaggttgggggccggcagggccatggcgcggatcctccatccagctctgccttctgcagccactggggcttggggtttcctttcctttgacctcagggcacccggcccagctcaacctggccttgctgcttcactactgctgggagtagccatctgcgctgatttctcactccaccaaccccaccccgacagagtctcactctgtcgtccgggctggagtgcagtggcgcgatctcggctcactgcaacctccacctcccaggttcaagcgattctcctgcctcaacctcccgagtagctgagattacaggcgcctgccaccacgcccagctaatttttgtattttcagtagagacggggtttcgccatcttggccagactggtctcaaactcctgacctcaagtgatccacccgcctcagcatcctagagtgctgggattacaggcgtgagccaccatgcccattttaaagtgtatgattcagtggtttttagtatgttcatggtgttgtgcaggcctcgccaccatctaattccagagtattttcatcaccccaaaggaaaccctgcacccattagcagtctaatcccatcccctggcaatcattaatctaatttcttttctgtagatttgcctattttgggcattttgtataaatggaatcatacaatacatcctctttttttttgagacagagttttgctcttgtcacccaggctggagtgcagtagcgcaatctcggctcactgcaacctctgcctcccgggttcgatggattatcctgcctcagcctcctgagtagctgggattacaggtgcctgccaccacacctggctgatttttatatttttagtaaagacagggttttgccatattggccaggctggtctcaaactcctgacctcagggttcagcctcctgagtagctgagattacaggtgtgtctagaactcctgacctcaggtgatccactcgcctcggcctcccaaagtgttgggattacaggcatgagacaccgtgcctggcccatgctcttttctgtcaggttttgtttgtttgtttttttgtttgtttctgagacagagtctcactctgtcactcaggctggagtgcagtggcacgatctctgctcactgcaacctccaccttccgggttcaaacgattctcctgcctcagcctcctgtgtagctgggattacaggcacccgccaccgtgccaactgatttttgtatttttagtagagacagggtttcaccatgttgcccaggctggtctcgaaccactgacctcaagtgatccgcccacctcggcttcccagagtgttgggattacaggcgtaagccactgcacccggcctgtcaggtttgtttcacttagcatgatgttttcaaggtttgtccctgcagcagcatgtatcagtccgccattcttttttatggctaagatcccactgtatggctatacggtattttatcagtgcatccactgtcgggtttttccccttgtggactattatgaatagtggacgcttgtgtgcaagctttgtgtgaacacctgttttcagttctcttgggtatgttcctaggaatggggaggggctttagatttacgaaggaagacaaggcaaagagagggagggaggagggacagagggcgagagaggggtaaaagaaaagagggaaagggaagggaggcagtgatgggcccggaatggtgcttcagagccagattgtgaagtcttgctaaggcatttggacctgattctttctgccccagagaatcttggaagggtttgcctcccaccccctgtgcctcaccctgaccacccaacaaggaccaacttaagaggagtcccaggtgcagcctcagtacctggtagcatgtagcaaaggggtggtttgaggggagaggggctcaggggaggggcctgggtctgttggggcaggtcgggaggaagaggggcaccaagtgggccattggaatactggaagcagcactccagtgagacatgggcgttggaggggtagatgtgggagtcactgcagtcaaaagccacagaactgggtgctgggagggtggccgagagatggatgggcaacatccgcaccatggagaggactctggccagcacttgcacttagcatcactgatcaacaaggcaaaagggtgggactggcctgggggcaggggagggaagagggatggcaacagagaggtgctgggatttctggctaaagagaccagaagacacccatggttgttcatggcaagactcccagctgcattcaggcatttgggaccttctgtcaccgtcattggtcattctgggtcttcagtccccaagcgaccatgcctactgctgctttcgtgggtcagccctggaaatgcccaggggcctaggggctggcctgccctcagacccagctggactgccgctggctctgaattcctccatcctgccccgcctcttcccggggctctaggctcctccccacccagagcctgcctgacagctgaggccctgcagctgcccaggcaaaggggcccctgggaggtctcagggacagctgctgcccataaccttgctgaccctggcccctgcacactgctccctgagatcccaggcttctgcccagcagccagcaggaccctaccaagccccatcttctctgctcactcccatcgctcccagatcttcccaggggctgaagcattttgggctgagcattttcgtgctgagtcagcaggccccacccaaagagtgagaaaagctgctgggtagaggcacccctagccccgctcctgcttcagaggaagtgcctttcaggggtggatgaggggtacacctgcctccgtcaggcaggcttggccctgttcaacagggtggggaccctgccctcccaccacctgcctcctaccacagaacagggcacaagggtggcacaaggggaaaaaggagaaggcaccatcactcctgattcccagcgaatagggggaaaaggcatactcactcctgattcctggcagcttcttcccttgaaggtccactttcctcctgaggactcgaggccccttcaaattgccccttagaatgtttctagtaatagtagttgcctctggggacgggtgtccaagggctaggggtcaggagtaggagggctcagagaacgatttgtcatgtccacactcaacctgtttgaatttttttttttatttttttggagacagagtctcactctgtcgcccagtctaagtgctgtggtgccatcacagctcgctgcagcctcaacctcccaggctcaagtgatcctcttgcatccgcctcctgagtagctgggaccacaggtgtgcgccaccacacccagctaatttttgagtttttgatagagacagtttcgccacgttgcccaggccagttcaagcaatcctcctgcctgagcctcccaaattgttgggactacaggcatgaaccaccacacccagctgtgtttgaaattttttaccatgtgtctggattactttaaaagaaggtgggggccaggcgcggtggctgacgcctgtaatcccagcactttgggaggccgaggcgggtggatcatgaggtcaggagatcaagaccatcctggctaacacggtgaaaccccgtctctactaaaaacacaaaaaattggccgggcatggtggcaggcacctgtagtcccagctactcaggaggctgagtcaggagaatggcgtgaacccgggaggtggagcttgcagtaagcggagatcgcaccactgcactccagcctgggcaacggagtgagactctgtctccaaaaaaaaaaaaaaaaaaaccgaagaaggtggggatgggcacagtggctcatgcttataatcccagcaatttgggaggctgaggcaggaagatcacttgagcccaggcagtggagattgcagtgagctgacattgtgccactgcgctccagcctgggcgatagagcaagactcagtctcaaaaaaaaagagggggtagagtggtgggaatagacatatacaaatgtttatatgtcgatccagctttctgtaagcactccacaccccacagctgttgtagcatccacctccttgggaggcaggctctcagaatccctgctccctgagggcagggagtgtcatgttcactgttgtctcactggtccctagacagtgcttggcacatagtaggcccacaaagaaactcctgcagaagcagtgccctcctatgacatgcctctccaccttccagaagcaggcagcttggaaagaaaagaggtgggaggcccacctgcagggacagcacaacacctgctaagggccctgcaggttgggggtctctcctcggcagcgggatgcagaaatgaatgagtggacagaatctctgctgccacccagagctgccactccagcacagaaacctgtaaacagtggacactgcagagcatcagatggagtcaagtgtgtcagatggagaaaaccagagcaggccaagggcagaggtgcctggagttgtggtgggtgctgcacagaggaggggtcaccagctcccaacttttatttcctaaacatgtgtctcccatacaccctcttcttgctatccccggcatcctaccatccacccatccgtccacccatccatttacctaaccatccattcttccatccatccgtccatccattcatctacccacccacccatctatctatccatccacgtaaccatccatcctttcttccatccatccatccttccatccacccacccacccactcatccatccatccatagacttaaccatccatccattcatccatccacccacccatgaacttaaccatccatcttttcatccatccatcaacccacccatcaacccacccatccacccaaccatccacccacccacccatccatccactcatccatattcactgggtgcctaccacatggcacacactctgggggactggctatgatccaatggaaaatggacatgaaccaaatgacaacgccacggagaggtccatggtccagagtttcccacggtatcacaaggtgacccaacatcaatgggggtccagaaagcttccctgaggggagacatcacagctgagagccacgggaggcatgggggtggccaggtgaggtggagggagcaaatcgcagggctcatggaggagcatgtgcagggacctagccctggaggctgggcaccgccgacagctgacaggcacatgttcagggcagcaggcatggagcactggctggaggctgaagaggctagcaggggccctgctgcaggtttgtgaccatggcagcacacgaacagggcacgtggcagtcagagtggtgtttttgtctatcaccatgtggtgtggagaataggcaggcagcacatcatcctggcccccaaaacccttgcgggctccattctccccccacccccaccctgtcacccaagttgtaagcctggactgggcctgactcccccttcttcctccatggccctccatgggggctaacctatcacctaatctcagcctttcaacttcatcatctccatctccagctctcacaccactcttcaggaccaaattttctctcccttctacgctaactgtccccagaagtggcctctgcctctagtctggcctccctccaggcccccctctccaaagctgcccggcaccacctctgcagaaattctgcagttcattcaccaaaaagaaacacatgtggctcttaagcaaatgaaaaggtgaccagcctcacgcatcgtaagagaaacgcaaactctaactacacccaaattcctttgttttgtttagtttttgcctttcagatggacaaaaatcaaaataggtggaaaccaggggctggtgagcctgaggagaaacagccctgttgactgtgtgggggcctggtacctggcacagtctccaagaaggacaagctgacagagctgacaaaatgaccactgcaagctgggcacggtggtgcgtgcctgtagtcccagccacgcaggaggccaaggcgggaggatgg

SEQ ID NO: 362 - DNA, 166118 bp, Homo sapiens
attgcatttctggacgcttctagacagtgttcatacttggctgtctggtttcaccaggaactctacccaaaagaggaaacagcaaggagaacatttgctttgtttgtaggagggaagttgtcgagctacaaacaaatctttaggcatctgaggaattgctaagtttctaatttcatatggttgctgacaaggaggtgcagacaaggaccctcttgctttcctcactatggatagtctgttgcctccatctagattctcttatttcaaaaaatatcctctccatgcaattaggagatatttatcgacgctgagaaaccaaagagccgaagaacaggtatcattttgtttatattatctttaaaatgaacgggtgcttgttccttgttgcttttacgtcgcttagtgatttcatttgtgctggtttacatgtttataggtacaggtcagatcctgcttgtggctgttcagacttggcaatcagaaagcaagcaggcttgtgagaatttatttaaacttggaacattcagatcctgagattaagcggagttctgtaatgaagccacatgctttctttcttctaaagagctactctatcaaagttaaattttgaattctttgatcattttccaatgcctcagatacaaaatttgacactattaatatctcaacaaagaaagtatcagaccctagaagtacacttgtcttcttgtatttatggttatgtttacatagccagaatttgcaaaacaaaaaacattttataaactataataaccttaaacagatcattaacaagctataaagatcattcagaagcagttggtcatttttgtgtgtgtaaaaggtaggaggtagagcactgccatattcagtctttttagccaatcaaaagctatgatttccagcaggagacactatcacttgggaatataagcatttttaaaactgttaaaatgtctgatcacatctcatttaaaatcatgcagtcatttttatggtgtgagatttatatcattccatttctttgatctccaaaaaagacatttctaaaaatgatttttatgaattttaccaaattgttagaagaagtagcaatatctgatccatttaaatctagtgattcatttaggaagaagtgtggcggtggtatacaaatgtgaaggacaaatgtatagccataccaaagacccagcagtcataaattgcttgtgcattgtgcttgtaactagaactgcaaaactatgcaggagatatcaccagtgtcctgtatttttttctcctttgtgatatgagatgacccacttaataaaacacttccaggaaatgcaagataggtttagcagacagaaaatcctctcatgacaggtttcccaaaaaggcaatgcataatttggaaaataaaaatcattgctactgtttgagaggaaactgcttgtatgccctgctttaataattttacaagggccagaaattcaaacagactctgttcactaagggagctaggctggtccagtttatcttacttaggcaaggtgtcaccattaaaagaccaacttttggtttccaagtttcagcctgcacttgcttttgatgtagaaagctagagaaccaagtggtagggctgtataagtttttgtttgccaatcttttaatgttcacgggcttcttcaggcctcatttattatggaaggaagagaggtggctgaaaggatgggaacacaactgtggaatgtgaattgagtgattttttttttctcagtattgtaagttttcagagatgtggctatattgcttgtgtagttctatggttctttgtttttagtttattgaagaagtattacaaaatgcattcagaagaccattagaatttaacataaaacctctgacttggacagggtgggtagtcccttccccagtgtacaaccatttgggacaacctaggaacagctgggagtgagtattatgctgagttcttaaattcttatataagtgaattgaataattaagagaaataatatatttgatttctttttaaagccaactacagctctgcagacctaatgtctcacagaattagagaaattaggtcagagttcatcataactaaccttgaaagcttgttgggaagttataaaggaggttaataatgtctacaatcttatgacctgcatatttgttgcctctaatccttacattcttgtataactaatccttgatataaaagtgaagggattgagacttagagcccttaagagcccttgcccatgcagctagaaagtaccagaggaagatgtgaatttctatctcatggctttaaattttattcattttaccacgcttgatccctgaacaatctagtaatagcaaaatatcaccctgctaacttttctccttgagagatttctaaaatttcctatattcacatagcactgtcataatttttactgtttaccacatctgtatgattaattcctcaatatttttctgtatttgtacttaaatcacattattagagtttatttagaaaaaaagttcatatcatgactgtaaatggaaaaccattgtcattagccgtaagtaaaaataattaataaaagcaaaacagtattaaattctaggtagatactattgcctgtaaaacctccaagcctgaaacctgctcatttgttaataaggaagattagcttttaagagaaaggttagagcatcctaggagccaactgagaaagtttcctgggtgaggatggaaaggaattaaaaggtagataatgtttttcaatccaaaatgattcagtgttattgaatgtagtgtctgcatgccacttaaaatcttctcccacctcacttagcgctgctaagtaccaaccatgttgacttccacatacttggggaatattataacagaacaccatctgcttctttacttttgcacatttaaatgaactcccccctctagcctagaattctctcctttacttacaacttgccctcctggaggtctcctgtacatccttcaatacttggattaaatgggctcagtgaaaagctttctccagtgctgctgggaagaatgaagtcttccttttccaagatattttgtttgcttcagacacagcccttactacattctatgtagtaaatcatgtgatttcatgtcgatattcgtgcacccatgcacacatgacactggatgttatcttgttctttgttccctgaggcatactggagcctggcagatactggtgtaaaggtgacccacacaacaggcagagggtacacactggattgactgtgacacagacctcctttgttgtttttactaggcctagaagttccccataccccttttctgtggtccaaattatgatcattgttacactcaccttgttcacatatgctttattgtttaaaacttctcctagtgctcttctcgcacttggtgtcatacagacaagaagatttgacatgagggttgatttgtttggtagctttttctggtggtggtagtgttattcctgtgatacagccatcaataggttggtaggttatttatcaaattgagaacaaatatttcatcctttgcttccctagattctcttgcagcaagtgtttcacaaagccaaatccccacatatgtagaagattaacagcattaatgagatgaagatgctgaaggttgggaaaatttgttaacctttctctcagaattattcaaatggtgtggtagtaacagtggtggtggtgaacgttgggcagcctgagcctaaatggagtctcagatgagtttgagtaggtgtgctgaacgcacgcataagggtgtttggtttcggttattttattttggtctgagggcaacatccagcacctggctcagatgttggtgtctagtttataaggaatgagtgagacttgcaggcaatgttcccctaagtactagagactcagcagcctgatctgtggctcaggtgatcaagcgggacactgagtgtggaagggagaatttgctccacttctgggctgactatagtctagctttagcctggagatgcctgccaagaaccaaatacctcatgaacccctggggagtactgctcttaggggccagcacccctgggctacatatgggtgctagcaccaaacaatgagaagacagtttgtcagctcatgtgggacagtctactctctctccttgggtgagttcttctattcccatggtttcaaacacctatttgctgaaaactcccaaatgtttatacccagagcacttcagccttgcatccaatcatctacttgatatctccatctgaatgtcttgtgaatgttgcagactgaatgtgtccaaagagaattccacaagctccaaacatgctcctccccaggtttttccatcaatcaacacaaaagctcaaaccagaaacctgggagtcaccttggcacctctctttttccctttctcccccttacgtccccttcctaatcctttagtaagacttctaaaatagttattgaattctccatcttcacccttctaatcctgccaaccatcttttcttacttgaactattgcaatagttttccaattcgtgtctccatgttcactctggttatcctacaatctgtgtctcctgtagcagtcagaattttctgctttaaatgaaaatcttattttagctcaatgcggggaatatgatattattttgtttgctagtttagtcccagtgctaagcataaatctggcacatagatgataaattaatgtaattgaatggaaaaaggggactttgtaagtattagagaagccgtggggttggagggttcacggggctgaggtgtttttatgcaggtgagggtaagagatggtgaaaatagggttattatccttagtaagcagaggctgttgagatctaggggaaatcatgtagaggaatttattttacagacgtgaaactagtgtcacaaactaagagatttgcccaagctcgcatggctcatctgtgtcagtgctgggattagaatttggttcgcttgactctcattctgttatgtatagtgaacccctaagcagagatgtagaaaaaggccatatgagaaaaaaactctacaggatgggtccagagaataggtgatgcctgagggtcaacttgtcaacttgtcaataacaaataagacgttttgatgagagactgaggcagagcagagcctgctcttttttgccttgtccctcaacttacactgcccttcagcagcctcgccagtctgaatccccacttctatgtgtccctgcaggaggaaagccgagaaggagtcagaaaacacaggccagctaatttaatctacaagaatttgggatgacctgtaccaatgtctcgctctcttgaacagagattttttttttcctgattgagaaataccattcaagggctgatctgacaagtcttgcctgtttaacagtgaatctgcttaaaatgaggagagtggtctttgggcccagggggcatgtactgtagctacattttaattacagagtagaatcaaattttgttttggaagctgttctaaagtttcctttcaatggcttaagaaaatgtttctagttggaacgggatcactggaattttttttctttgctgctctgtttcttaatgaatgctaacctcaaagttgcactgttaaataaatatttgaatttaatttgaattttagaaacttatttctgcattttggctctcatacttactctgaatgatactataaaaattaagaactccccattccaaagaaaactatattgagatttccaaggctaaataaggatttgaggttgctgatgtaggctctgattctctaggtaaaatgatagacgtttcactacaacttgatttaagaaatgtttttagctccataaagtcagtaagttggttatatcttgagtgtataccaaagctattcattgtaaaaagtctttttgaaaagtcatgaaatgctatccattgtcagttcaaatgatatttgaggggaaactaaaagtgcttctccatgtccccttagccccatgcttatgatctttcattggcttccatttgctttttggatacagacaaagctccctaatgtggaggggtttgtgtggtccagctctgattctctccctgctgcatgttgaccttgccccctgtgcttgtgcttgagtagaaaaaatttcagtccttcacaaacaggaggaaaagattttccttgtagaacttaataaatgttatctcatttatacctagtgttccattattggaacaataagcatgtgggagttatttacatcctactgctcaaggccatcgccaaggtctgattgcaaaaattcaaaaaattgtaactttgggcacaaatgggttaagatagaggacagagagtctatgccactcctgtggaggaatttgtataattatatataggtaacattgacagttaaattgtgacaacatgaagttgaactttaatatttctgattattaaatgtgacattaaaagtggaactattttattatggtaatgacaaccttttcctctatctgaagggagaaattttttaaatgagctatgtatttaccaaaaaataaaaagctaccaatggtttttcacattatctacaagatgcctgagagttatcattgatagcttgcataaagataaatggctttctagttgtcagcaaccaccctcatggtctttctctctcccaaatatgtcttcactatctaagaaaatatcaccatcctgatatttaggcagaggcctaggttcatctttggtgctttctgctcccttagtcaatatttaatctatcaccaactccattcaattctacccctaaaaaactcccaaaccggttggtctacttccctctttcaccaccctagcccaaagaccgtcattacttcttgcctgaaatactgtaataccttcctcattggtctcccagtaatccacactacagtcagagaggtcttctgaacactaccacctagccccatgcttatgatctttcactggcttccatttgctttttggatacagacaaagctccctaatgtggaggggtttgtatggtccagctctgattctctccctgctgcatgttgaccttgcccctctgtgttagttagggttctctaaagggacagaactagaggatatttgcatatatgatggggagtttattaggagaattgactcacatgagtcacacgatcacaaggtgaaatcccacaataggccgtttgcaagctgaggatcaaggaagtcagtctgagtctcaaaacctcaaaagtagggaagctgactgtgcagccttcagtctgtagccaaaggcctgagagcccctggtaaatcactggtgttaagtccaagagtccaaaagctgaagaacttggagtccgatgttccagtgcaggaagcatccagcatgggagaaagatgaaggccggaagactcagccagtttcctcatgccactttcttctgcctgctttattctagctgtgctggcagctgattagatggcgcccacccagattgagggtgggtctgcctctccctgtccactgactcaaatgttaatcccctttggcaataccctcatagacacatccaggaacaatactttgcatccttcaatccaatcaagttgacactcaatattaaccatcacaccccctgttctctgaaccctagctatagcacacttcttctatgtatgcaagtttccctgctacttcctggctagggcatctgttccaataatcatctttctatcctccctcagttagtatctactcttccttcagattttaattcaatattaactcctttagagcagccttttctgacttttccaccttgcttcattacatcctttgaaggcacttggtaactgtcctttgctgtatttatcctagtagcaatttcgcatctttctgtgggggctatttgattcccgatgtatcccaggtgactagcaaagtgcctgacagatggaaggcactgaatacaagtttgtggaattagtgaatgtggggagtaggggtgcaatgaattctatcttgagactgaagtacttgaaataatcctggatgttagactttgtgaggaagatacatgactgcttttgtatatgtgtttgtgtatgtgttttgtaagaatcttagggctgtagtaccagaatggctgagtgattaaggtattggacttaagaatcatagggctaattcatgaagaaagataggtatgcatttgggaggttccggaggaaataaccatgaccaatgggtagaattgcagggagggattatgatatactaataaagatgaactttctaaaaatgaaaggtaaagaaatgaattatcttctgcagagtgcgggggtatgtgacccctccttaggggatgttgtggcaatggtttctgcatcataaaagagaagactgaatgacttattaggttccagctctgatattctagtataataggcaatagagagatgaacaattcagatattttagaaataaggagagggcagagggcatagatgtgtagttaggattcccgttttatttggttagtggtaaatactccatagtcttagcatgttgctctagagtctaagaccaaagaagacagaatcaaatgcctttggtgattagagtagcatgtaattctccgtcaaggtaaaaaacaaaagttacatctagcaaagacctcaagtgaagagctatgtacctgtgactagcttttctaagcctaatcgaccacttaactacttctaatccatagtttgtaagttatctaaccccttccagtataacgataaatagctaaatatacatagcagtcattgataaatgggggtgccaagaaatttcaggttattttgtggcactttaaccactgttgttttttcttcttcttcaatcaagcctcttttaccttcagattttcttcaatgcagtcagtgctggcaacttgccgtttattatggtcccttctgaaggtgttccatccttcttgtccacagcatcacagcagtgaagtgtcagacaagcctaagagacacctggaccctgggttgatttctgagctatttttaatcccttcatttactttaaaatttttctaacctactgtgctctggtgcctttgaaacatgggagtcagtaaatggatgaatatcaaaactgttgctttgtctttgaaataagcacattattagaataagaaattgaattagaaatcacaacaaattacaaattcgaatgacaaatatcacaagcatcaaaaaaatctagaaaataagtgtttttaccaattaaaagttaacagatccatcctaaaatattttgttcctacattgtgggggccacagggtctttaatcacctcctcataaagtgatggtttttaaatactctgtgaagagatagtagaaagataatttggatactgccctaatacagttaatgtatgattatttttcattaaaacaaacataaagtgcaaaacccttttctgtgacagtgtagcttttttaaagattcctaaatttgctatcccattccatgttttagacagttcatctacacttcgttagcttttgttcagaatgaaagatgacatatttttgcaccttgtacagacagtcccatgtcttgacagaaaacaaaatgaaaatacccacatatgttgtactgctcatgatttgctgtgaagagagcaggaaaaatgttggaattatttctttcctactcaccctaaaggtggcatattagtaaggctatttcaggagatacaacttaggttatgcattcaagaataaaatattttaaatttgtattaaatgccttatatgtgtcaggcacttgacaaggtgctttacgtatgttgtaatttatttctcataataaccttgcaaagtcagtggtattatccccattttgtgggtgagagaactgaggtttcaagaggtaaagtaacttgctacatagctcataaatgatgactctgagattttagctccaggtttgtctgtttgacctcaaagcccaattcattccctcatacagagatacctcccatagataggattcctttctctccttcttcccttcactccttcctttcttactttttccttccttttttccttgacctcagattttctctcatttatgaggataaaggagttgaaaataaaaccatcataactattgtgtttggaagataccttaaatcttttttagaatgagaaatataggtggaaatacaggtttttgcaaagtttaaagtttattcaatttgggagactttgtttaagaaaaagaatataaaatctgtatcaggtttctcgacatggtgcggtggctcacgcctgtattcccaacactttgagaggctgaggtgggtggatcagttgaggtcaggagttcaaaaccagcctgacaacatggtgaaaccctgtctctactaaaaatacaaaaattagccaggcttggtggcatgcacctgtagtcctagttactcgggaggctgaggcaggaggatcacttgaacctgagaggcagaggttgcagtgagccgagatcacgccactgcactccagcctgggtaacagagtgagaccttatctcaaaagtctgtatcagggttctctaggaggtgaggtatttattatgggaatcggctcatgcaattatggaggcagagaaatcccataatctgctgtctataagcttgagaacccagaaagacagcaatgtaatttattcagagtcagaaggcgtaagaactgggagcactaatgtctgaaggcaggagaagatcaatgttccagttcagagaaagcaaattcacccttcctctgccttttggtcctatttgggttctcaatggattggatgaggaacgttcatactgatgagggtgaatcttctttactcagtccactaatgcaaatgctaatctcttcccccaaacaccttacagacacacccagatataatgtgtttttttatttttatttatttatttattttaccagctatctgaccatcccttagcccagtaaaattgagacataaaattaacatcacaaaattgtcaacattaaagtagatacgaagtgaatacttatttagaatggaagaagaaatcacaacaaattacaaatctgagtgacaaataccataggcatcacaaaatctaggaaataagtgtttttaccaattaaaaattaatgaatacaccctaaatgttttgttcctacaatgtgggggccacaggatctttaatgacctcctaacacaatgatgatttattttgattttgattttttaattaaaaaaattttttttgagatggagtttcgctctgtcgcccaggctgaagtgcagtggcgccatcttggctcactgcaagctccacctcctgggttcatgtcattctcctgcctcagcctcccgagtagctgggactacaggcgcctgccaccatgcctggctaattttttttttttttttgtatttttagtagagacggagtttcaccgtgttagccaggatggtctcagtctcctgacctcgtgatccctactccttggcctcccaaagtgctgggattataggcatgagccactgtgcccggcctttatttttatttattatacttacttattcactttatttatttatttatttatttatttatttatttatttatttttagtaagagacagggtttcagcatgttggccagcgtggtcccgaactcctggcttcaggtgacctgcctgcctcggcctcccaaagtgctgaaattatgggtgtgagccaccgcacttggctgattttttaaatattctataaagagataatagaaagataattcagatactcccctgacatagttaattgtttttcattagagtctagaaaagttccatcgcctagcttttggctctgtttctcctttactacccacatacttcaggtgctgagcaccataggacatatttatatgaagatttcagcccagtgatttagtacaggtagtagggatattcctgtatgtcatttctccaccaaaacatttagcaataacttaaccatgcacaggcatgactacaaaccacaattatataatccactaaatccaaatgaaatctaagggtatccccatctcaactttctttgagccagatccaagacatacctatggccacttcagtgctacctgataggagtagaattgtgaaggagggatagccagtaaaaagagtgctctcaagccaattgcagttaaaatatattttgcaaatttttaacgaaacataagattatgagaacaatgctagagtctttctcggggccttaaagagggttctgcaagtgagggaccttgaagcttaagctttgttggcttccaagaaaacccagctctggaggaaaggtgtaaccaaaaaaaatggtattacactataatacacaagagtccatgccatatagcgcttcaaaaaatgatgttatatgagatcctattctgagcagcttcagctcccaaactcattgaatgaagtagaggatgttctattcagtatattttataaataatatgttgaagatatagatgttctggtactgctaaaactcaaaggtctcagactcctctgccaccatttatattcaaaaaagaattatttgcaaagggattctttgcaaatacaaatagatctctatactcctatattagtctaattaatattaaacacaccatttactattcttccaagcagaccagttaacacacacacacacagagaaagactgtgttattgctgtttaagatcacatagtggaaaaactaaaacatcactaaagaaagataaagtctttaagaattcattaagatgtaatcaagcttttgcaaactcatgtgttatttgcaattatagtatagtgatatggtttagctgtgttcacacccaaatctcaattaaactgtatctcctagaattcctaggtgttgtgggagggacccagggggaggtaattgaatcatgggggctggtctttcccatgctattctcattatagtgaataagtctcatgagatctgatgggtttatcaggggtttctgcttttgcttcttcctcattttctcttgctgctgccatgtaagaagtgccttttgccttccgccatgattccaaggtctccctagtcatgtggaaatgtaagtccaattaaacctcttttgcttcccagtctcgggcatatctttatcagcagcatgaaaacagactaatatagtaaattggtaccagtagagtggggtgttgctgaaaagatacccgaaaatgtggaagtgactttggaactgggaaacaggcagaggttggaacagtttggagggttcagaagaagacaggaaaatttgggaaagtttggaacttcctaaagacttgttgaatggctttgtccaaaatgctgatagtgatatggacaataaggtccaggctgagatggtctcagatggagatgaggaacttgttgagaaccggagtgaaggtgactcttgttatgttttagcaaagagagtggcagcattttgcctctgccctagagatttgtggaactttgaacttaagaaagatgatttagggtatctgacagaaaaaatttctaagctgcaaacattcaagaggtgacttcatcactgttaaagacattcagttttataagggaagcagagcataaaagtttggaaaacttgcagcctgactatgtgatagaaaaggaaaacccattttctgggaagaaattcaagttggctgcaggaattttcataagtagcaaggagcctaatgataatccccaagaccatggggaaagtatctccaggccatttcagagaccttcacagcagcccctcccatcacaggcctggaggcctgtggtttcgtgggctgggcccagggtccctgtgctgtgtgcagcctagggacttggtgccctgtgttccagccatggctgaaaggggccaatgtacagctcaggctatggcttcagagggtggaagcccgaagccttggcagcttccacgtgttgttgagcctgtgaatgcactgaagtcaagaattgaggtttgggaacctccacctagatttcagaagatgtatggaaacacctggatgcccaggaaaatgtttgctgcaggggtggggtcctcatggagaacttctgccagagcagtgtggaagggaaatgtggagtcagagcccccatacagagtccctactggggcactgcctagtggagctgtgagaagagggccaccatcctccagaccccagaatggtagatccaccgacagcttgcaccgtgctcctagaaaagccgcagacactcaacgtcagcccatgaaagcagcaaggagggaggctgtaccctgcaaagccacaggggtggagctgcctaagaccatgggcacccaatcttgcatcagcatgacctggatgtgagacctggagtcaaaggagatcattctggagctttaaaaattgactgccctactgaatttttggacttgtatgggcctcgtaacccctttgttttggccaatttcttccatttggaatggccacatttacccaatacctgtacctccattgtatctaggaagtaactagtttgctattgatttacaggctcataggcggaagggacttgcctttctctcaggtgaaactttgaactgtggacttttgggttaatgctgaaatggcttaagactttgggggactgttgggagggcatgattggttttgaaatgttaggagatgatatttggagggcccaggagcagaataatatggtttgacagtgtccccacccaaatttcaacttgacttctatcttccagaattcccatgtgttgtgggatggacccaagtggaggtaattgaatcataggggccagtcttcccggagctattctcatgataatgaataagtctcacaaggtctgatgggtttatcaggggtttctgcttttgcttcttcctcattttctgttgctgccaccatgtaagaagtgcctttcacttcccgccatgtttctgaggcctccccagccatgtggaactgtaagtccaattaaacctcttttttatcccagtcttggggatgtctttcagcagcatcaaaacagactaatatacatagtttctgaaacttgtctgatactctagataaagatcatctttatgttgatttaaaaattttttaactttgtttaatccccataatcatatattgaccttttttgctgaattttgctcattgagaatgtattgaaatgtctacttttttcatatatatcctattcttagctgaaactctagaatcctccttttttgattatatatgcataattatccttaaatgtaagcagtgcttacaattctgttctgtaccattactatattacccaagtttacaacttaactagaccatggcttataagtcatctaaaaataaataaagcaaattatagaagtattttagccttaaataatgaagacatgtttgtttcaagtgattaaatagtgagaattgtgtaaagccatttcactagcgtcaaaaaactccttttgctctgtccccaacataaaatttgtgtgtaatatacttgaaatttttagagcctctgaaatgttatccaacttattttctttaaggataaaattatttgtttgagaaacccagtttcaagaaaatggcattttatccttactttgtgaagcttccctactcctcttctttcatctaactggtgctgctaaagcctgatacacctagtcaaagaagcattgttccaaaggtcctgacctggaataagaaaacaaaaactggcttcatagctaggatgacaactgtagctccattatcactgaattgctaactttgttcttattctctcaaactgtggttttgccaatgtgatactcaattacctaagaggggagaagtatgatttctttatgattttaatactctttcctctcatattttaaaatagctggttttaggccaataagtgtctactcaaagaaattcaaatccttatataatttaagaatgctggaggaggtttaaatattcatgtacggtcatacttccattttattccacttcacttatatatacatagcacttaacaggtaattgtgttttttataaattgaaggtttctggcaaccttgcattgaggaagttcattggcactatttttccaaaatcatgtattcacttcatgtctctgtgtcacattttagtaattcttgcaatgtttcaaactttcccattattattatatctgttatgatgacctgtggtaatttttgatgttactattgtaattgttgtggggtgccctgaatcatgcccgcattagacagaaaacttaatggataaatgtgtgtgctgacttctccactgaccagtgatttccccagctctcttctccttgggccttcctatttcttgggacacaatagtactgaaagtagtccaataataaccctacaatggcctgtaaatgttccagtgaaagaaagagtcatacattcctctctttaaatcaaaaaatagaaatgattgtccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagtgaggagcccctccgtccggcaaccaccccgtctgggaagtgaggagcgtctccgcccggcagccaccccgtcccggagggaggtgggggggctcagccccccgcccggccagccgccccggccgggaggtgaggggctcctctgcccggccgcccctactgggaagtgaggacccctctgcccggccagccgccccatccgggagggaggtgggggggtcagccccccgcccggccagctgccctgtccgggaggtgaggggctcctctgcctggccgcccctactgggaagtgaggagcccctctgcccggccagtcgccccgtccaggagggaggtgggggggtcagcccccggcctggccagccgcccagtccgggagggaggtggggggtcagccccccgcctggccagccgccccgtccgggaggtgaggggcgcctctgcccggccgcccctactgggaagtgaggagcccctctgcccggccagccgccccgcccgggagggaggtggggggtcagccccccgcctggccagccgccccgtccgggaggtgaggggcgcctctgcccggccgcccctactgggaagtgaggacccctctgcccggccagccgccccgtccgggagggaggtggggggggacagccccccgcccggccagccgccctatccaggaggtgaggggcgcctctgcccggccgcccctactgggaagtgaggagcccctctgcctggccagccgccccgtccgggagagtggtgggggggtcagccccccgcccggccagccgccccatccgggaggtgaggggcgcttctgccccgccgcccctactgggaagtgaggagcccctctgcccggccaccaccccgtctgggaggtgtgcccagcggctcattggggatgggccatgatgacaatggcggttttgtggaatagaaaggcgggaagggtggggaaaaaattgagaaatcgcatggttgccgggtctgtatggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctaatcttaagtacccagggacacaaacactgcggaaggccgcagggtcctctgcctaggaaaatcagagacctttgttcacttgtttatctgctgaccttccctccactattgtcctatgaccctgccaaatccccctctgcgagaaacacccaagaatgatcaataaaaaataaaaaaaaaaaaaaaaaaaaaaaaaaaaaagaaatgattaagcttaatgaggaagcatgttgaaagctgaggtaggctgaaagctaggcctcatgcatcagttagccaagttgtcaatacaaaggaaaattcttgaaggaaattaaaagtgctactccagtgaacacacaaatgataagaaagctaaacagtatttttgctaatgtgcaggaagtttgagcggtctggatacaagaccaaaccaggcataccattcctttaggccaaagtctaattcagagtaagtctctaactctcttgaattctgtgaaggttgagagaggagggttagctgcagaagaaaagtttgaatatagcagaggttggttcttgaggtttaaggaaagaagcaatctccataacataaaagtacaaggtgaagcagcaaggagtgatggagaagtggcagcaagtaatccagaagacctagctaagatcattgatgaaggtggctatactaaataatagattttcaatgtggataaaaagccacaggctgactttcttgtttggaaccagtacagctgttgactttaagttgaagccaatgatgatttatcattctgaaaattctaggtccctaaagaatgatgctaaatctactttgcttgtgctctatcaatggaacaacagagcctgtaggacagcagatccatttatagcatggcttactgaatattttaagcccactgttgagacctcaaaaaaaaaaatagattcctttcaaaatattactgctcttcacagtgcagctagtcacccaagagctctgacatgaggtaaaaggagaataatgttttcatgtctgctgtctgttctgcagtccatggatcaaggaagaattttaactttcaagtcttattatttaagaaacacatttcataaggctatagctaccatagatagtgattcctctgatggatctgggcaaagtaaactgaaaactttccagagaggattcaccattctaggtgtcactaaaaacatttgtgattcatgaaaggaggacaaagtgtcaacattaacaggagtttagaagaagttgattccaaccctcatggatgactttgagggattcaagacttcagtggaggaagtaagtacagatgtggtagaaagggcaagataactagaagtggatcctgaagatgttactgaattgctgcaatttcatgataaacgttgaacagatgaggaattgcttcctcataagaaaacacagaaaatgttttcttatgatagaacctattgctgggtagatatgctgtgaacattgttgaaatgatgacaaaggatttagagtattttataaactgaggtgataaagcagtggcagggtttgagaggactgactccaattttgaaagaggttctactatgctactaaacagcatcagacaatacagagaaatcatttgtgcaaggaagagtcaattgatgcaccaaactttattattgttttattttaggaaattgccaccgccacttcaactttcagcaaccaccgccctgatcagtcaatagccattaacgtcaaggcgagatcccctaccagccaaaatattatgactcattgatggttcagatgatcattaacattctttagcaataaagtattttttaactaaggtatatacatttttttagacttgctattgaatacttaatagactacaatacagtgtaaacataaattttgtatgcactgggaaaccaaaaaatttgtgtgactttctgtattgtgatatttgctttattgtggtggtctcaaaccaagctcacaatatctctgagttatccctgtacattcttattcactcttagaattgagtactattggcatgatcaaaatatttttagatgaaagcttaatgcttcttgtaaacagtgctgaaactttagcatgcattggaatcacctaaaggactaattaaaacagaatgctgggccccacctccagagtttctaatacagtaggactgaggtggggcccaagagtctgcatttctaaaaaaattccaggtgggagggaccacactttcagaaccactgttgcagatcatttgatgatgtatatttccaaaatcaaagctgacagggcttgtcatacctactcaagaatagcatgtatgctgcttagaagatggtaagtcattgtcaaagccagagggatactaatgatgacttagagtttcacaggttcttaattgaccattttcattcaccttggctgatgcctagtgttacttaatgcttagtaagaaatctttaggccaggggcggtggctcacccctataatcccaaactttgggaggcagaggccggcggatcagctgaagtaaggagttccagaccagcctggccaatgtggtgaaaccccatctctattaaaaagtacaaaaattagccaggcgtgctggcgcgtgcctataacccctgttactctggaggctggggctggagaattgcttgaacctgggaggcagaggttgcagtgagcggagatcatgccactgcattccagcctgggcaacaggagtgaaactctgtctcaaaaaaaaaaaaaaaaaaaatctttaagcaatgtcttggccctaagaatataatctaaaatatgttcttatgtttatatcatcttcgatagctgattaaagtgatgtagcaactgagaatttcaattgttgatttaaatcatggaatatacaaaaagatataatccttgttaggtcctgcatactttctaaagccattatgaggtcttaattaaaagaaacaaagaataaaaccctcattttttccctagcccttactctgcttattgtttaaacataattataaagactctgaataacaaaaatttaactggaaagatgaaatcagtattcttaatactacttagtggcttttaggtttaggacatatgtttaatatgtattctgttgatttttcaatagatcatgttaattaacatgtctcaattacctattgaataatgtctctaaaatgcctatctgtgattattattcatgagattacactcccattttaccagtactatgcctatctgtgattattattcatgagactacactcccatttgaggagtacttttcttttcttttttttttttttaaagatggggtcttactctgtcacccaagctggagtgcagtggcacgaaatcggctcactgcaacctccgcctcctgggttcaagcgattctcctgccttagcctcccgagtagctgtgattacgggcacctaccaccacacctggctaatttttgtatatttagtagagacggagtttcaccattttggccaggctagtcttgaactcctgaccttgtgatctacctgcctcggcctcccaaagtgctgggattacaggtgtgagccactgcgcccagcttgagcagtacttttcaactctgagaagataaacccaagggattctagaagagggtctgcttggagaataatttctccagtaatggtatctgaaggttgaataaaaacaagtgaatagatgtagatattgactaagagtgactaagaaagacagttaccttattaattaatacaatcttgagtgtcatcaaattagctatggggcatatatcctacactcagaaattaggcactattaaagttaaagggggccacactgaattgaaagaggcaagaatttaacaaacaaaatgataaactacaaaaggtaactaaataaacagagcagcttcttatatattctccaataaggcattgtggaaacattgagggatggagggatacccaagccaagatgggtattagactgctaactttgacattaaacactgagaaattcttgagcagggagcttcctttgtatgagtctcatcttcatcacctttaagaagcaattaatgaaatctagtctgcttacttcgcaatgttttgagcattaaatttaattatatacaaatatgtacttttggtgtctgttcagtgagaattgattctcacttccctaaaagtaatttaaacgttttaatcaaatgtgtaatgttgacatctttacctttccaagtacttttgtacttttccagggttaaaataacatttttgtcatttaaatgaggaaaaaatataagttttttaaaaactcaaatgtcatagctttttaactgttctaattgtgtctgctaatagaaacaagttgatgtgcaaaccacaaaataataaatatttttgcctagcttttgggaaaaagaaaagactatagtatactttaagtaagtgtaaatttagtttcattttagcaattccatagtcgaatctgtcactaagtaatcattagttaaagaaaaaaaatctagccaggcaccgtggctcacccctgtaatcccagcactttgaaaggctgaggtgggcagatcacaaggtcaggagttctagaccagcctgaccaacatggtgaaaccccgtctctactaaaaatacaaaaattagcccggcatggtggcgggtgcctgtaatcccagctactcagaaggctgaggcaggagaatcgcttgaacccaggaggcagaggttgcagtgagctgagattacaccactgcactcctgcctgggtgacagaacgagactctgtctcaaaaaaaaaaaagaaaaaaagaaaaagaaaagataagaaaaaaatctagtgcccagggcatgcaactatataagtaaaaattctaaaagatcatcaatgtttaagaataaaatacagtcagttatataattttaaaatatttctaatgagtgataaggaaaacttgtcaatggaatttctgaagtcaatagccaatttttaactttatctgctaatatggcaattatttaacttaaaaaacagacacacttcttattcagtttttggacatcttattctgtaacttcctattgattaacatcgcctttaacattttaagtacttgtcgtaacattttatcatttgaataattcatattgtattatactcttcacttttataggaacaatcatcaaccaacattttaacctattaatctaaactaaattttttcctctcatttaatctatcaattaagattcttctgattgtatgtaacagaaaatgtagttcatttattatctcacattagaggaagtctagtggtagggcaggccccagagttggtttatttgttagcttaattatgtattaaaggacttggcttcttcgagtcactactttgccattcttagtattgtcttttctcaggggaagggtagaaggagggataaaaaggtggctgctgtacttccaagcattcagaatcattgaaaagtcttgctaaatcagactgctgcatctaatccccagaatttgattcagtaggactcgccggagtgtgagaatttgcatttctaataaattcccaggtgatgctgatgctgctcatagtaaagccacactgagaaatattaacttagactaatgatcttggaaacgaatggattttttcttttctttttagttcacatgtaatagttgtatttatttatgcaacacagaatgatattttgatacatctgtactatgtgtaatcatcaagtaagggcaattagcatatccctcacctcaaaaatttatgatttctttttgttgggaacattccaaatcctctcttccagttttttaaaaatatgcagtaaattgttgttaactatactcatcccacagtgctataaaacactgtaatgtatttctcctatctagctgtaattttgtatccattaaccaacctctccctattcctcccctccaactacatttaccagcctctagtaaccactattctactatttacttctatgagttcaacttttgagctcatgtatgggtgtgaacatgtgttatttatctttttgtgccttatttatttcacttaacataacatcctccaggttcatccatgttgccatgaatgacaggacttaattcttatttataactgaatcgttttctattgtgtatatataccacattttctctatccagtcatctgttgatggacttgtagtttgattccattatcttggctattgtggataatgctacaataaacatgggggtgtagatacctcttcaatatactgatttgcttttctttggataggtacccggtagtgctgaatcacatgatagttctatttttagttttttgaggaacctccatactgttttccataacggctgtacaaatttacaatcacactaatactgtatgagtttcccttcttctgtatcctcactggcatttgttagtttttgtctttttgacaatagtcattctaacaagtgtgaggtgatatctcatcgtggttttgatttgcatttctctgatgattagtgatgtcgagtgttttttttttttatgtacttgttggccatttgctttgagaagtgtctttagatcatttgcccatttttaaatcaaaatatttgagttttttttggagttattttttgagctgttggtttttttcagttccttgtatatcctggatattttgtcaggtaaatagtttgcaaatatttatttccattctacaggttgtctcttcattttgttgatgatactctttgttgtgcagaggcttttagtttgatatagtaccacttgtctatttttatttttgttccctgtactcttgaagtcttacccataaaattttttcctagaccaatgtccagaagcattttccctgttttcttctagtagttttagggctttgtgtcttacatttaattatttaatccatattgggttcatttttatatatgctgagagttaggggtctaatttaattcttctttaatatgaatatccagttttcccaacaccatttattgaaaaggatgttctttcactagtgtatgttcttgtcttcttttctgaaaattagttggctgtaaatagttggattcatttctaggtcctctattctgttctatttgtccttgtttctgtttttatcttgctgttttggtcactaaaattttgtagtgtattttgaagccagatacagtgatgcatccaggtttgttctttttgcttaggattgctttggttcctcaggatcttttgtgtttccacatgaattttaagactgttttttctatttctatgaagaatgtcgttggtattttaattggaaatgcattgaatctgtagcttgagtaatatggtcattttaacaatactaattctttcaattcatgagcataggatgtctttccattgtttttgtgtcctctactatttgtttcatcagcattttatagttttcattgtagaggtctttcacctccttggttaaatttattactaggggttttttgtagctagtataaatggaattgctttcttgatttctttttattgttgttgttattggcatacagaaatgctactgatttttgtatgttgattttgtttcctacaagtttactgaatttgtttattcgttctaaaagtactttggtggagtatttaggtttttctgtatataagatcatgttatctgcaaacagggacaatttgacttcctgtttttgaatttggatgctgtttatttatttctcttgcctaatctattttgtctgatataagtatagctactcctatatacttttggttttcatttgtgtggaatacatttttccattccttcactcacagtctttgtctgtttttaaaggtgacaagagtttcttgtaggcagcataaagttgggttttgtttttgcttattcattcagccagtctttatctttcaattggggggatttaaaatgtttaaaagaaactaccatcagagtgaacaggcaacctacagaatgggagaaaatttttacaatctacccatctgacaaagggctaatatccagaatctaccaaggacttaaacaaatttacaagaaaaaatcaaacaaccccatcaaagagtgggcaaaggatatgaacagacacttctcaaaagaagacatttatgcagccgacagacccatgaaaaaatgctcatcatcactggacatcagagaaatgcaaatcaaaaccacaatgagataccatctcacaccagttagaacgggatcattaaaaagttaggaaacaacaggtgctggagaggatgtggagaaacaggaacacttttacactgttggtgggactgtaaactagttcaaccattgtggaagtcagtgtggcgattcctcagggatctagaactagaaatatcatttgacctagccatcccattactgggtatatatccaaaggattataaatcatgctgctgtaaagacacatgcacgtgtatgtttattgcggcactattcacaatagcaaagacttggaaccaacccaaatgtccaacagtgatagactggattaagaaaatgtggcacatatacaccatggaatattatgtagccataaaaaaggatgagctcatgtcctttgtagggacatggatgaagctggacaccatcattctgagcaaactatcacaaggacacaaaaccaaacactgcatgttctcactcatgggtgggaattgaacaatgagaacacttggacacagagtggggaacatcacacactggggcctgtcgtggggtggggggaggggggagggatagcattaggagatatacttaatgtaaatgacgagttaatgggtgcagcacaccaagatggcacatgtatacatatgtaacaaacctgcaggttttgcacatgtaccctagaacttaaagtataataaaaaaatcataaaatgtttagccctaaggttgctattaataaatgagaatttacttctgtcattttgttaattgttttcggaatgttttgtgtaccctttgtttctttttgtttttctttgcagtttaatgattttctgtagtgataatgtttagttcctttttctgtcttatttttgtatctgttctaccagtgaattttacactattgtgtgttttcttgatggtaaatatgacattgtcctttagcttccaaatgtgggactttcttaagcattttttggaggggtattgatgagtttcctgtttttggtttctggaaaatactttatttctccttcatttctgaaagttagctttgctgggtatagtattcttgcctgacaatttctttctttcagcactttgaatatattatcccattctctcctggcctataaggtttctgctgagaaatatgctattattctgatggggattcctttagatatgacttgatgcttatctcttgctgttttcagaattctttcttcaacttttggcaatgtaactataatgcatttcaaatagaacctttttgtgttgaatttatttggagatctttgagcttccagtatctggatgtctatatcactcctaaaatttgggaatttttcagctattattttattaaattacatttctttctgttgggaccattcaacatacactttctagctatttgaaactatataagtattgtttatttcatacattgggttcttcagttttaatatatatatattttttgacagagtctcactctgttgcccaggctggatgcaatggcacaatcttggcttactgctacctctgcctcctgggtcccagttcaagcaattctccttcctcagcctcctgagtagctgggattacaggcacatgccaccatgcacagctaatttttgtatttttattttttaatagaggcagcgtttctccatgttggccaggctagtcttgaactcctgacctcgtgatccacctgcctcagcctcccaaagtgctgggattacaggtgtgaatcaccatgcctggctgatatttctgtttttttctctttttttaatgaaatgtacctctgttgaatttttcattcagatcctgaattgttttcttgattttattgtattgtttatctgtatttgtttgcatttcactgagttttctgaagataattattttgaatttcttttcaagcatttcatgcatttccttttttggtattctgctactgaagaattaccgttgttttttggtgctgttatatttccttgctttttcatgttattttgtttctctatgttaatatctgtgcatctggtgtaaccgttgttttcttccaattttatacagtatctttcatagaaaaagactttttcctatagatgtattcataatgtaagttgggtagagtgctttggctttcattctgggtgggtgcgatagtacagtctctgtataatttctttggctgtcatcaacatcagtggtgtctgcaagttcctcagtggcttagattgcagttgtctgtgggaaagctgtgctggatggggatgccaggtgagatgatccttgggcccctgggcagcacatgggtgcatgatgacctcatcgctggaatgggctgggttgctggcagaagtgatagtgaaccctcatgtggtctggtcctttaacccctatttggtgtggtggtggcagcaggtacctaggaggagtgcaaaggtgttcatggtggctgggaatggatgtttgaggattacttatgacattcattaaaagatatactataattatcatttggaaaattacagagttccctttactcacctcaaagggcctggtgtcatttttagtttgtaagcctcctgttaaatattctacactgggacactgctcatttaaaataccaatatttctagtagttgatgtagtagttttgcagaaaatagttttgcattcagatgtttgaattgggagcttgattgggtcagttcaagccccaaattttcacctcagcttacctgttcccactcataggaagttttacccctccaaatcctcatttttccaattcgcctaaatattggacatttagaactattaaaaacttaaaatatgatacaggctacaaaagcattaccttctataatcaaggaagaaaaataaggttgtccaaaggcatactgtaaatgcttctaatccaattttccacctgatctttgattgtagcaataaattttctaagctaaaggattaacaatttgcttgtgttgcaaaaactctttcctgccaatttgtaattacccttctctatcatttatctcataaactatattgccaaattgtaatttcccctttttcattatctatttcaaaaaccatctcattgatatgggttctgtatctcccatagtatgctcagtgggactagtggtctgtttggatgattgtcctgggctaaactgcaggatcctcataaagccttggggctgtttatctcactctccaatttattatcataatggcattttgtgcctttttcctcatttatttgcacaataggaagcacagtggagagagatgatttctgcagggggcctggaaggacaggggacaagttcagacacagaagaaagctttgcagaaaatatctgacttccagcagttactgggatagaaaacttttaagtgcaaaatgtactattttggaggtatgaggaaatgctacctttcccaaagcactcccacatcccagtgtgcagcaggataaagagagactgaaaatgtttctgatatgaaattgatacagcatttaaatggagggaggaggcctaggctattaatgcaaacacagctagaggcctgcagatatgacacagaatttttcccacagttttaatttaaaacaaccaacccgtcagcaaagctttcaaagttggtggaagatattggccagtggcaatttaacttactcacctattttaagacctccttttctttttcttcttcttcttctcctcctcctcctcctccccctcccccttcccctcctttgtctctctctcatccaggctggagcgcagtggtgtgaacatggctcaccacagccttgtcctcctgggctcaagcagtcctcccacctcagcctcccaagttgctgggaccacaggtgcacaccaccatgcccagctagtttttaagttttttgtagagatgacgtttctccatgttttccatgttattacttctatttctttgaggaaagtcattggcattttggtagagattgcattcaatcagtagattgctttgggtagcatggacatttaaaaatattaattcttgcattccatgaatatagaatatgtttacattgttttgcatcctcttcaattgctttcatcagtgttttacagttttcatcatagagatgtttcacttctttggttaagttaatttctagggatttaattttatttgtggctattacatgtgggattatttttacctctttttcatattgtactctgttggcatatagaaatgctactgatttttgtatgttgattttgtgtcctgcaactttattgactttatttaccagttctaatagtttttggtggagtctttaggtttttccaatatatagtcatatcatctgcaaataaaaataatgaaacttcttcttttacaatttagatgttaaagaacatttctcttgcctaattgctctagttaggacttccagtactatgttgaataatagtggtgaaaaagtgggcatccttttcatgttccagtcttaaaataatgactctaagtttttccccattcagggtaatactagctgtgtgtctgtcatatacttttttctttcttctttttttttttttctcactctgttgcccaggctggaatgcagtggcgcgaccttggatcactacaacctccacctcctgggttgaagtgattctcttgcctcttgtaatcccaagtaactgggattacaggcatgcaccaccacacctggctaattttttatatttttagtagagatgaggtttcaccatgttggccaggctgatctcaaactcctgacctcaagtgatctgcttgtcttggcatcccaaagtgctgggattacagacgtgagccaccatgcccagcacaacttttattatgttgagatatgttccttctctacctagtttttaaagggttttaatcatgaacagatgttaaattttatcaagtggtttttcagcatcaattgaagtgatcatatggtttttgtccttcattctgttgctatgacatatcacattaattgatttgcatgtgttgaaccatccttgcatcccaaggataagctcacttggtcatgatgaatgatgtctttaatgtattgttgaatttggtttgctagtatttcattgaggatttttgcattaatatttatcagagacaccagcctgtagatttttttttgatgtgtctttgttctttgtatcagggtaacacttgcctcgtagaatgagtttggaagtattccctcctcctctattttttgtaatagtttgagtagcattggtattagttcacctttaaatgtttggtagaattcagcagtgaagccatcaggtcccaagcttttctttgctggaagactttttattatggcttcaatcttgttacttgttactgttcaggctttggatttcttcatggttcaatcttggtaggttgttatgtgtctaggaatttacccatttcttctaaattttccaatttattagcatatggttgatgatactagccactaatgatcctttgaatttctgtagtatcagttgcaatgtttctattttcatctctgattttatttatttgggtcttttccttttttttctttgttagtctggctaatggtttgtcagttttgttcatcttttcaaaagactaactttttgtttcattgacatttttattgttttcttcatttcaaacttatttctgctctgatctttattacttcttttttcctactaattttgagtttgatgtgctattgcttttctaatttttttaaagatgtatcattaggatatttatttgaagtctttcttctccttcttttttttttttctccacagagttttgctctgtcacctaggctggagtgcagcctagctcactgcaacatctgcctcccaggctcatgcaattcttctgcctcagcctcccaaatagctgggattgtaggcacctgccacgacgcccagctaacttttgtctctttagtagagacagggtttcgccatgttgtccaggctggtctcaaactcctgacctaacctcaagtgatctgcccaccctggcctcccaaagtgccgggatcactcatgtgagctgccgcacccaaccctctttcttctttctgatgtaggtacttagagcttaaacttccctcttagtagttatagctataaacttccctctttcaatgtatctgatatgttttggtatgttgtgtttccattagcatttgtttcaagaaatttttcaatttctttcttaatttcttttctttctttctttctttttcttttcttcttttttttttttttttgatagagtctttctctgtcacccaggctggactgcagtggtgtcatctcatctcactgcaacctccgcctctcgggttcaagtaattctcccacctcagcctcccgagtagctggattacaggctctggccaccatgcctggctaatttttgtacttttagtagagagggggtttcacgacattggccaggctggtctccaactcctgacctcaggtgatctgcccacctcggcctcccaaagtgctgagattacaggcgtgagccactgtgcccgttctccttcttaatttcttcattgacccactggtcattcaggagcatattgttgaatttccacgtatctgtatagttttcaaaattcctcgttattaatttctagttttattccattgtggtcagagaagatgcttgatattatttcatttttggggaacgtttaagacttcttttgtgacctaacatatggtctgtccctgagactactccatgtgttgagtagaagaatgtgtaatctgcagccattggatgaaatgttctgtaaatatctattaggtccacttggtctacagtgcagattaaatttgatgtttgttgattttctgtctaggaggtctgtccaatgctgaaaatggagtgtttaagtccccagctattttgtattgaggtctatctctctctttagctctaataaaattagctttatatatctgggtgctccagtgttaggtacatacatatttataattgttatatcctcttgctgaattgacctctttatcattatatgatgaccttctttgtctcttcttatagtttttgtcaagaaaactattttgtctgatataagcatagctactcctgctcttttttggcttccattggcttggaatatctttttccatccttttattttcagcctatgtgtatcttaataggtgaagtgtgtttcttttctttcttttctttcttttttttttttttttttttaagacggagtcttgctcttgtcgcccaggctggagtacaatggcgcgattttggctcattgcaacctccgcctcctgggttcaagcgattctcctgcctcagcctctggagtagctgggattacaggcacctgcgacaacgcccagctaatttttgtatttttagtagagacggggtttcaccatgttggccaggctggtctcaaacttctgacctcaggtgatccacccgcctctgcctcccaaagtgctgggattacaggcaggagccaccacgcacagccggtgaagtgtgtttcttataggtgatagatcactgggtcttgttttttaatctattcagccactctgtgtcttttggttggacagtttagtccatttgcacttaatgttattattgataagtagagactttctcttactattttgttatgtgttttctagttgttttgtggtcttctcttccttctttccttccttctgtcttcctcttagtgaaggtgattttctctggtggtatgatttaatttcttgcttcttatagttttcgtgtctattgtacgtttttcaagatgaggcttgcaaatactatcttataacccattattttaaacttaagacaacttaaaactgattgcataaacaaaaacacattaaaaaaaagaaaactaatagaaactctacactttaactttgtccccctgctttttaacgtcttgtttctctttgtttcattgtactatgtcttgaaaagttgtcgttatcatttttggttggttcaccatttagactttctacttgagtactctacatgccacaattacagtttgtttttgcaatcagttataatattctctgattttctatgtgcttactattaccagcgagtttgtacatatatatgtattttaatttttatattagatttgggggtacacgtgaaggtttgttacatagataaacacgtcatgagggtttgttgtaaatattcatatagatgatttcttattgctcattaacatctttgtctttcaggttgaagaactctgtttaacatttattttaggacaaatctagcattgatgaaatccctcagcttttgtttgtctgggaaggtctttgttcttcatgcttgaaggatattttcaccagatatactattctacaataaattttatttttttcctttagcactttaaatatgtcacaccactctctcggcctgtaagattgccactgaaaagtctgctgccagacatttgggagctccattttattttatttgtttcctttctcttgctgcttttaggatcctttctttacccttgacttttgggagtctgatatattaaataccttgggggtagtctttgggttaaatctgcttggtgttctacagtcttttagtacttgagtgttgatatctttctccaggcttaggaagttttctggtatcatccctttgaataaactttccatccccatctttttctctacgtcctctttaaagccaataatttaagagttattgcccttttaaggctattttctagatcttatagccatgcttcattcttttttatccttatttcttttgtcttctctgaccatgtattttcaaatagcctttctacatgttcactatttattttttctgcttgatcaattctgctattaagagactctgatgcattctttagtattccagttgcatttttcaactctagaagttttgcttctttttaactatttcaatttgtttgttaaatttatctgataaaattctgaatttcttttctgttatcttgaatttctttgagttttctaaaaagagctattttgaattctctgtctgaaaggtcacatatctctgtttctcctggattgatccctggtgtcttatttagttcatttagtgaggtcatgttttcctggatggtcttgatgtttattggtgtctaagcattgaaatgttaggtatttattgtagtcttcacagtctggacttgtttgtgcccatcctccttgggaaggtttttcaggtatttgaaagaactagggtattgtggtctaagccatagctgcgtgagggggcacctcaagcctagtaaggttgtggttcttgtagacttgtagaggtactgccttggtggtcttggataaaaccctgaagaattctctgtattatgaggcagagactcttgttctttacccttactttttcccaaacaaatgaagtctctctgtgctgagctgcctagggctgcaggtagagtgacatactacccccctggccctcactactgggactgtgctgggtcagacctgaagccagcacagcactaggtcttgcccatggctttctgtaaccactacctgggtaccacccatgttcactcaagtccctagggctctaccattagcaggtggtgaagccagccaggttggtgtctttcccttcagggcagtgagttccccacagccccgggtgggtccagagatggtgtatgggagctagggactgcagtcaaaaatccttgtatgtctacctgacgttttattctactgtagctaagctggcacttaaaccacaatacaaagtccttcctgctcttccctcccctttccacaggcagaggagcctctccctgtggcaaccactatcactgggccatgggtggttttctacaccaccattggtattcacttaaagttcaaaggatcttcagtcagcttgtggtgaatgctgccaggcttggacatacccttcagggcactgggcttccctctggcccagggaaggtcatgaaatgccatccaagaggttaggcctgggattggggacttcacgagcccacttgttggtctaacccactctgactgagctggtatctaaagtgcaaaactaagtcctctttactttcccctctgcttttctctagcaagaggagtctctcaccatagccaccacagctggcaatgttctgggtctcacttgaagacacgtctcagagtctcacccaaggcccatgccatgatgcactacctgggtattgcggctgattatttagtacccaaaggctctttattcacaggtgatgaatcctgccaggtgtggatccttcccttcgaggcagcggtttaccttttggcccatggtgtgtctagacgtgtcatctatgagttagggtctagcatgggggcctcatgactgcccagtgccatatcctactgtgactgagctggtatgcaagatgcaaaacaaagtcttctttgctctcctcttcatacgcagaggagtcacttttgttgcttcaagctgtgctgcctggggttgggggaaggatggcacaagcactcccttagattccctggctagtgtctccccaggtcatgtaccaccctagtccagtggctctaagcccatcccagcccagcactagaagttgcctaagaactgcaatccctgtgtcctagacagactttcaagtttacctagaaccccagagcactttggcctatggtggtgaggcttgccaaaaaactcaagttctgacaattgggatggtccattcccctctggctaggtctggtccaaatgttcccttcatgcatgagtgctggctgagcccagcatggctttgctctccactgtgacatggcagcactgagttcaatagaaagaccactagccactgcactctccctcccccaagtgcatatactctctgtgtagcagggctgctgctaggttatggggaaggggtggtgtctgtgattcaagactgtctctcctactctcttcaatgattctttcagtgatatgaatataaaaccaggtactccgattgctctgatttttggttcttgtgatggtatgcagttagttgttaaactttccagtatgcagatatttgttaaaatgtgttgttcctgtcgggggttatcaatggtacaggcttctattccgccatcttgctctgctctccaaaacacttcgaatattaaacactgaaataaatgtgagttatacatacatttaagaaagattaataaaacaaataaggtaattatttacccaattattccagttccgggttgtaggtggctggagcctatccagcggctcagcactcaagggaggaatcaaccctggacaggatgccattctattgcagggtacacatgtacacacactcactcacactgggacaatttagacacgccaattaacctaacatgcacaactttgggatatgagaggaaaccagaatacctggagaaaacccatgtagacacagggagaatgtgcaaactcaatacagtggccctaccagtaattgatgtttttttctcatcatttaatgaaatgatgttgaacaaaatgaccttattcgaggacctagtgtacaatgctttttgtcaggcattaatattcatgccatcaaaatcaaaagcacaggctcagctaaaatttctcaaatgcatggaaacaagcacctcaacactgttatcttttaatttcaaatggttacctgggctcaaaatctgggtgtgcaattttatctgctctgggcagtgctcaatatcgagcatttcttacaacaattaggacttattcccattcagataatgttgtcctagttaacccctttgtggtttttggagatgtaggtttattctttaaactttttttttttttttttttttttttgagacagtttcttgctctgtcccccaggctggagtgcagtggcatgattacagctcactgcagctttgacctcctgggcttaagcaatcttcccaccccagctgcctgagtatcagggaccacaggtgtgtgccactgcacccagctaatgcttttattttctgtaaagacaggatctcactatgtggtcaagcctggtcttgaactcctgggctcacacaattttcctgcctcagcctcccaaaatgttgggattacaggtgtgagatgcaccagaaacccttaaacttcttaaaaatcccttaagtcctcttggttttacaggaaagtaggagcttggattttagtttgatcataggaaacaagtagattgttattcattcaacaaaaaatatttatgataaacatttttcaggctatccatttatttaataggtctttattacatatttactgctgtcaaatgttttggggccagaggtgaattatgctagtttggaaactaggtggaatattatcatttaaatggatacctttgtatctcaaaacaaatcctgtagtttatataatttggaatattgtatgtctgttttccatggaaatgatgaagttcattggtcatggtactcttgggtcatgggactcacactcactttgctcttacctctttcttattttcacatgcatcccatcgacactcatgtctaatccagaagactggtagtatataagatcccaaatattaccactggctcagaatctgagccaatgaatggagagactatgtcatacttgaaataaacttctttaacaataaaaattaagagtataagttctctcatttcatctcagtttcatcaaatatttcatgtttaaaatgctagcaagtgtgaaagaggctatggaattttgtgagtgataaaatatttgtagagtacttggggatctggatctgggtgctattaaaaccaaccaaacacaagtagctcatatgagtccttcaatttttattcttgcttccaacttttaatcttccagcactgccaaaacatggaactaggcagatttatagcaattctggtagatgtttgttaggaactgatttcgtacaacactcttggcaataaaactatagttttctaaacttgacatttagcatgtcctttatcttataagaagaaaaatacttctgttgttctgttggagtaggttagcttataaaaataaagtgatgcatctttatatgtttttaacgtgtccaactttgccaggcatggtggttcatgcctctaatcccaagcacattggtaggccgaggcaagaggatctcttgagcctaggagttcaagactgcagtgtgctatgatggcatcattgcactccagcctcagcgacagagactctgtctcttaagttagtaagtaaataaataaaatgttcaacttaaaataaaattacaatttcttttctagcagctaggtgaaatttcttaactattaacctctggtactttaaacaacattaaaacagcctttaaaagaagacattaattaattgaggaaagattttaaaataattttttccaagttttaatttttaaatccctaaagaaccacatattcttgtaccatccaggtttataaaaatgcagctatcaaatttgatattaaaaacaagataccgcacaccctttgtggaataaagcacagtataaagaaaattagaatgtcatgaccattcttcttcaatctttcccatttgtaatatttcccccaagcggaaaagcctgacaaatttccctttcttgcacgtgaccactttttgcatcagatgcatttaattttgtaggttaaatattcaggacaaaaggagagtagaaagaatttttagagctttgatttctatggaagcaataagctgaaacttggaaataatatgtttcattgccatcaatcccattgtagctagctaacactccagggatttccttgattctctctataataatcttatacttctatagtgcttataatttgcaacctgtgttcacttactttatgagattcttacaaaaatcttttgaaagaaggctagtgtgtatgtatatgtgggtgtatgaatatacatatatatgtgtatatgtttgtctatacatatacatatgtgtgtgtatgacatatatatgtatatagtcatccctcattgtccacaggggatcggttccagaaccccctcagacaccaaaatttccagatgcttaagttttttatataaaatgactaattggtcaattcttcttggtaaagttgatcttgatcttaccagtttcttttttggcttagtaataggaacaatgattttcataatttaggggaccaaaagtaaaatttcagtttaagtcattttaggaataaaccatggagctataaatcttttggaggagttatagattcagtgttaatgctagagtattgcagtatattaatacaacagatagttctgaaaagttgctttagaaaaatgtttcagctaaagtgacccaataccaaattctgtacagttaccctctattttgtaaatgcatatgttaatatcaaagtatttatattgtgtaatttcctaccttaggtgcttttgtttttaatataatgctgtttcaaggtcgaatatgtacagtaataactgttacaaattgattacgagagatcacaatcattgtacaaatcacaggctatgtcattgtgtagacaaaaatcactgaccatgcatgccagaggtggatcataaatagtaactcctaagactagaaatctacttgatatttttatgggttcatctttaaaagtgacctcgctgaataaaagttcaatatttcttaaaagaaaggtaaatctaaaaaccgtccagaattttcgatcctagtctagtaccacttacttgggaacaaatatagaagcacaggcaaccccgtccgttaatttggctccgtcattgtgcagacaaaaatcactgaccatgcatgccagaggtggatcatagttaactcgttaagactagaaatctacttgatagtgatttttatgggttcatctttaaaagtgacctcgctgaataaaagttcaatatttcttaaaagaaaggtaaatctagaaagctgtccagaattttcaatcctagtctagtaccacttacttgggaacaaatatagaaacacaggcaaccccgtccgttaattctgatgttgaacgtgtggttagagagcacactgcgatatgttacaggacctgagataaaaagcaaatttgtaaagtgtctaagtgttgatggagaaaaacacatctagcatatacggaaattttcttttgagttctctgtaggatgatcaccaactcagtaggtgaagccctgccctctagtggttatgggtgtgagaggacttctgttcaacattatatgtctggctcaccacggtttattaaaaccaatcgttcattaaaaagcacttattaggggtctgggtaagatgccgagcaagtgaaatgtttacgtgtgaaaaggcattgacactggacaaaggtacagctgctaaaagaagtgctcgttcattggcttcgacagctgtacgactggtttctaattgctgttccagcctctccccagttccatataccacaaacgaatgaaaaagattagctctccctggagctctctgaggctgaaccttgctctctcattacacatggtaactaagcacaccccttaaagaattttgggaagtcgccccgcgattaccggctcccccaagaaccaagcagtcagtgcagggttttgcaagtgagagtgcgagactcgggaggctgctcacggtgctccagtccctggcaggagcatggacacctcgccccttccttccgtgggcctcaacgttgcctgctgagattgtgactgccaccccgacgggagcagcttcccctacagactttgtagagagcgcttaaacgcctcggggacagcggccatgactctcagcttgggccgaccccgcggccgccccacgggaatgcgtggccgacacggggcgtgggcgaatctccgaccctcgcgttcagggggtgcatataaacgggcggacaccgtccctggggtaagggaggcgccagcaagaacaaggcgggccaccaaccccgagcgacctcctaccggacggatccaaacccaaacattgtccattccgggccgaagtctcggccttcacttcacttccgccttcccagcccgtgaacacgaatgcgcctgcgcgcacctctctcagcggaagtaatagtgacaaagctgggttcgcggctggcccaggagtgcggggcgcgactgggcggccggcggcggggaggggcggagcgcaggagtcggaggcgggagcagaccagcacggcctcgcggagccggcccggcggaccgtgacgggtcccctcacctcctcttctctcccctccccgcccgccctctctccctcccttcctccctcccgctcgcttcttctcacgccgggagcaggctcccgcctcgcaccgctgccccgcgagcagctcctcttctcccgaggcgcgcggggcgcccccgcgagccccgcggctgagaccccgcagcctggaggagggctgtccggggctttgggtgggtaccagtattacctcctgcccccatttctagaaacttccaggttctgaaggaaggggaggttcgggtatcccctggatgggggggcatctctagggcgccgccccgctggcgtgagctggggacgttgcgggcacacgacggggcgggtgcgggatcttggggaggggggctcccgagatagtggctgggcggggaactccttcctcagcctctcgtcagcgccgcttctcctggtttctcttgcagatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggtaaaggcccctggccgaccggttgcaacgcggagttgagggtgtggtggtttgcttttaagttgtctttgtttttccacctttttattttcgtgagcttatttatttactgtgtatgtgaagtgtccaaggatttgcttacttagggtatccagcttttattttggtaacatggggcatttgagagattgaggttctgtgggtgactgagcttgattcagctttcttgaggaattcctgctctcttcagcttagggaatgagagggaagttttcatttcagatagcgtctgtgcatgtttaaatagctatttgaaaggaattactcgaggggaagtggaaatgggggacaaggggatggggctgcatctctgtatattggcgtttcaagcctcgatgtggtgtgtggcaggattcatttataagaaagcaagccatgttttattatgtctagcattggggaaaaaactcattatttttcaattcacaaaaaaaacccagtgaatttaatgaaatgttatgagatgagtgcttttcttaaagttccaccctatttcaaaacatcatttaggaggctgacagcggaacctgtttgttcactgtacactttggacacattagatcgtcattcacatgttacatgatccctttggcctcgttaaaatatttaatgcttttcctacacagcactgattatttttaaaattgttgaacaactgtgaataagtgattttttttccccctcctgaaacaacacttattctttggactgacttctgacttgtgcgtgatcatttttttttcttctgcctttaaccgggctgcaaaatactataaaagatacttaacaaatgacagttttttcctctggtataatttgttttaaaaaatatgtgtctggtataaaggagctgcagtcttgctggctgcttctaatttgtttttccattgttgagaatgtaagcttgattgtctgactaggactagtaattttgaaatgggtgtttcttatagatgcagtaatgtgttttgctctctgagacctctgggctatgtagggaatatgatgagaggcatgattatattgacaaattttactctggatggataattggcggaagacattttctgaaatactaaagtgtataactgcagaggagttatactgtctaattgggtcttgagaaacatttgaaagcagtgatgtttttggtgataaggaaagtcacttttctgagcctttttcctctcttttaagtttattgatttaagaaaggcaaatccattctgcacatgagacaaagaatgttaaatgcattcatatacttgtttcttggtagaaacatcttaaataacttctaacatttaatgtatgtttatgagcttgttttcagaatggtaccagatttaagagggtagcctaaagtaggtggattctttcatgttgcttttgtttcttgatctctcaggaggaagagcatgagtaataaagccgattctcattatctactgaggtgggagggggtggttgtgagataggagaatggtgcctacttgtgtctgtctctgtattttgtggccaaatatgaattttgtggtttcatagtaaaagattatacagttcttaaaaacgtgtggggttttctgtcccgttattcttgaccatcaagagaccatttttgtcagtttctccctatcgtcacatttttttttatatataaacagtttgaagaagagcctgtatatagcctagaaattttcaaaagtgactgaccatattaaactacatagattgatacctgtgcctttttattgttcacttgcctttttgtagttttcatccttctttgatatagtgtagtattaacaatttggaggtgtgaaacaaaaatggattcaagtcttgactaacttgtcttgaaccacttaaagctgtgtgattttaagtaaattacgtcacctttctgagcctgtatttcttcatctataaattgggattgataatctttaactcacagaattgagaggattaaatgagaaaccctgtataaattctcttgtgaggtaggaatgataacgtttaagagcttgagttgtggtggaaccatgcagactgatttgaatgctggattcgtcgcttaccatttggctttgtgcatattaaagttttctgtgcttccgtttcttcataaaataaagataatgatagaacctaccttatgaggttgttgtaaacattcaaacagtatctggcacatagtaagtgctcggtaaatgttaattataaattgcctagctgaatgtttgatacatactaataggccacctggcattaatattgtcatgacagttaaatgttggaagggggaacagtagtagccaaatgctcaaaatgaagttgtcattgttagttgagggataagtggagttaggtaaggaattttctatggcattagtgcttttaagcctacagaaaaagttagggctctaccaagaagccagggtccagtacagaaagagacaggtttggatttgaagcccgacaagtaatgttttcctctcctgaaaaatctgacaagttactaggcttctaagctttctcagcctctaagttatctcatctgtaaatgagataatgccctcttgcaaagttgatgtgagtaataaatgaagccgccagagcaatgtttgacatacagttaacttggatgaattgagtgatgctgctgttccctagtaagagtatcctccagtaggtatgcaggtagttacatttgtgggtgtgaacagtgtagaattgatagtgtttccctagagcatcagcatgaaggtttcttaggtagcttacagtggtgtggggaggaaatggtttcatccatgtgttggttccttcagcaatggtggtattttctttggcacttcggtttagattcttctggacttttttcctagggcccatttaaactttctcagcaaagcttgaccaatttttagctgtagactccaggatgtttcatgaacactttctgcttgtcactaggaacgtttaaaatgttaatttcctggaatttttggactacttaacattcagtcgtgagttaggattttatccagatcctttggaatttgtttttacatgtttatcacaaatctaaacagatcccgcttaggcatcttgagatgcacaagtaaacagctcttacctgatttttaaaagttaattgcatgtttaaagtgatagcttactagaaaagatatgtctagctggagaagcttgcacataggttttcctttctagtaatggatttattttttggaataaatttggcctttcccatagaaaattcagtgtgactttaatacacatgaaactttaatatagccttaaatgtttgactagtggatagaaatgtaatagtcttcaggatttcaggacatggttaatttaagattatagacagagctaataggtgtagagaacaatgccccaatcttttttgtttgaaaatggttgtatttacactttacttttaaaagcagtttcttaattcaatttcaaattgttaatcagctaggaatgtctcaagaaaaaattgcattactatagttggagaagctatagggaaaaagggatgagaagccaccttaattttattcctttaactgaaaataggaaaccaggttataaaaatatatctttgggtgtgggaaatatagtttatgttgtttgcagttttgtccataaaatgatagtcttaattagtactctgaaaaagagttgaaactaaaagagattatatatatgacattttgtaaactgtagtaatttaagccagaggatgctgtagagagtacttgtatgcaataaccttctgacagttggattccaaatacttgatttgtcttcatatttttgtcattcatttaaagtcagcagaattcaggtctgttaacgcaaagcattatgaaacaaaatagtttcctagggaacacacccctaggggcccaggactgattttggagatcttagttagccatgatctgttttgcaaggttaaattttgttttaaaggtgccaggaacactgtggcttgatggtaaagttagcatgaattttaaattacaccgttgttacatgtagcatcttaaaatatcttaaggatcagttcaagaggtcccctcacatttactttgttgaaacaaattctttttaataatggtttcaggcatcagttgtgacaaggttatctttatgcttttcatgtagacaaatgttggtaaaaggcagtaaagggtgcatcctgaggttaatgccatcatttcatgaaagaaaggatctctcaaaaaaaaggctaaattgataatttcctcttggatgtatatgactgctacttatatgcatttgttaatacagttgacccttgaacaatgtgggggttggggtgctgacccaccatgcagttgaaaatctgcatgtaacttttaactctctgaaaactaaactactaatagtctctactgttgcctggaagcctcactgataacataaacagtcaattaacacatactttgtatgctatatgtattatatactgtattcttgcaataaagtagagaaaaaaacttaccaagaaaattatgaggaggagaaaatatatttataattcattaagcagaagtggatcactataaaggtcttcatcctcattgtcttcgctttgagtaggctgaagaaaaggaggggttggtcttgctgtctcgggtgacagaagcaaatctgagtataagtagacctttacagttgaaactcatgttgttaaagagtcaactgtgtatcttctgtcttcaggctttaagttgctacgacaaaagtataaatcgtagaattacaaataaattacaccaattgtgttaaattaggttggtttagactaaacctgtgatgtgtttagaaaaagtttgaatgaaatgttgaaaagctgtcctagattatagacagaagacagtaatagtcggggtcagaagcattatcttaagatggccgtaactgggtgtctgattcaatttctatctctgctttttttaattctgctataggtattagagaatgtgtgaattggaattatttaatatacctgttagttgtaattgctttcttaagtaaaggccttttggtttgacatttggtcatttcgtaaacatgctgacctaaactcgtgtccctccctcagaaggaaatacgttaatttagtatgacatccttttttttccctttgtgcttatttatttatttatttttttgagatggagtctcactctgtaacccaggctgggctgggacacagtagcatcattatagctcaccaaagcccctaactcctggactaatgcgatctccctgccttagcctcctgagtagctgggattataagcacacatcactatacccagctaatttcttaatttttttaaagacgaggtcttgatatattgcccatgctggtcttgaactcctggactcaagcagtcttattgccttggcctcccaaattgttggaattataggcatgagccaccgtgcccagctttagtatgacattctttattcttttagaaagctttgagatattgatgcatccttatagaaattactttcatttatttatttacttacttaaaacagcttgataaagttggaaaaagcaggaccctaaataataaatatatttgccatcagccttttataggaaaactcagaaataataagtggaaatatttaggatgtcactcatcagactttttttttgaatatgtaaatgtgtttttttgaaaatttaaacacgcaaagtaaaaattaaaagttttggttaagttgtgaatttcagaaatttatcttggttatggtgtcctgaagttaaaaagaatagagcattagtacattagtacataaacgttctgttattctctgcctaagggcaagatccaactttgaaccaggtcctggatttcctctcatcttaaatcggagcctttttcatttgtagtataaataaattagccttttgatgctgtgattttatttgtatatgttatatatgagatttatatctctctttgtatgcaggcatttcactagattttgtttggccatctatttttagtgtttccctagcagcatgtttgctttacctgccttcatctaggtttctacatcatcaggggtggaaatattagttggcttaattaagcttgggagttgtaccttacttgctctgttgagtgtcagttctaccttcttttgaagcaggcaaaagcagttcatggcacaaatgccagaaatagcatgcaaaccactttgtagtggtatgcaaactaatttctgctgtgtccttttcttaatgcttgtgagggttactgtttacttaagagttaatatttggcttatgaaactagtatcagatgagaaattccagcatccctccccaccccagagaaagatgtggtcattggggactgctctgaagtctgccagccctctatcctaaaagttggtagatcagttattatatcttgatatgtacccctaattcatatgaggggccaagagagattagttactcctgatttcatctgttagaagataaagggagtgtggtttgtatctatattagagtaatgggaatgaagggtagggatggatgacagagatattttactcctaggaaaaatcagcaggacttggacagtgactagatacagagaattaagggaatagttgaatcagacatgactgcaagatgtcatttgggtcagtgaaggtgccattgattgtggttgaaggagtgagccgatttaggggctggctgaagggaatatataggtcagactgtcatgatgtgaggctcatatagctatgcatggagagaggtgttaaatcaagcaccaggattcaaagtgagctcttgaaggcagagacctcaatttgtcctttattcatcttgaacagactctgggacgtacctactgtcaattgaatgaaaatgctggcttcttccttctaagtggttctcatctcaggattgttttgcccccgggggacatttggcaatgtttagagaaatgctgggttgtcacaactcaaagtatgctactggcatccagtgtgtagagaccagggatgctggtaagcatgctacaatccgtaagacagcatcttctacctccccccgccaccctcaaaattttttagccccagatgtcaatggtgccaagattgagaaacactgttctaacaaacggcaaggaagttgactcctctaagccttggtttcctcacttgtaaagagattatgactacttcaggtttgttagaattagaccaggcagggtgtgtacaagtgcctggcatgaaagagcctctcagcaaatcctaatttcccttaccttacttgatgaatagatttaggggagttacttttggtcttttaactgctaatttcaaggcttcacgttttttttttttgtttttttttttttttttttttttttctgagaggtgagtgggatgcctaggaaacatagagtagcttttataatcttaatgcttttctcatggttttatcaaattatgattttgattatactttggtttgggtttgtactatttcaggattcagtatttagtgttcacctagcagtagacaatgaagttaaacccttagtgtagatcaatgaagttaagcccttaaattttactttttagcctgtaaatacattttatgtattatttattgctcacagaactgttattgtttggaagcaattttactattctttgaaatcaagaccaaaatgtactgaattttatttctcatggaaaatgctagacctcctatgtctattgcctttttcctttttatccatttattctaactagaccccccccgaagtcagaactcttccttagatttcctttttagggtcttcattaggtggctttcttttgcttgtcgggtgtctttttactttattttgtaaggtgttgaatattccctttattttgtaaggtgttgaatgtttcagtggtgttagggacaggaccaccgatattttcatctctaataccaatcccttagtgatctattccagtcatagcctcagtgtttaaagtctccttacatgtacatagttgtgtggcattctcatttttagggagtcactggaattctttgctgctatttctttccttttaggaaaaaaaccggtttactcttactatacattattttctccatctatagaatggaattactgtaggtaaaagtccttgagttcggtaaactatgtattggacttactaatgtacgttttattaattgcaggtggaatttagaaataacctgcctgtttttcatcttaaactaagattatttaaatattccattcattaattagttggttagaaaaattagcttttgaggaacaccacttaaacatggaaaataataacagagtacattttgtgacagcaaataaattatcggttaacttaaccctataggattcaaagttggtagctttaaatgatattaaattgtatttgactgtcaactgcttttaaaggcttacgtggctccccattgtacctgtagttatttaggtctggaagcacagggtgttaagaatgccaccataatgtcttttcataagggtttggtttgtcatagcctgtaaaattaggttcaccagttagctgctttatgaaatgaatgtcattggtcatggtgggggaggtattaggagaaggtataaaggaatctaaaaaaactttctttctttctctccctccctcccttctttccttctgccccttcctcccccctttcctttcctttttcctctttcccctttcccatttcccctttcccctttcctttcctttcctttcctttcctttcctttccatcttctgtattgctagtaaaataattgttgctcactgaaggctttaaaaaacactggttgcatgcttaatataggatggcaacaaaatggacgggtttaaaaaatatgtagatggtatgatacccctttcctccatccttgtaccaaatttctttcaaacctagaataatttatacaaacagatgtatcagtagatggagtattatgcccactttttaatttaatgatcaaaaaatgccaaattcttcccagagtggcagtataattcagatgtagttaactgttggatgcaaattcaattatggtagaaagatttactttactttgagaggtttttctaaaatcttctaaaattatgttgatttttaaaatttgaaataactttagacttacataaaaggtataaaaatagtacaaagaggtcctggatatcttttgcccagttactcctaatgttaacatcttatataaccatagtataattattaaaaccaggacattcacatttataaactatcctttttctagttcaggatccaatttgggatcctaccttgcatttagttatcatcatgttagtctcctcccatctgttaagcttttcagtcttttttttctctcatcttttataaatgttactgacacttttgaagagtactgttagttattttttagaatgtttctcaatatggggttgtcagatcttcacccgtgattagcatgtcttatgatgggtgaagttaatgtgatcacttggttaaggctgtgtctgccagatttcttcattgtaaagttactgctttttcctttgtaataataaatgttcattttaaccttgtagttgtataataattagtaattcctttgtaattaataccttcctctagtggggaggtactgcaaatatactgtgtcccatcatacttatcatgggccagttttgcaatatcctgtgttccatcatactttacatgggcaagttttgctatctatcaatggttcttaactggcagcagttattactgctttggtctttgcttaatggcgagttttctatttcactcattcttactatatttggaattctacaattaaggaagtactgtcctctttacttattaattatccaattaatttatttacatggctttgtggatattttgccttatgggttaaaatccagtaattgttgctcaagtcattctcgctttggttattgagggcacttgaaaatttgttcctgtgtcttttctacaataccctctctcattttgtgagcactaatttactttctggtatcacatgatgttctgggtgtatcttgtatttttcctgcttgcaccagccatggaatcaaccatttttccagggagctgagttcattttactagagaatgatatctagaaaccaagatctgggtgccaggtgtgctccatgctactgggtgtcattgcttctaggctctcttagtagatagagctagcagtgtatatgtttggtaacatgtatgaacacatatgtttttattttcttatctatccatctatgtatataaataaaaaactgccagtgatgctgccagttctgttcttccaccatagggtccattttggtcttttttcctgttcagcccttttctctttctttgttacttccttctccaaaggtgagaaactgttctcaaccacagtatattgacttacttgtttcatccgagtacacacaaacaaaagtagttttagaattagtgacctattcattccctggtgagaaacacagttttaaactagagtacaatatttgtctttaactttatggtatacaggcaaattctgttttcagaagttacttgggttcttttcatccctgcctaagggttatgttagtcacttgtaataaaattaggttcacttgttattgtttgtatgctgttttaagttcctcctacatcctgtttcatcatagcacagtatccctctcccatttatttatgataaagatgtgttcttaaaaggactggatttgcttaaggttgggtacagctgtaattgctttgccagacagcagttaaaggacatgtgctttggcaatcattctcttgggcttgcttgcctggttccttagtttcagctctcatttctacatcgtttacacttgggaattgatatcagctgtggccccataactgtcagtgcttgaaatcatgcccatcgactaaatcttatttgttctgtatgcacagttttagacccggagccacctacagtatgaatactaattctctcatagctgtggtaaatcatgaagtattttgtagaccctgtcctttactgggtttttctttttcaagatagaatcacttaccacaaaatttgtcattttaaagtgtataattcagtggtttttagtatagtcacaaaattgtatattgatataattctagaacatttttatcaccccagaaagaaaccccttacccattagcagtcacttcccattctcccctttcgctagcccctggtaaccactaatctactttgtctttatggatttgcctgttctgggtatttcatataaattgaatcatacaatatgtgaccttttatgtctggcttctagcacgtgttagtacttcatttctttttgcgatgaaataatattccattgtatggatatacacattttgtttattcatcagtttctactttttgtcaaaaaataacactattgtgagcattcatgtatgggtttttgtgtaaacatgttttcagttttttcaggtgtatacttaggagtagaagtgctgggtcatggtaattctatctttaatttattgagtaactgccatagtggttgaaccattttttcattcccactagcagtgtatgaggctttcttttaattaatttctccacatcctctccaacattttgctgttttttttttttttttccattgcatcctagggggtatgaagtggtttcacattgtagttttgatttgcgtttcccaaatgactaatgatgtgtcaaggatcttttgcatggattcttcatgcaaaagaatgaaggtggactcttatctcacagcatatgcaaaaatcatttctgcactctgacttctaatctgttggtttataagtctttgcagatccaagtaccacaatgttttggttactgtagattttgcgataagttagttttgcaactaggaagtgtgatgtgcttattggttatttgtatatctttggagaaatgtctattcaaatcttttgaccattttgtaatttggttatttacttttttgttgagttgtaagagttctttatatatatgtgtgtacacacacacacacacacacacatacgtttattctggatactggataggaatatattctatacttgtaccagtatacaaagatgtttacctaagagtgttcactgcagcaatgtttataagataattatcagagatatggtttgtaaatatttctcccattctgtggattacctgttcactttctgaatggtatcctctacatcagaaacttttaaaattgtgatgaagtccaatttatatatgtgtttcttttattgtttgtgctttatatatctaggaaaccattgcctgattcaatgtgatgaagattataagaattttatagtttaactctcacgcttgatccattttgagttcatttttgcatatgatgtgacataagggcccaccttcattcttttgcatagaatatccagttatcccaatactgtttgttaaaaagactattctttttccattgaatgtcttggcacccttgtcaaaaatcaattgaccagaaattatgggtttatttctagactctgaattctattctgttggtttatatgtctttgctgatgtaagtaccataatgttttgattactgtaggttttgtagtaagttaattttgaaactggaagtgtgagacctttaacagtgtctgcctttcttttttttttttttcagattgttttgtctattctggatcccttgcatttccatatgaattttagaatcagtttgtccatttctgttaaaaaggcagttggaattttcataagcattgccttgaattgtcctttactttgagaatataatattcttacttaggtacaaacataagactttttgagtactatgtttgggtgtgaccttattctaggtaacaagcatttcacagaaatagaaggccaaaaggtacatgaaaagatgttcaacctcagtcatgaagaaatgcaaattaaaaacaaaattataatttttcacttgtcagattggcaaagattagagtgtagtgatgactagtcttggctagactgtggggaaaatagaagcttctgagtttgaagtttttgacacagtccctttggagatcagtagcagtagctatcagaataaaaaatatgaacaaccaaagtttcactttcagaaatgtattctgtacctgtacttgcacaaatataccaagaagtttgtacaggatgtttactgcagcaacatttgtaataccaaaagacaggagtcagcctaaatatcatcaagaggactagttaaaattgaagtactgcatacaatgaaatgccctgtgagccactgaaaagaatgaggcaggttagtatgtaaggtgacatggagtccaagatgtattgaatgacaaaatttgttattgtgtggttctattagaaattaaaaaaaaaaaacaccagaaatacttgtatacacacctgtatagaaaatggctggcagtatacacagaaatagttaacagagattacttctgggcagtagaactggaaatctcattaaatcctttctcattacttgactttttttaaaacaatgagcaggtttttgttttctgaaaaatcattaagaatgactcagtagtgcaagtaaaattaaaattaatactactctttaggaataaaatatttgtttttttctgtcagtttgattgttttatatataatatctgttggtctctagagcagtttgattgttttgtatataatccctgttggtatccagaggtaaatgcattttattgtgatttttattgctgtgtggaaaatggattagaattagttcttgggtacaaatatttaatagtatttggaaccatatttttcatttctacatattgtaagtatgggagaaaaataagatttatcttttaagagttgtgattgtgctagtttttaatttatcaaatgaagaatatttaagaatatttaattctttaagtacaaagaatatttaagaatacttaagagcattgaagcctgattatgccactgttctttgggttcatgctctggaacttaaggttcagtgaagaaggtaaccatttcatagtatctcccttaacaaaggttactgatacattttcagaaaccttagtaccacaggcagtaaggaggcagtgagatccctctggattttgccagaccattcctagaatttttaaggtgaggggaccaatttcccaccccatatagaaatggcaccaacatctctcctagaaacttcctggtgattggaaactttttatctgttgatgctggttctgtctttagggagaatgtcatgtttcatgtaacatatcttaaaatatttgaagatacctgtcatatcctttatttagaaatctttattgaaatccaattaatggtcaggtactgcccttcatacttctctaggccgaatattcctaattccttccactgatcatcttaagacctcatttccagaaatgtcaccatagtatgccatgcttggtagcaggctctaatgatgccctaaactgaatatagacttctcaaggtatggttggattgttgtgaaatagtctaggctcattgactcgcttggactaaaaagctatctttctcataatgcagtttaggataatgtttacctttttagcaacaggtttacactgagaatgcttttacagctctttaaatgatgtatgaggtcaacttaacccatgtgtttgtctgaattattattgtagagccttagcatctggtatgttagtagttggtttttcggtatagtagtaggttttatatatatatttatatttatatttatttattgtcaatagagttagggtctcactatgttgcccaggttggtcttgaactcctgggtgcaagtgatcctgctgccttggcctcttaaagtgctgcgattacgggcatgagccacggcacccagctagtagtaggtttttacatttatttctcataagtatacgtgtatgcttttgtaaatgttgaggtggtggtatattgcctcttctcgttgattctgcctgataatcagcttgttagaattttgttttggtttgtagttctccttgaagaggtccttcacatcccttgtaagctggattcctaggtattttattctctttgaagcaattgtgaatgggagttcactcatgatttggctctctgtttgtctgttcttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactttgttgaataggagtggtgagagagggcatccctgtcttgtgccagttttcaaagggaatgcttccagtttttgcccattcagtatgatattggctgtgagtttgtcatagatagctcttattattttgaaatacgtcccatcaatacctaatttattgagagtttttagcatgaagcgttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtagcagttcctccttgtacctctgatagaatttggctgtgaatccatctggtcctggactccttttggttggtaaactattgattattgccacaatttcagctcctgttattggtctattcagagattcaacttcttcctggtttagtcttgggagcgtgtatgtgttgaggaatttatccatttcttctagattttctagtttatttgcgtagaggtgtttgtagtattctctgatggtagtttgtatttctgtgggatcggtagtgatatcccctttatcattttttattgtgtctatttgattcttctctctttttttctttattagtcttgctagtggtctatcaattttgttgatcctttcaaaaaaccagctcctggattcattgatttttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaattgaggatacaaacaaatggaagaacattccatgctcatgggtaggaagaatcaatattgtgaaaatggccatactgcccaaggtaatttacagattcagtgccatccccatcaagctaccgatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccataacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggaaacctacaaaatgggagaaaattttcgcaacctactcatctgacaaagggcaaatatccagaatctacaatgaactcaaaccaatttacaagaaaaaaacaaacaaccccatcaaaaagtgggcgaaagacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacatgtatgtttattgcggcattattcacaatagcaaaaacttggaactaacccaaatgcccaacaatgatagactggattaagaaaatgtggcacatatacaccatggagtactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagaccacatggacacaggaaggggaatatcacactctggggactgttgtggggtggggggagggatagcattgggagatatacctaatgctagatgacgagttagtgggtgcagcacaccagcatggcacatgtatacatatgtaactaacctgcacaatgtgcacatgtaccctaaaacttaaagtataataaaaaataaataaatttaaaaaaaaaaaagaattttgttttggttatgaggcaaggtgggtatccctctccagccttgagttaatgtcatcttggataagtatgctattcagtatttatctgagttgttgataaaatattaacagaatagagcctcgtggcatacctagtggtactgagttattaatactactggcccacctgtcagaaattatgcagtttagctgtgtattttcatgtgacagtgtttataaaatgtcttgttggcatcagaagactgtacagccttactgtacttaagacatgctgtttttaaatgattgttttctccttttccaaagttaaaatctgctgtatttatttaagatttttttggtgtgtgtatgggggaagaggggaggtggaaggatgaaaagattctttgcactaagtttgcttttggttaaaaagaagcctgtattcttagatcttaaatctagtctcactatactaaaattagtcccctaaactggatttactttgaaacttttggatgacctgactaatttaaatattgtacaatagttaagaaggaggacttttagtgttacacaatggttcggttcctggccatatcacttactagttttgttaatttctttttgtgttgggcacattacttctttaatctttaatttccctatctaaaaaagtagtaaaaataatgccctcttcagattgttttccgaggattaagtgaagtattagaaataaagcactcagcatcaagcactggtacttagcagcttaacgggcaaacctgctctttccctcctcctcctcctccttagtactcttcttcctattatgtttcctccaactgttactgtgataacatataaatgactaaatgtgaaatcagtagagttttagactttttttttaactcaaagcttcaaactaaaaacagtgtatttcttgcagatcctttaaggataaatagttgatcttttaaaatgaaagtgccctgtgaaagtttcatagctaaacatttttgttctttagtttaaggcttaagccatataggtttttttgtttgttttttttttgatttgttttaactagtcaagtgcatttcagtgagaagggagaaagagtagaaaggtgttggatctgtaactgactgtgaacaatcagttgagataactcaactgccttcagaccagccaagccctatagttttacaagaaaaaacccattcaggttagtaactcatgttgaattacttttggctactttgtgttcaataatatcattctggggtgtctttgtcttttttggggggcaaggaaatggggtcttggtattttgcctagcttgggcttgaactcttgatcttctgctttagcctcctaagtagagggtgtctttgattatatcttaataaaaggattggaagttgaagcaaggaattaaaaacataaatgtgaattactgatagatgttaggcaagtagttgtgtaggtgggactaacttgcttgactaagattttgattgcccatccctttcacgttctacctccctaccccataacataccttgaacatgaaaacatggggaacatagatttcaatagaagaagcccaattatttgtgaataagtatgagaaccatctggatattctgcagttgttataatacagagcaaatagagcattagcacctacgggaaagcagttggattgttgaatcttctttgacttgtttgttgctttggatgacaggagggttccttcctacctcttagtaaagattgggaaagaaaagagttaattgtgaacttactgggattaattcattctgggttttttttttttcccccccttgagacgatgtttcactctgttgcccaggctggagtgcaatggcgtgatcttggctcactgcaacctccgcctcctgggttcaagcgattctcttgtctcagcctcccaagtagctaggattaaaggcgcctgccactacgtccagctaatttttgtatttgtagtagagacagggttttaccatgttggccaggctggtctcgaactcctgacctcaagtgatccacccgcctcagactcccaaaatgctggaattacaggtatgagctactgcgcccggcctaattcattcttaattataagaatgtacagtttttgtttagggatatagtgttagttgaaaaattagggaaaaagtctgttacttagcttagtttttcatttatccttttatttagcagttactgagtaccagctatatgccaggcatagtgagtgttggtttgtgtgacctgcagttcttgtagctattgagtttatagtgtagttgagggaaaaacacgtttggatgagcagtgatagttacgtggtaggggactgagtgtgagtaatcggttcagggttgtcgcaagccaacacaaaaaagctcatagaaggaatgaggcctaaaagcttagtgtagggtatggagtgtgcaggctggacctggcttttgcctgcagaaatgtgctacaagcatttcagacaaagggactcagtggtagacctcttctacatatgccacttcagtagtgtggttttagattttatatttagccatttatatttagcctgaggcgttctgagtcagtccaaatccactgtcactaaataaatgggttatgtatcttaataacagaggattagccatccttatatgtgaagggcagcattactgggacatgtaaagcaaacttatttgtgacaacagaatatttaagtatagttaataaataggattcttatagtctcctattaggtaacattccttttagagatcctcatggagtatgagtatttaaagtgaggtggaggccaggcacagtggctcacgcctgtaatcctagcactttgggaggctgaggtgggtggattgcctgagcttaggagtttgagaccagcctgggcaacacggtgaaaccctgtctctactcaaaaaaaaaaaaaaacaaaaaattagccaggcatggctgcatgtgcctgtaatcccagctacttgggaggctgagacagaagaattgctttaacctgggaggcagaggttgcagtgagcagagatcgcgccactgcactccagcctgggcaacagaacaagactccatctcaaaaaataaaaataaataaaaaaataaagtgaggtcgaaactatgattttcttggaggacgggcccaaaaggtgattgattagtagggttaaagattaaatttgtgcttaaatttatatatatattttttctttcttctttttttcttttcaaagccattatgtattgctgcagtaccaatttcttttgccttagcggggaaacagctggtaccattgcaggcagaattcaagttccctgattaatgaagtggaggactgtttgaatctttaatgtcttacctttatgtgtaacttgacccctcagttctcctttttctttttttattcagccactcgacagctcaatttttctttttctttttttattcagctctcagttctctatctttttattgtccaaaaaccatacaaatggtgttttcttgcccacttttcttactcatgttgaggattggtttttctaaacatagcttttgtaaatcaatgtgtactgactgatttcacttccctgattatatccttaaagcagctaaggtcattggttactataaatgaagtacacacaagtccgtgacttgtgatggtttgacttaggatttttcaacttcacgatggtgtgaaagcagtagacattcagtagaaactgtacttctgttcttcactttcagtacagtattatttattaaatacatgagatagtcaacactttataaaataggctttgtattagattattttgctcaactgtaggctaatgtaagtgttgctgagtgtgtttaaaataggctatgctaagctatgatgttcgcttcggtaggttaggtgtatgaaatgcatttttgacttgttactttcaacttatgatggatttgttggcatattatcccattgcagttgaggagaatagtggattctatgaagataaacttaactaccaggtaaaagacatttcttttttttaaaagcagattaataatatgtgaacgcctttggatttgttttatctaagtaagactttagattttgttgtgttatagatggtttgcaattgtgtttaacacataacagctgggaatgagtgccagagtattatttctgaatcttgcttacatggtagtgtgtgctaaaaattaagatgtaaaacttttgcttttattttacctcgacatttaaaaacactagtaaaacttgggatcaggtgaaaacttttttgttttacttgcaaaaatattctcttaaaaatattgtggtaaagagatctagcctcttaatgaattttaaagtatacattattgttggctataggtacaatgttgtacagcagctctctagtgcttattcatcttgactgactgaaacttcatgagctttgattagctactctccatttccccttctcccagcctctgctaaccatcattccactctttgatttttatgaatttgtattattttagatagtggagttatgcagtcatttgtctttttgtgactggcttatttcacttagcatggtgtcctcaagattcacccatgttgtgccattttgtagaatttcttttttttttcaagctgaagttttatttaaattgtaaaagaaatggttcccaaaaaatgctggcgaataaagcaaaaggataagatatagtgctcccttcctacgagttagccagcctatccgagtacagggtaatatatagtacttaatgctggtagaattttgcagtagtttagaaagattatctgtgcctagattatgaagagattctcagtgtgtgatgcttggttctgggtttacaccttactgggcatgaacaagagccctctccttggccatagccaaatcccttgggcccaaagttctttgcatagcaccctttacaatagatttcaccttctttttcagtcaggagttgttgattcaagactcttcccacactttgcacatcggaaatagtttttgttccagggctttccagctccagttaccttctcagcagcatgtacggaatccccacatctggaacacttctcagcacctctgtatttctgagcaaatttagaagtctttggatttgcttgtaggcatgtgaggctgaacactctggcttgatgcccaggctctcaccacggtccatgttaagtatgccagcgccctggccataaactgtagccttttggcccatacttctttccatagcaggatttgcagtaaatctcttaatcatgaattgccactgtcttgctatctaaattattcctgcaaatcatgcatagaaagcagcagcagtgggccgggcgcggtggctcacgcctgtaatcccagcactttgggaggccgaggcgggcggatcatgaggtcaggagatcgagaccatcctggctaacatggtgaaacccggtctctactaaaaatacaaaaaaattagccaggcatggtggcgggtgcctgtagtcccagctactcgggaggctgaggcaggagaatggcgtgaacccgggaggcggagcttaccgtgagcctagatcgcgccactgcactccagcctgggcaacagagcaagactccgtcttaaacaaacaaacaaacaaacaaaaagcagtagcggtggaagctcctgccattacactgcacctcttctgcgtggtgcacggccctcccgcagaccccacacttgtttccacctctccacgcaggcattttgagttggaggcaggagcacgcatcacaggcggagctagagaggctgggctggagggagtgtccagggagtccgagatcgctagaattttagaatttctttctttctttcttttttttttattgagagagttttgctcttttcgccgaggctagagtgcaatggcgcgatctcagcttactacaacctctgcctcccaggttcaagcgattctcctgcctcagcctcccgagtagttgggattatagacgcccactaccacacccagctaatttttatagtagagaaggggttttaccatgttaaccaggctgttgtcgaactccttactgcaggtgatccgcctgcctcagcctcccaaagtgctaggattacaggcatgagctaccacgcccggcctagagtttcttttttaaggctacatagtattccattgtacatatattccacattttaaaaatcctttcatctgttggtggacattaggtttctgcagctatcactatcacattgtgaatagtgttgtggtgaacatcggagtggtaatatccgtttgagatcctgatttcattcttttggataaataccccaaagtgggacttctggaatatatggtagttctgtttttaaatttttgaggaagcttcatacttttttccatagtggctgcaccattttgcattcccaccaacaggattccaatttcttcacatcctcaccaacagtagttgtgttttgttttgttttggttttttgataatagttttccttacaggtgtgaggtaatattgtgttgtggttttgattttcatttccctaatggttaatgatgagcatcttttcatgtgcttactgcccatttgtatatgtttggagaaatgtctgttgatgtccttagcacatttttaagttgagttatttgtgtttttttactgttgaattattggagttctttatatatttggagactagccccttgtcagatgtttgcaaatattttctctcattccgtaggttgccttttactctgttaattgtttcttttgctgcgtagaagctttttagtttgatgtagtcccacttgtttatttttgttttggttgcttatgcttttggtattaaatccttgagataatcgccgacaccagtgtcatgaagcttttcctgtatgttttcttctaagagttttagtttcatgtcttaggtttattaaatcattttcagttgatttttgtgtatggtgtaagaaaagggcccagtttattttttttaggtttttacatgtagatatgaagttttcctgatgccattcctttcctcattgtatattcttggcatctttgttgaagatcagttgaccatatgtgtgtggacttatttctaggctttctttctgtgttcttgtggctctatatgtccgtctttatgccaataccatactgtttagattatggtagctttgtaatattaatatattttgaaatcaggaagtatgatgcctccagctttgttcttttacaagattgatttggctatttatggtcttttgtggttccatatgaattttagaatcgtttttccatttctataaaaaataccactggaattttgatagtgattgcgtagaatttatagatcactttgagtaatattggcatttaaaaatactaagtcttaacaaaacgtgagcataggtgtttctgtttttttgtgtgtcttgtttaatttcattcattgttttctggttttcaataaacaaacctgtcacctcattcaagtttattcctaggtagttaatttttttctattgtaaatgagattgttttcctaatgtccttttcagatagttagtgtatggaaacattactgatttttatatgttgattttgtatcctgctactttactcaatttgtttattctaacagttttttaaaaatggaatcttgcgagttttctttcttttttttttttttttttttgagacggagtctcgcacagtttcccaggctggagtgcaggggcacagtcttgggtcagtgcaacctccgcctcccaggttcaagtgattctcctgcctcagcctccgaagtagctgggattataggtgcctgccaccacacctgactaacttttgtatttttagtagagatggggtttcaccatgttggctaggctggtctcaagctcctgacctcaagtgatccgcccacctcggcttcccaaagtgctgggattataggcatgggccactgtgcctggcccaaaagggacaattttactacttcctttctgatttggatgtattttttttattttattaagcatttaatttattgcttaattgctttggctaggatttccagtactatgttgaactgaagtagggagagtgggcatccttgctttgttcctgatctttcaggaaaagtttctgttttttgctattgaatataatgttggctgtgggcttttcatatacagtctttattatgttactttctttttattccttgtttgtagagagtttttataatgaaagggcgttgatttttgtcagatgctttttctgcatctattgagatgatcatgtgatttttatctttgattctgttaatgtggtatattaatacattttttatatgttgaatcatccttgcatcacaagggtcagtagatttccctggtatgaaacccacttgatcatggtgtattacctttttgataggctgttagattcagttagctagtattttgttgggaagttttgcatctatatttattaaggatattggtctgtaattttctttttttgttatattcttcccttgttttggtgttagggtgatactggcttcatagaatgatttacggaggattccctctttatctttaggaatagtttcagtaacggtagtaccaaatttctttgaatgtctgaaataattcagctgtagatccatctggtactggactttttttttgttggcaattttttcattcctgtttcagtctcaccacttgttattggtctgttcagagtttctgtatcttcctgatttaatctaggagagttttatatttctaggaaattaaccatctcctctggattttctagtttgtgcatgtaaaagtgttcatagtagccttgaatgatcttttctatttctgtgttatcagttgtaatatctcctgtttcatttctaattgagcttatttggatcttgtctcttcttttcttggctaatgttgctaatggtctattgattttgtttatttttttttaaagaaccagctttttgtttcatttattttttgtaattttttgtttcaatttcatttagttctgctctgatctttgttacttattttcttctgctgggcttaggtttggtttgttcttgttctctagttccttgaggtgtgaccttagattgtctgtgctctttcagactttttgatgtaggcatttaatgctgtgacctttcctcttagcactgcttttgctctgtctcagaggttttgataagttgtgtcactgttacccctcagttcatagaattttaaaatttccattttggtttcattattgacttgaagtcgtcattcaagagaagattatttaatttctatgtatttatgtagttttgagggttcctcttggagttaatctccagttttattccactgtggtcagagaggatacttcatataatttcagttttcataaatttattgagtcttgtttaatggcgtatcatatggcctgtcttggagaatgttccatctgctggtgaaaagaatgtatattctgcaattgttgggtagaatgttctgtaaatatctgttaagtctatttgttgtagggtatagtcttaagtccattgtttctttcttgactttctgtcttggtgacctgtctagtgttgtcagtggattattgaagttccctcactattattgtgttgccgtctgtctcatttcttaggcatagtagtaattgttttataaatttgggagcttcaatgttaggtgcatatatatttaggattgccacattttcctgttgtactagtccttttatcgttatataatatccctctttgtctttctttttttttttgttggagacagagtcttgctctgttacccaggctggagtgtagtggtgcgaccttggcacactgcaacctctgcctcccaggttcaagcaattctcctgcctcagcctcccgagtagctgggattacaggcacacaccaccatgcctggctaattttttgtatttttagtagaaacgagttttcaccatgctggtctcgaactcctgcccttatgatccacctgtgtcagccttccaaagtgctggggttacaggcgtgagccaccacacctggcctcctttgtccttttttaactgttgttgctttgaagtctagtttgtctgatataagaataactacttctaggccggaagtggtggctcacacctgtaatcctagcactttgggaggcataggtgggtggattgcttgaggtcaggagttcaagactagccttgcaaacatggtgaaaccatgtctctactaaaatacaaaaattagccaggtgtggtggctcacgcctgtaatcccagctacttgggaggctgaggtgggagaatagctgaacccaggaggtgaaggttgtagggagtctagattgcatactgctctctaacctgggtgatgaagtgagactctgtctcaaaaaaaaaaaaaaaaaaaggataactacctttgcttgcttttggtttccattttcatggaatatctttttccatccctttatcttatgtgagtccttctgtgttaggtgagtctcttgatgacagcagatccttggttcgtggatttttatccattcttccattctgtatcttttaagtggagtatttaggccatttatattcaacgtgagtatttagatgtgaggtactgttgttttcatcatgctagttgttgccttaatcccttagttttttgtttttgtttttttttttcattgcatcattgttatataggccctgtgagatatatgctttaaggaagttccattttggtgtattttgaggttttgtttcaagatttagaacttgtggtgctggtttggtagtggcaaattctcccagcatttgtttgtctgataaagactttatctctccttcatttatgaagcttagttttgctggatacaaaattcttggctgataattgttttgttgaaggaggctaaatataggaccccagtcccttctagcttgtagggtttctgctgaaagatacactgttaatctgataggtttttctttataggttacctgatacttttgccccacagctcttaagattctttccttcatcttgactttaggtaatgatgactatgtgcctgggccatctttttatgatgaatttcccaggtatttttgagcctcttgagatttggatgtctagatctctagcaagaccggggaagttttccttgattatttcctgaaatatgttttccaaactttcaaatttcttttcttcctcaggaacacgaattatttttagctttggatgtttaacgtagacccagccttcacggatgctttgtttattttttttaaaataatttttctttatcttggcagattgggttaattcgaaagcattgtcttctgtctctgaagttctttcttctgcttgttcgattctattgctgagacttcccagtgcgtttggcatttctctaagtgtgtccttgatttccagaagttgtggttgttttttatttatgctatatatttcactgaagaattttccttttatatcctgtatcatgtttttgatttctttaagttggacttcagctttctctggtgcctcctttgattagcttaataattgaccttctaaattctttttctggcaattcagagagttcgtctttgttcggatccattgctgatgagctggtacgatcttttggtggtgttaaagaaccttgttttgtcatattaccagaattgtttttctggttccttctcatttgggtagactatgtcagagggaagatctgggattcaagggctgcttttcagattcttttgtcccatggggttctcccttgatgtggtgttctcccctttcccctaggaatggggcttcctgagtgccaaactgtagtgattgtttttgctcttctgggtctagccacccagtcgagctaccaggtgccaggctagtactggcgagtgtctgtaaagagtcctatgatgtgatccgttttcaggtcttgcagctgtggatactagtacctgctctggtggaggtagctggggagtgaagtagactctgtgagggtccttggttgtgtttttgtttagtgtgctggttttgtgttggttgtcctccagctgggagttggcactttcaagagcatatcagctgtggtgctacagggaggatgcacatttgccctagagacacttggtcaagtattcaggtttctcaggcagtgagcaggcccatagagctcccaagagattatgacctttgtctttggctaccaggatggctagagaaagactacgaggtgggggcaggaataggggtgtctcagcctctccttgggtgagcttgctgcagctgctgttgcggggggtggggtgagggtgtggttcccagtccagtggagttatagtcccagggggattgtggctgcctctgctgagtcatacaggccaccagggaagtgggggaaagctggcagtcacagaccttaccttgcttccatgcaacctgtggtcttaaaggctggtctcacttccatcatgcctccccaacatcaccaagtctttttccaggtagccggttaccagggtggatactttgccccagaccacaagcctcccccttgagaaagcaaatggactcatagtttttaggcctcccagagaacctgcagtggtgatccaatttcttcaaagggtctgtggattctcttggctttcctggtttgttcctgtggtagttcttgtattgtagcaaaagttcatgatgtgagtctccacatgttgctctgtctgtcagaatgggagatacaagctagtcctgcctcctatccaccatcttaatttgagcatctagatatagtttcgaataatgtgtatctacctacaaagttcaggcatggaacgaggcaaataaaacaaacacaaaaactggatagcaaaactactccaatgaggagataaaggttttcaaaaagtacttgaactggaaagcctaggtgatactaaaacattaaataaaatagtatatccaagacccagtatgtgttaatatatgggataaccagatcgttttaactgctctggctaatcctcatttctataaatatgtagacaaaactagcactgctgtatggtaataactaccagtatactgctttgtcctttaaaatgtgtctgccatactaggctcaaactattaaaccaagtttttctactaaggctaggaatgtcacatgtatgcagggatgagaaccttatcacacacactcacgctcacataccaggtctctcagcccttgggcgtcgccttccaactccatgtgtattttatgcatgtgatctttatatgtgttctttcgctgttttcctatcatgtgaaacacattaaacatctcaacacatttgcgcctggttttggttgcccagtagtattcttgtgtgcaatgaaaccagtgagcaagtacacatagtaggaattataccatcttggtagaaaacagctatataaacacggatgtacatatttcactggaaatctcaaggacccacctcttcagtctgtagcagaagtctgcttgccacatcagatccttttacccttcacctctattcttggaccccaaagcagggccagtgcttttagttttgtatctggtgtcctcaaaatgaatatggaaagttcataaacactatataagtactatgtgaatctggttgaaaacaggtaaaacaacaaacctacatatactaactggtagttaaatttatttcacaagaaaaccatctttaagattttttttttaactttttttttttttttgagacagagtctcgctctgtcgcccaggctggagtgcagtggcgtgatctcagctcactgcaagctctgcctcccgggttcatgccattctcctgcctcagcttcctgagtagctgtgactaccggcgcctgccaccatgcctggctaattttttgtattttttagtagagacggggtttcattatgttagccaggatggtctcgatctcctgaccttgtgaaccgcccgcttcagcctcccaaagtgctgggattacaggcgtgaaccaccatgcccggcctttttaactttttaaaatagagaaaacagtatattccttggggaaagatgaaggattgagaaaaccagctctgggtaaaaattattatgactgcacctggagttgattaggcctgcctaggaaagaaacaggcaactgctatatgaccacaggggacagccaccatctgagtctcagcagactagttcacacgccatgcaatgttgctgtatattcaaattgtaaaaatcatctagcttatcatgaaacaagctgcatttatcatcagagactgtcaggtcatcatctccacctgcagacagagcttaagcagcatctcacctatctcaaagatgacagactcttgtcactgttgtcaaaggggttgctgttctgtttcctcagtgagctcccagagttggttccttccttgggccctgtatctgtttatgttcccattttctgtctctggctccttttaccaccatcagggtaggcagacttggaacaattctctccaaatgggcagcttccatgttcttcgttaaaatacctacatgccttatcactcttcatctccttgtattcctgaaatgagtttctgctaccttctactccacgcagtactcatgtggaatgacaaagttaaatatggcctggcattctgggatggactttaccatcttgcttttctgttgcttagtactcctccacttgtgaacacacttgaggtgcaggtgtggttgcagctggagagcatctcaaagcagccctttatatatttagagagtatcatgcccctttagtgttttattgtttattatatgaaataataccgtttcctactctggagatttacagctactttgagcccatggaatacccccaaagggttttatgtaaagtgtgttcaaatgtagaccctatctatataccaactaccaaaggattagttgagaaacattttatgagtaaggctgtcatattgcatgctgggtactagagttagcaatttccaatatattattgatagaaaagtaaacattaataggaaattatcatgaactgactttactcaccttgtttagtctgtattgaccttgttggaagaaaagtattaatagctgtcatttgagctcttactagtggtaagtcaaatgctgtgttagtgtatttaatcctcaaacatctctgtttagccatattatccccaggttatatatatgaagaagatgaggtttggggatcttagaaataagagattttattgatctgtcactgcaggcagtgtaaatatatttgattcttcttaattttgctttatgatctcacaagatgaaataactatgtcatctatttcaattctcattgttttaagatttaaatcattttggggggaatcttctccaatgttttacttaggaacggttcaatgaagtctttcccctgtcctagtttgttttatagatttgaaataagggcatttcagtggctctaaaacatgtgtgtagcttttgtaaaattcctaatcttttctctaagtttttacatttcttaattatgtaaaaatattatgctataaaataatttcagtaatttgcagtaaagaaaggtaatctgtctctagtttcctcatatttattcaccgatatctcctcattaaaagttgaaaaatactactgctctttgttttaaagtatttaaacgtccaactgtactttttacataaataagattagaaaacatgaatttgattgttccagaaactcagtcatactgagagaagactttttttcctcagcaatttactattttttggagtaaatgcaaaaagcctttatgtgtgcaggcctctgtaatgacactctaatgtagtagaatcttctttgatttcatttgcttaaagatactgctttaaaagttttagggaaatattttatcctaaaaatgttaattatccaaggttgaaaagatcttacctgacagcttaaaaacttgtatctgggcagtaagatgataattttagtttcagtattattttaattgagtggatgtgtggcaattcaagtgttttcgtctcttaagtttcagtagtgggcagcttttgtctcccttctgttttcactcaaagcattttgtctgtaaagaatctcagcttaggactcaaaacaagtctgtgttgaggatttatttctagagttgtgttaaacagttttctgtagctatagataattacttatgaagctgcatcaagtacgtaccttgattactactatctcgtgactaactgcttgttcacagccttccccacccttcccaccagctccccttcactaacctgtgcatcctttgcttgtctggtctcttttacttcttgtttttctcctagtttgtgaatagctcttaaagtctgacttgttgtcatggtgcgttgaaagagtagccagttgtcttttctgggtagatcagctatgagctgactgactaagaggagtagttaaaatggagaaagcttagctgtactttgtcttgcatgttaaacgtaatgagtttagaggattatgattatttgtaatcatcaggatctgctagacaggacatctgttttactttttactcttatgttggtggagaaatagcgtgcttttcattcaatgtgaaaattttgtgttctagctgggcaccgatggcttagtttttgaaatgtaatttcttgagaagtagcatgtggttagtataaaattgtctttcctattaggactagctacgtaattagtctgaaatatttttctaactggaaaattagttgctgtgaacttttggatttttattattctagactgcattacacttgtttgctatattcaaatattttttctttggttttacttcctaggttgcacgttttcaaaaaatacctaatggtgaaaatgagacaatgattcctgtattgacatcaaaaaaagcaagtgaattaccagtcagtgaagttgcaagcattctccaagtaagtggttagtggggaggaagggactagatggtgtaaagtcagtcacttagactctataaaacagtgctgtctaatttacttttcttcagtgatagaaatattctgttctgtgccattcagcatagtagccacaagttgaacaggactgttgagcttgacatggggttaaacttgacagaattaaacatgactatatgacttgaaatgtggctagtgtgatggagaaactgactttaatttaatttaaatttatttaaataactacaggtggcttagtggctacctgattggacagtgcagctctagaacataatagcttttctaggaactatattagtgctgtgtaaggattggttggattaggaaaataattaacgtaagtagtggtaggagtttatctttttttgataagggttttctaaggtaaagtaaaaacttaagtacaagtttagaattgcagataatctgtaattgcttatgtaggctcttcctggttttcaaaagtagtatctatcgaaacatgaaaaagataatattttttatttttccttcagcagtcacatatcttagtgatagcattaaaaacatgggtatccttttttaggtttttgttgttgttgttattgtatttatactctgctttaaaaccacttatttgtaatatgtttgttttgaaaggctcctttattggactctattataataaccttttggtcagggcaactattttgggggtacagataattttattctttaatagttagaatactaaatcatgagagagaataactgaaggatgtaggtagtgtttatagaacataaactgttccaagaagaagttcatctgaacttcactgcttttgagtaatttaggaagcacaaaatttgagcatgaaataattacacagtccaagagtataaattaataccaaccccagggttttgataggcccagagaacaaggaagacatttatggcccattgaacgttctttgggagaaactaattttagaaaatggcgaaacaacaatgaaaaggaaaaagctaattaaaatgtactgttatgctttctgtaagtcttgtggctgattgtgttatttttctccctaaattttgtttgtttggtaaactctgcctttttgtttacattttttttaaaaaatcaattttgttgagatataattcacataaaatacaatgtactttttaaaagtgtacaatttgcattttgacaaatgtaatcaccaccaccattaagatagaacatttttatcactccagaaagctcccccatgtccctttgtaattaatccctccctctctatgtgtcacttctggtcccaggcaaccactgataggttgctctcataatagactagttttgactgttgtagtttctgtaaatgtgataatacattatattatgtgcttttttgtgtttttcttttctgtgctaacattttcaataactttcatgtataaactctaataggctgatcttcagaatggtctaaacaaatgtgaagttagtcataggcgagcctttcatggctggaatgagtttgatattagtgaagatgagccactgtggaagaagtatatttctcaggtgagatacttttacttcctcttctactgtgtaatttattaatacatggacttctgttatgtagttgcttacttttgtgatactgtttatggagaaaggaaataatttttagatgttttttacctaaaatttttcatttgttggggcttactgttaggttggaattcctgtatttttagtatgtaaatcttaaagacaacattttccatatgggtatattacacaaagataatactgttgacagtagtgtcctttgctgatatcaaacctacactatttaaatgataggactggcaatattttttaaggtaatcatggccagctcagaaaactagtaaaaagtaagttaggtaagttaaactcaggctgcctgggtacaaattacaccttcatttcttaccagttgtgtcatctttattatcctctgagccttatctataaaatggtgatgataaccttacgggagatagttagctctcagtagatgatagttatttatattttttcatcctaaattttaggaaagacttattctagactgcttttatcttgataacgattgtgttaatgtaaaaagttacaggttactatgattagttttgaagtaattaggttggtttgctaaacaaatattttttgctaaaaacttctttttagtaaatgtctgtgccttttaacctgcggtctttctaaaacgatctatgtttaacttttctaaagtgccttttctgctaatgagcttaaatttgccaggcttaattttgcgaatgagtttgtctaaagtagcaacactggaattttaaaggttggatgaaccttgtgtgtatatgtcttatttttatggaatattatttatatgtgtctttgtattttcatacttaccacattcccacattaccaaagacttcagaaagcattaacatagtttactctggatttataaattgtaatgatttgacttatccctaggcagtatgatttaatgttttactttcttgatcctgttaccaaagctagagcacctgccccttgggattcctgtgagaattaaatagtgcctgtaatgtagttaagcacaactaaacaaataacagtaaatagtaatcgtaatcacaaagcactgggtgattctttattcctctgcagcctgccatccatcaagtggtgtgcttagtaatgtggcacagcttttttaggggaaaataaaaaagatcatgggtcttgccctcaaagtgtgacgttaatagctaacatttttaagaactttttttggtttacacggtgctttaatgtacattcttagttaatccttataacagttctttggtataaggttctgttttaccagatgaagaatctggagcttaaaaagattaaggtgacacacagatgccagcaactggattcaaacctaggtactctgactcagtcaggtttgtggttggtcagccctgaaccatattgcagttgcagtgttattttattagggcagtttaacttattattttttaaaaatcctcgttagaatcacttggggagtgcttaaaaaatgctaaagcctgggccttatgcctaaagattttgatttaattaacttggtgtgaatctgggcattggtattgttaaaagtttcttataggattccgatgtgaagaaggattgggacttgttccagggaatggaaccataaaggggctttggaggtggtggcatgtaacctcagagctatggtatctaagggctggggctttctggtgggatggattctttttagcctaattactttgcaactttgacagtgatgtaacactttagcagaggaagagattctaacatcagagtttcaaggaatagaatgtccaactggaagaatttggggttgactctggtgtgaggtcatttaaatgctttctgatcaggttgatgctatagtcctgtttctttgatatgatttgctgtggtagatagaaaccaggaaagctagccttgaggaaaatcttcagtttcttttgtggagaggagggaatttttctgtgatatgtgagtcaaccacagaattgtaatctacaccattgtacttgagaaatgtttgaatctcagtgttctattcagtatttcgcccaaatttttagcttaaaaatcatcttctcctgctttttctagcctcagtagaaattcagaacagctgtatttcttaaattaatataccaaaaattgctgtatactataaggaattggttaattcttagttttaagtattgctatttaattttttttttctgaaaaggaactgttaaaaagcttttaaatgtagttaagtataaacgctttttttgttaattgaagagatacataaaataaactgagtatagacttttgtaattttccagtcatgctcttatggttttttttttttaaagcctttgctgagagaactgtcatgtacaaaactgtgttgaattgctgtttgtttttactttcagtttaaaaatccccttattatgctgcttctggcttctgcagtcatcagtgttttaatgcatcagtttgatgatgccgtcagtatcactgtggtaagaaaaaaattacatatttttaatctgttgagtaagtgtataaattgggattggtttttattttggaaaataaattgagaagtgctctcagatttttttcagtgtccaaattctgcttttattttattctttttgttgcgacagtttcttgttgtattgcccaggctagagtgcagtggtatagtcatgactcactgcagccccgaactcctgggctcaagctgttttctgcctcagcatcctgagtagttgggactacaggtgtatgctaacacccccagcaattttaaaatttttttgtaaagacagggtcttgttatgttgcccaggctggtcttaaactcctggcttcaagtgattctcccaccttgacctccccaaagtgtcgaaattacaggtgtgagccactgtgcctggctcaaattctgcttttattatagttacagtaattttgagtaatgttcaaaagtccatgattagcacacatgaaaattctttaactggtaattttcacaaatatgaaattttataattatctgattaaattttaaatttatttcactttgcagttgagaatatattttgactagttgtgaactaaagcctgacatgtgaaattaaaaatattccttatagtgcatgctgtatttacagcatacatttactatatatgattttattctttccagctaggttattctagctttcattgaactgttttctcatctttttccttcttgctccatttcatttttgtataaaaaatttgtagcaagtaaaagcacttatgcttaagaacactgtagatgttattgtagagatgcagctcttgaactattgcttgcagtatcccaggtatccctgagacctgttcaaggggtatgtgaggtcacaaccattttaataatactaaaacattatttgtctttcaattatagacttttggcattaatggcacaaaaacaatggcaggtgaaactgttagagccttagcacaattcagagtaatggcacccaactttgttaacagtcattgttttctttcatgtttcttaagaatgttcttgataaagcagtaaaaattaattttattaaatctggacccttgagtacataccttcataataatttatgtaatgaaatgggaagtatgcatgaaactcttttgtatattgaaatacaatggttgtctcaaggaagggtgatgattgtgaggcaaactagccttgtacttgaaagactgactcatagacaaactatgggtgttaggacttgggtaaccagcagattcttatttttgaaagtgaattaaatgagcgaatcagaccaaggaaaggcaactggcagaatttgttgctaatgataaaattcaggttttcaagcaataattagggttttggaaaatttgtatgcactcttatgggctggatagcatcccagtatttaagactttattccaattagatcagtagtgatttcaacaaatgtgtgttttttttaaaaaaaaaattgttacgaaatgtggtaaccttggggaagatttgggcaatcttggggaagatttgaataaccaagtgaaccaatatttcccagaagaccaatgcgtgacattacaaaatctgaaatggtaaaagatccattcaaatgcaagataggtcaatggatttcgatataatagattatgaaaggtgcattgatacagttttatattctacattgcagattacctttaagtaactagcacttgagttttggtgtagtagctaagaagaatatccacaatcatctgaaaaagctgttaaaatactcctccctaggctgggcatggtggctcatgcctgtaatcccagcactttgggaggctgaggcgggtggatcatgaggtcaggagattgagaccatcctggctaacatggtgaaaccccgtctctactaaaaatacaaaaaaaaaaattagctgggcgtggtggtgggcacctgtagtcccagctactcgggaggctgaggcaggagaatggcgtgaaccccggaggcggagcttgcagtgagctgagatcacgcccctgcacaccagcctgggcaatagagcaagactctgtctcaaaaaaaaaaaaaaaaaaaactcctccctaaaaaaaataaaaaagaaaaaatgctcctcccttttccaccgtatctgtatggggctggattttcttcatacactttagcctgaacaatatgttatagtaaatggaatactagctttctagaaagtcatatattaaaatataaaaatttaaaacactgctatttttctcacaatttttttggaaaatttatttttcataaagttatttgtgttagcatgtaatgaggtttaaaattttttacatgagttgatgagtagaaattaaaactgactagttgaaaaatttgatatggtaaatatcagtatatataacccacttaaaagctggtcctcaatttgtgagagcataaaagggccctgagatcaaaaagttagagaagctgccctggtaatggcaagccactgtaaactgttagcttctttccccacaggccttaaggtaaagttgtgatttcttttccagctgatctcagtgtttaaaatctgttattgtgggactgcagatagttagaaaaataaaatacagttaacagttacttctcaagttaatgtctgatttaaaagcctgtttcttttgtttaggcaatacttatcgttgttacagttgcctttgttcaggtaagtactctattttgccaacatgaaaatggtatgttaattgcttaaaaatcaaggtgtcttgtggtagaacctaccgttattggggggttgtaatgcccatcagaacaacttattctttgtttttcaagtaatttcagatacagacaactcttcagggaagcttgtggtgtgggactaaggaactgctttgatttaggtagtgagatgaagaaaatctagttttttatttgataatgttaaggataactgaagcagatggaaacaaaaagcatagtaatagaaataaaatccagcagtaaacttttttattttttcaattaaaaaattggaccagagtttatagtttcataacactgttatgttttaatgcctactagagctaagtctagatgaaacaaaaaagtatagaattaaaaggtcgatctgtgatgtaccatttgaagaaaattccacaggtttctgtgactgattcccttagccaaatgctacacttgtttgctgaatttatcacttaaccttattttatttgagtctgttttgaggaattaaaatggttctactcattgttggcatgacctcctctcccctccctttaaaacaatttctcattcctccacaaaaggggtgttgtgatctgaatcaaagtaattcaaacagtaaataaaacatatgtaaagtagccccttttaaaaattactatgaataatgtggagatactgtcaagatttctattaataagtacagacaaataaaaatgtaggcttagttttatgtttatttaaatatctgaaacttctgtagattttagaacagtgtttcacaatatcagcagatttcctttttagctagaacatggttaacaagaatagaattattctagcttagagaaaaatgtaatattgttgcataagcctgaagttcgtgctgttttgaatctgaagcctatactttgaataactatggttgttcttacatctacgatttattacgtgggtatttcttgtcactatcccagcctcttaaggtaatctctaacctagttgttattagttctgtagtaacccagtgtagaaagccagttggaatcagatcatttgcagtaggtttgtgagctccattagtagactatcagggttccgcttttaggggaatcttcttgcttagacaaatgttgcccatggtcaggtggagctggttagtctagcataggtcatgtcaggctaaccattattcaaggcagctattcattcagccaagtgagtgatatgacccactggaccactaactggaccttcttgcgtctttaagaatgtgtcagatatgtggagtgccctacttcagaaggattcctgcaaatagtatcactatgtatggaagaccttagtaccttgttctctttgatcactagaaagcccatgttttcaaaaaacaccacaaaattgtgattttaacataagtcaatatggaattttacacaagatagtgttgttatacacattaaatgctatggctgagactattaaatatgtttatgataggtacatttgatagaaatctcacaaaaggatgaaaactttataaaaagcctagtttcaaattgctaggtctgattcttacacacatgtgacccatcaccaaatatgcctgtgaaaccaacaaaatagtctataaacaagtaaaaatcctctccaaaaagatcctatttactgtcagttgaacttatcataatgctttaatcaaaaagctctttatcaaaaatgtataaaaaattcttaatactttatcattatttgttatttgtgctatattacttgtgtcttaagagggctttttatattcctttttatatttatgtcctgccttttttccgtgtgtctttgcaatccccattccccacaccactgtacttcttcccagccataaaaatagctaattgttttatatagtcgtaatgaagtcaccttacaataaatttgaaaaatgacttttaggcatttattaggttttaggtggtatgtttaatgatcattttgatatagaggtatctttataattgtagggagtagaggctaagaaaccagaagacataagtaaagattgggcagcatctatgtcatttattactgggatctaggattgatgggtattttctagcatattacagaatttttgggtaaacttccaaattccttaatatccttcatgtgtttggggtgttgtcttatgatttttacatttgtagattttccttatatttgtcactctaagattaagtagagactgattgtgttctaagttattcttacatagccttgtgttttctatttgaagtttgtgatggataggacattttgactagtactagcactgcagtcatttcaaaacattcccaacccttctacctccactatttgcctctccctcttttgaccttagattagaagattcttttgcttactacagacatgaggcaaaaatagcagtgatgtgtgatgcaagactgctcatggaaatgtggactaagtagtattgtgagttgaaggatgtttctgactgaccctcagctatttgttatctggatggaagaaggctagaaatcacattgttagaactcctgagaattttcctttttggatacacaggttgatgggaactgggtctgtcagtatagagccagccacatcttactccttgtttatcccatgtttgttctaatggtttactttgtaaaccattgctgttagcatgggcttaaattcctaaagcagatgttgtttacggttaattatctttgacttctgtggtcattagacacttaacataagattatctaaattttaaggctcaatgacttaaaacttttaatgactcaaattatgtactctttggacatactagtcagttttcatttttattctaaataaccttaggtttgtacattgaatattaaaatgtaaaactgggaatatttaattatcaaaattgatctctacatttaacattttaaaataagggacaagcttttctgggtaagaatataagcacaagtaaaggaaaagatgagaattgggggaaattttaaaataatgattgagattaataagtctaaatggaatatattcatgggagcaaaattaaattctacttttttttgtttgaataggaatatcgttcagaaaaatctcttgaagaattgagtaaacttgtgccaccagaatgccattggtatgatcctttttttggtatggatttctgcccctttaaaaatagaagttgaatgtgactagtaccgtacatattgttatccccactttgtctgaacataaggaagatactattaatctgacacaaaaagttcctggtctcattaatgtagcaaaactgtaccattgaaaactttaaaatccgagattctagagacatggatgtatttaacagattttttttttttttttttttttttttttagatggagtctggctctgtcacccaggctggagtgcagtggcacaatctcggctcactgcaagctccatctgccgggttcacgccattttcttgcctcagcctcctgagtagctgggactacaggtgcctgccaccacgcccagattatcttttgtattttttagtagagacaggtttcaccatgttagccaggatggtctcgatctcctgacctcgtgatctgcccacctcggcctcccaaagtgttgggattacaggcgtgagccaccgcgcccggctgtatttaacagtgtgtgtgtgtgtgtgtgtgtgtgtgtgtgtgtgtgtgtgtctgtgtgtgtgcgcgcacgcgcgcatgcatgcgcgtgtccatgcgcaagtgtgtgctaagccctgttctgggtatagtgattcacaatcaaacagacccaggtgattcaaaaggttgcttcaatttgcacattttacatttgaacaaataatttgtttttcaagttattttctgtcatcttggcatcttaagtgtttagaaacagtctttttcttggttcttatatttgccttttcctcagacaagcctactggaaataattttttaagacaagttgcatgaattttttttttttaaccatggttgtttctatttcgtgttacagtgtgcgtgaaggaaaattggagcatacacttgcccgagacttggttccaggtgatacagtttgcctttctgttggggatagagttcctgctgacttacgcttgtttgaggtaaatttgggatctgattgtaataagtgaaaatacgtggatgtagattaaaggataaacattactagttttaaggaattaacacatagttgatttgaaccatttggtattctactttaaaatgtgacatatataaacttttttttttccttaaaatgtatctgtctctactgtaacatcttttgaggtgtttgtttagtgaatcagcagatctttatagaaacctgcatattagggactgtgggagatacaaagatgatatgacagaatacttgtgactagggaacatactatgtgtacacaaattactcaccataaaatagaactcagtaattgagtaagagaagttcaaagaataggatatagacatttaaagaagggagaggttccacctgatttgaatgagatcagaatatgcctcagaccacatggctttggcagtgataattgaagagtagtactggacaaagatggggaagacaatgaagcaacaccattcaaatcactatgaacattccagtgtatgaaactctgttgggacatggtaagggtagaaaacgtgtgatggaatcagatttcagaggccttggatactaggcttaacttcagatttttttggttaggagttaccttttgaggctcctgtgcagttgctaaataatgttatccttaatctggctacagtgtgtagaatagattgaagaactggaaaatggagataggcacctagtttaacaggctttcaaaacccattagtatgcaggtcttatccaccattggaattaagctgtttgttaacacctgcagagcagtcagtctttaaatactatggccaaaagtatgagtgttctcatagatgctgtagaaggcctgaaaaacctttcagactgtaataagaacaaacttggcttaatctttcagcagaggccttttttccaaatatttgaaatttatccttagaaagctactggattgctttaattgggtgactaggaataattgataatattgcaagtgttactaattttacttcattatcctttttctcgtctttgaggtctttttaatgttaattcttttctactcttctttccttcagttcctaatattttgccgatgacaataccttgaattattcttcctcagagattaagtagtcttgtcacttggcataagttttcttccccctcccccagaaaaccctaatttaaattcatggagttcatgccattctttattctgggctgctgctcttccagttgagaagcagaacttctcattgggatagttagaagatggtgtttctcatttgcatggttcgagaaatataatgatagaaacttcaaaacaccattaatgcttgctaaactattttagggttttcatttaactaagggttaattgacttgacagttaattatttcaaagttcacatgtaaacaggaaagaaaacctgtcagtatagattagtatgtattttatctactcagcaaatatatattgaaaacattgtgaattttttatttttgtttttgagatggagtctcactctgttgcccaggctggagtgcagtggtgcgatctcagctcactgcagtctccatctcctgggttcaagcaattctcctgcctcaggctcccaatagctgagattacaggtgcctgccaccacgcctggctaattttttagtatttttagtagagacggggtttggctgtgttggccaggctggttttgaactcctgacctcaggtgatccacctgcctcagcctcctaaagtgctgggattatagtcgtgagccaccgctcctggccgacattgtgaatttaataagaattataagcatatgtcttgtggagtaatttattagttattattgttttccccctacttgttaactttgcaagcacttcatcagcacgttttattctgcagtactgtagttaggttgattttgttctagttaatccacttttacgtatatagttgaacattttttattctctctaccttaattctgccttatttgttttgcctgttacttgctaccccaaacagacttttgcaactactttgactgcagattgaaataactttccttaaagagttggggatcttttatccatctaaatttaaatgtactgacttaggatatagactgataaagtcagtttctcttctggacacagaagctgctagttttttgaaagtaaattggcttattggagttttgttggctcagtttggctgtggtgatctttggataattttgtaaggctagctggtcatttgatactactgtatgaaataaactgtcattagggtttaaaggaaccagaaaactccttagtcagctttgggatatcactaatttcttccaaagcacatagatttcactttagagaaagcaagtctgtgaacttctgctatgtagttagttctcttacagactaggcctaaagccacagttgcaactttagtgtcatcattttgtaactgtcataaattttagtgctttcagagtttgactgtaaacttgcctgggtccttagcagcttcttgttagcacattcagtgacttgactgttgtacaacttttatctggtacaacttttatcttcataggttgtgtcttagcttgggttgctttaacaaaataccatgccatttatttttcacagttacggaggctggaagttcaaggtcaaggtctggcagggtttggtttctggtgaggactgttgctagcttgagatggctatcttcttgcagagtcctcacatggcggagacagcaatttctctctcttcctcttatacggccactaatggcatcattaggactagcctcatgaccgcatctaaccctgattacttcccagggccccatctccaaatactataacattgactgtagagctatatagcatgtgactttttgggatacatagttaagactgtaacaggttgagactgccattttgtttatactttttaaagactaatattaataacttaaggaattgtgtagtttttcccttgcctgtgtcaggttttcagaagccagtggttgagccaagatagttttcccttggtatccactgaggatcggtcctagtagatccacagagagcaaaatccaaagatgctcaagtcctttacatacaattgagtagtatttatatataacctctgcacatttttctgtatactttaattcatctctagattacttataactcctaataaaatataaatgctatgtcaacagttgttatactatatttttaaaagttcgtattttttttactgttgtattttttttattatactttctttgaatattttccacctgtgattgcttgaatccactgctacagagggaggactatagttggtggcagtggcctttccagcaggagcctgagaggcactgatggagctaggacagtaaaacttagaggaattgagctttgggcatgttatttgtttttttttcccccgagggtttttattttaacttttagtgttgagaagaggcaccactggccaattacttgatgataaccaatggattggtcggacaatgactttagatgaagcaatcttattgactatgtatgcctggataacagtacattttatttttatttttatttcatttatttattttttattattatactttgttttagggtacatgtgcacaacatgcaggtttgttacatatgtatacaagtgccatgttggtgtgcagcacccattaacttgtcatttacattagataatatctcctaatgctgtccctcccccctccccccaccccacgacaggccccggtgtgtgatgtttccaaccccgtgtccaagtgttctcattgttcaattcccacgtatgagtgagaacatgtggtgtttggttttgggtccttgtgatagtttgctcagaatgatggtttccagcttcatccatgtccctacaaaggacaagaactcatccttttttatggcttcatagtattccctgctgtatatgtgccacattttcttaatccagtctatcattgaacagtatgttttgcctttgtgaaaacacagcatatttttggtgttgttccaggtaaagtctatatcaatatttggataaagaactctttgtaagaaaaaacagcgtgagggtcagatggaaaaaggttgtgggtttttttttttttttggtcttttgaaaatattttacttctctcagctataactttctaagccgaataatacatcgcttgaaatgatagcaagattttctttcatttgaagttctgaataagtccattgacactttgctttgtggttcatgtgcttatagttggcccccatcatttttttaaacctatttttgatctgatgattttctaaatgtatcagacttctttcagagaattaccacttgggctagcaaccaagattaagctgtttttatgatactggattatcagaccattttaatctgggcagaaaggttagttctattaggagttagggtctaactggggccaagctcaggaattcaaacttaagaacacgccagtgggcattatattgtgagccattttttaatctcatgaatccttgtactttgttatagtatagcagtttggctcagtgagtagtttctggtgttttcagggcttgttcctttctgttccctagttctaaggagaagtaaaaaccaaagataatgggcatcattgagccagcacagatatactttagctacctgccacctgaaggagtcagaaataatctccttgactggaaccccatgtagccattatgttcctatctgtgaggctcacattcttgcccagtctgttgttaagacccgctaacaagcagcttcctccacgttgggtaaatccattactggagcaatcactctgtgtcaagcattctgatttcctgagttaataaaatacatgttccatttactcaatgaaaaaatactctggtaaaacccaggttacaattctgatttggtttggtatgctttttcaaaaaagaatgttttcaaatatttgataaaatgtaagcatgtagtgatattttaaatttacttatgttggtaatgaagctaatttaggcaattgtaatccatttcttaggaaatcagtctgttatgaaaccattttcgccatttagcacatatttgaaaaccatgtacagcacattgtatcaggcttcagggcttagaagtgaaaaagacagtttgagccctctccattggcagacaccagcttgcaaacaactgtgattcaaagaatgatatgtgtctgctcatgaaatgaattgaccatgtgagcctaggcaagccgcttgattttttcaggcctgttttgtcactgtgacacagagttgccctagagcaatgcattccaacttctaatgtgcctaggaatcagctgggctctgttttggtaggtgtagggtggggcctgagattacgcatacttaaccagctcttagaccatgccaaaagcactggtccatccaccacattaaaaaaaaaaattattaaaacagcttttttgagatataatgtgcatatcatacagttcacacatttaaggtgtatcgttcagtggttttcagtatattcacagttgtacacccatcactacagtctaattatagagcattttcatcactctcaaaggaaaacccttacctcttagcattcattctgtattttccctgcctctagcagccactaatctgcttgccactgaaatacatgtgcctattctggacatttcatataagtagaatcatacaatatgtagtcttttatgtctggcctctttcatttaatgtaatgtttttaggtacttcattcatgtatgtcattgttttttactgccaaataattttccattgtaaggatttatatcacatagttggtgaatttaatccatttacacttacagtgattactgataggaaaggacttctgttgttacttgttttctatttgtgttatctttttatgttcctcagtttctcctttgtgcccttctttgttttttttccacgcccctccaattgattttttttgatgtaccttttttattccctcaaattattttctgtgcatactgtttacttattttcttagtgattatatgtggattacaatgaacatcctaatcttataacaatctatttgaagtgatactaactttgcttcagtagcatacaaaatcgtacagcccacacctccctcatctttgttatttttgcaaatgacatctttatgcattctgtgcccattaatatagatttataagcattttatgcatttataagtttaattatataggaagcaaacacaggagtcacgaactcaacatacaataatactgacttttatgtttacctacatagttagcttcattggaattctttatgtcttcatatggctttgagttactttctactttcttatttcagcctaaagggctgtctcttagcatttcttatgagtcaggtctgactagtgatgaactctttttgcttttgtttatttaggattttaaaaatttctccttcatttttaaaagataatgttgccagatagaaaattattggttgacagttttttttttctgaatattataaatgtctgctctttttggcctctgtggtttctgattaggattattaatcttaatgaaaattctgttatgtgataagttgtttctgtggctgttttcaagattctgtctttatctttcaatggtttgattataatgtgtttaattgtggatatctttgagtttattatatttggatttcattgagctccttggttgtgtagatttatgtctttcatcaagttggggaagttttcagccattttatcttcagctattctttctgtcgccttctcttttttccttctgagattgtactggcatacctcattttatcatgcttcaaagataatgcatttaaaaaaatatattaatagatttgtggcaaccctgtgtcaggcaagtctgttggcaccatttttccaacagcatggtgcttactttgtatctctgtgtcacattttggtaattctcacagtatttcgaactttttcaatattatgtctattatggtgatctgtgatcagtgatctttgctgttactgttaaaattgttttggggcatcattaacgatgttcatgtaagactataaatgtaatgagtaaatgttgcgtgttttctactgctgctctgcccgactgctctttccttctccttgggctttcctgttctctgagaaacagcaatatggaaattaagccaattaataaccctacagtggcctcttaagtgttcaagtgaaaggaaaaattgcatgtctttcactttaagtcaaaagctagaaatgattaagcttactgaggaatgcatgtcaaaagctaagataggctgaaggctaggcctcttgcctcaaacaattagccaagttgtgaatgcaaagaaaaaattcttgaaattaaaagtgctattccagtgaacacacaaatgataagaagtaaaacattcttattgtggatatgaagaaagtttgaaaggtttcgataaaacataaaagcagccacaatatttccttaaaccaaacctaatccagagcaggaccctaactctcttcagttctgtgaaggccgagagaagtgaggaagctgccaaagaaaagtttgaagcttgcagagattggttcgtgaggtttaagaaaagaagccatctctgtaacatataagtgcaagatgaagcagcagatgttgatggagaagctgcagcaagttattcagaagatgtagctaagatcattgaggaaggtggttgtaccgaacattttcaatgtagatgaaacagctgtatcttctgaataactttctgtatactcgaatcagaaagttagcaatttatgtaagcatctaccacgggataaaattaatttcatatatcgttttcagtaatacgtaacataacacttggttggtttggctttgagtgttagtaagttaaatacatgaagattttaaattacatttttcttcatttgcataaacagtgaggtatgttaatttttgagaacagaagtaagaaattttatcatgatcaggcagctacaggtgaatattttggaagattgttttctggggagagaaatccatttctaatctgcattttaatgatttgcttttaattctagactcgagaggtgattgccttatcagtgtaccgtatgtcaaaccgttctttagcttaagaacttatttgtagctgccagttgttccatattaacctgaatttttaaaagtactttctgcctttcaggaaacctttgtgactggcatttgatttctttctctctagtgttttatgggaataataatcttgtgaattttccaatcatttttattgtgtacatgttaaatatttagactgtggattatatagtcgtcttgattcttatttatattctgatttttgaactgttttatagcatattcacacctccaccagactgcttgaagaagaatgaaagtgaaaatcagttttcttgttcattaacaggtcttctgagggtttaatacttaaacttctggctggctgtcatggggctgcctgattctttgatttcactttatcctacctttccctctctcatgaatgcaatgaataatgactctaatatctttcttctcagacgaattaaattgtgactttattaaactgtaataggcttgcctaatttattaaattccaccttttctttccctctactccctcaaaactacttcctaggaaaactcttgcaatcactattaagagaaaataacttgtgacttagaaagtattcgtattcaacagatagttgaaatctttgcagattgggacattgtaagatttagacaaatttcatgatcatttgagttttagttgcaaatttataatgatataggaaaaaattagggtcctgagctcctttttcttccacatcagcttgtctgttccaccagacaagggctctcttaagtgattgttgttctgaggctgaaaccaaagagctaggttgctgacagagccatgaaatcatgcttttctctttttaaaaacaacagattaaaaaaaaaaattccttctctgttagtcacttcatgttagtatttatccatgtttaagatttacatttaaagcaaaagtcttcaaagggaaaacatgagttttacttctcttacagaaggaattctgtaaatttctacaagtatttttaaatattagtgggtctctttcctaattaagatcttggaaagttacgtgcaactctgactgttgtaacaagcattaaatatgagcttgctaaataaaatgaaccttatataaatttacttgtaattcagataatacataattttttacatatctttgctttatgtgttatactgtctttttctataagtggttacaaaattggggaggagaaataatttgcagattgatcctctaaataattaagaggaatctggagttaaagtctttcaacactggaattttatctgcatagtgttgtacctctataacgttggatgagttacttaacctttcagtgcctgtaaaacagataataatagtaattacttgcctcataggagttgttagtaggattaaatgtgataatttagcatagatatgtagcatagtgcctagcagatggtaagcaatgaaatgtcagctgatttttagtattggcattatctttgaagaagggcccattttaagatttgtttctcttaccttgctaataaatgtgttagtgtgaaaagttaaatagttccaaggttaacgtggaaataaaagtcaaataaatatgtttctttaataaagaaaaattcacttgcctttgaacatgacaggtgttttttaaatcttcagttgcgttaaggtaatgaactcagatttattaactggtttgtgtttgtatacacaattaatgttaaatgcaaaatcctttaaagtctaaatgactattgatctgtattttaaagaataatttttgtaagcttattttgatactaaaatgcattccactgtcatattatctaaacttctgggaaatgctagcacaattttgtctctttggagttatatttattttcatgatgaatattttaaaacttaacaacctattgtaaactgttatttttgcagttatgtttgcctaacacacaaacacaccaagcatgttcctgtccccaaggtctttgtactttttgttgcctttacatgaaatccactctccctaattatggcccagccttggagctctcaggtctgtcagggctctgcagaggattacctggttttggggaatgttttcttctaaaatgtggctctatctttattatgtttgttgttttccctctacctggcattatgttatatactcgtgcttgtttaaaatcactttcccattaatatccaagggtagaaactttgtttcattcactgctgattatcctactgtgtatgataaagcacagggcctggcacattgtaagcagtaataaatatttgttaagtgaatgtaggaatgttgttgatcaaattaaaacagttttgttgaggagatgaagattctgtgaaccaatttttaataatcattttacgtgaggttatttgaggtttttatgctcagaagtgaaccatttgaaaagatgtaatttataacttttcaccccccaccaaaagaaaagaaaaagaagatttaaatttagaatacttggtacatagtgtgaactgagagttaagaaaggcctgattgagaatactgactcagcctaaaatatcagtgatactgtgcagtaatttatcctgttttcttaccaggagcttgctcagtgcctaacactgatagtcagtaaatgtttgttgggtgaatgaatgagcctgtaaaatcagtaaagtcatgaactaattcctagtttcttacagagtatcctaaggacccttgaataaatgcttctggaataaaatggatggaaatttgcaacagaatcacctggagggcttgtaaatactgtctgttaggtttactttttccaccctgtgtttgaggtggagcaaaggactcttaacttctaacaagttctgaggtagtggatgtgatgctgtcctcctttcagaagctttgctgtatatctgtattcctgttgaggtgattcatgttaatgtattgaaggttttgagagcactgcagtagaggaagctgtttaactcttaactatttctgacttacttggccctagtcctctccctcacttgttcgtatgtatgtatgtatgtatgtatgtatgtatgtatgtatatatgtatgtatgtgtgtatgtatctatactcataaaattgttttttttttcttttttctgtatgcttgggtaggtaaatactgtgtcaggagtgaagccttcaaaactgagccctgttgcagagttggaagatattatgatagttatgatctgcatgaaagcatttgtatacatttttgagtcttgcaaattgtaatttggaataaacggcatgtataacaataatgattttatgaaaattgattccaaaatgatgaaatgatttctaagtaacatttttcccctttattcatttatcactttcagtcatcgtcgatggttttaatctgccaagccatatttccagaactttaggtacttgacaaaattaggaaataatattttgtcatgaaaagttgagttttctctagatgaagattgagtcttagctagtgtcaaatttttcctagttgtattttcaattttaggctaatctagtctcatggtacagcattctactttgcatgtcttagattttgttgacttaattgtattttaaaatatgattgtactgattctggtcttttagagtgatggttttgatacaagatgtggctaatcaatggaaaagggatgtttgaggaagaagtgatgatggttatgaactctagagatgttaaatgtagcacaaaatttgaatctgggattctttatgttccctaaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaaggtaaatttttttcctgatttgaaaaaagcagttcctttgtttgaaactattttctcaattattttttgctgattttatgtggaatttttcaaatacatgacaaaggataaaattgaacttaacccattacatctatttgtgaaactggggagaatctgtgtccccaaagtataatatttccgtagttctgctatttcccagataatggataatcctcaatacctgtttctttttaaagagagaaacagtgttttcatggatgtgtttattattaaataaattttaatttagttaatatgatactggctataataatctgactatatgttgttcacctgttgatcgatttcaaatgcttcctttcctgaattctgatactccaccagtgcaaaagacaccattcactaggggtaaaaagaaactatattaaatgtctcctattgagtataatacatgtttgtatttcagaaatactaatataggcaaaaaataggcctcagaattgagtctgctatacgtttttttttgagacggagtctcactttgtcgtccaggctggagtgcagtggcgtgatcttggctcactacaaccttcaccttccaggttcaagtgattctcctgcctcagcctcctgtgtagtagggattacaggcatgtcccaccatgcctggctaattttttgtatttttagtagagatggcatttcaccatgtgggccaggctgatctcgaactcctgacctcaagtgatccacccgcctcggccacccaaagtactggcattataggcgtgagccacagcacccggccagcaatacgtttaatgtaatgtttgtttccagagtttaaatcataaggggcaaatgctaatgacaggaacataaaaaagtaaatttgctgaggaaatcttaggagtgtgtatgttagacatcttcactgtaggtaagactttgaaagttgttggatgtgtgtgtgtatgtgttttggtttacatttcatctggatgtaaatgtattttcctgtttttccccttagggtgttgtcattggaacaggagaaaattctgaatttggggaggtttttaaaatgatgcaagcagaagaggtgagtacttaatatgttaatgatgtatttgttccaaatctgaaattcttcattgtaagtagagaatgttggattattttatatactattgagagcaatattttattcagaatggaaatcagttgtctctgtttagaaacataattggaaagcctgtaattgaaaaggtctaaattgatgttgttagtattctaaaggattttgagctttactcattgtttatagcagaaaaaggcttatagccacttatttgtagatcttattattttcagaaattagtgttgtggtaattttaaggattagtaattagtatatttgtaccttggaatatgtcttctatcaaattttttcaacttcacataattccaagtaagggtggcagggaaaagattgccaagtaaaataacctacaagatattctcggctaaaagtattaaagatgagttcattttaaatactttcttattataaaaagaagcttcattctgcaaatgtcgtgttctccccaaatcctctggatttctcaggtaacctgccaaaactccagtatgcgatgcaaagtgggaactcattccaagaggcgtggcagtgaagggatgaatagagaagagggttagcagttgagggaggattaaaagacctgggttactagcatgtttgtggataccaaaagggaaaaattggaaaagcaagtgagagagcagctgatggtaatgaagtcctgcagtggttggtaggagggagaacagatttttcctcaaaaggaagcatagagagaacggaccttttcaaataataaacaggtttttaaaaatagagaatttctgttcctcactgtgtgaccttgggcattgtgtaaaatctaagtctcagttttctcagtgaaggtgattatttaccttatgggagagttgtatggttaacttaggaattgctttgtcaagcacttagcaagcccctggcacttgataaagcttagtaaatatagctaattgtggtgacactcttcttcaatttatcaaggcaccaaaaacccctctgcagaagagcatggacctcttaggaaaacaactttccttttactcctttggtataataggtaagagaagagtgagtatgtatatatttttatttgagttttgttttttgaatgtgaagggtggtggtattctagttttatttattggcttttcttttttttattaagtttaatactttttaaaattataagactactagtagccattgttcatttcaacaaagaaaaaatagaactctgattcttgtaatcagaaaatatttcttgaaacattttagtatttgtctttctagtcttcaacaagaatgtaatacgatagttttatggactgcttttctatttttatttcacatatcctgtcataaaactcttgtcattaaattgatggtcacataaaacaaacataaaggttgtatagttttctattttgtgggaaaacatataagaagacctcttctagacatttaggattttttgagggtttttttttggtcatataaatacttctttagtgtggtgtcttctggtaaatacctctcttttttaaggaaaaattcttagaaataaaattatttagtcaaaggggatccatgtaacttttaaatttttggccagctttaagtattgtcattaacttcaactgtaaataaaagagttctcattatttgatttcacagttcattattagggaaaccgaatgctttgtcatgtgtgggttgatcatttttatttcattttatgacctgccaacgatttcttttgtcccttttcttgtgtcttgagtcttagattgataaaagctttttatatgactagattatcaatctttttgttgtataagtttttttttcccgtttaagttgcctttgaggcatgtggaataaacttggtaagaggacaatatatgtaattaaccatttatgcctagtgttccattattggaatgctaagcatgtgggacttatttatatcctactgctcaaggtcattgccaaggtctggttgcaaaaattcaaaaaattgcaacctcagacacaaatgggttaaaacatccccttttccttgagattctgttatcaccctcctattgataatctctgcaattaagttggttttgttctgttcctaaagattttcccaacctcatgtttataagaacatttattaaaacattgttgtatagttttttatttttgacattttactattttatttaaaatttattttagtacatggcttaaggcagagttttaacttttttactcaagttaattatcccattaattctgtaatccagtctttattcattggattgaagtcacgtttttatcacacattaagcacttgcattaattttggagtcttttctcctttaattttcttaccgtgttaattattccagctagtttagtatttcaaagtcagtaatacaatttttttatttgagatggagtctcattcttgttgctcaggctgaagtgcaatggcgcaatcccggctgactgtaacctccacctcctggggttcaagtgatttccctgcctcagcctcccgagtagctgggattacaggtgtgcaccaccacacctggctaatttttttattgtatttttaatagggacgggattttaccacattggccaggctggtctcaaactcctgaactcatgtgattgcccacctcagcctcccaaagtgcagggattacaggactaatgcaattttaaagcaatatttctgttaatacaatattagttgaaataactttgtaaatagtaattctgtttatccatctatcttcattgtaaacataaagtagaaggtaggaagttatcttagttatttttgttttactggtgtgtatgccctcataacttcttccgtttgattattgctcattttctagaaattttatagtgaatttgatagatcgaatgacattctagccaattaaatctttgtagtttctattagcactataccataaaccatttcaaatttagtaataaatatgtttcaactttacgatctctggttatatgttagtatattacattggacataatttttcttgccaaggtcaagagctagatcaggggtcagcaattgtttttttttgttttttgtaaagaactagatagtaaatattttagtccatatggtctctgttggaaatactttactttgccattagcatgaaagcaatcatagaaaatatgtaaataaatgagtgtggctatgttccaacaaatttcatttacctaagcagacaggagacccacagattatagtttgctgacccctggtataatcctttggacataatttctttcatcatgatagtatttgggataggatcttagaaggttgctatttggataattattctttagttatataaagatgaaaaaaaaaacttgtcttaaatgttcatattgatttgcagtcttgagatagcttattttatcaaacctctcgtgaatctgtttgctttttcctcacaaacctgcttgtgcgcccctttccccctattcttttcaaagataaaaggttaaagcaaggagtattggtttaattgatttttaaatttttgaaatgccataaaagtagtgatttttagatgttaatgcagttgtaggtgcttaacgtaaggcacatcactttttgagccaagtcgtaagtgtccctttgtgtgtagtatggatttgctgagaagtgtctggatattgtgttatggaaaataaagttttagggtttaattttgcatatttgatattaaatagaagacctatatgtttgctgccaccttctttttttcattgtatgaacatactggtaatttttaaaaaaataataaaatattactgctttaagggatggtaggagcagtgtcaaccaaaagtaaaactgtgtgtgtgtgtgcatgtgtggtgtgtgtgtgcacacatgtacgtatgtgagtatgcacagcattcacattaagcagtgttaactttaacctcccctgtttaatggatttttataaaatcttctaattgtgatctgatatgctttcccttttttgtcaagggacgttttagattccttcagcttgttctgttccttctaggtgattgtatgtaaaagggaaaaataactatttaattatctttcaggaatcatcatgttggttggctggttactgggaaaagatatcctggaaatgtttactattagtgtaaggtaagtctcaatactttataattggagtctcttttgcctcttttatttctctaatggacatagcttacgttttattatggagatcagtattacatggagcccataagagtataacatcgctacataaatagttcagaagtcatatattaaaattatccttagaaaaatgaaaatgtatgtatatggtaatgaagaaaacccatactagatgtctggaattactaatgcattattgcctttttatatataaatatacaattaaggattgtcaaattgaaaactagcaacatgaaagagaaagttcacaatatagaaattgaataatcaatttcagaggaaaacgaaacattgaagaaatgatgacaaatttaaaaaccaagtgtttgtattttcagagacttgtgaagaaactgcatccatgagataaattgttgtagaaaaggatcagagaacaaaaagagtttttagaaattaagattatgattgttgaaattaaaaattcaattgtaggggtgtaatataaattcaaagaggtctccccccaaaaagagtaaaaagtcttagaatgagataaaatgatgaagaggaataatttcaggaaataccacttgtaactaattggagtttcaaaaattacataagatatgacacacaagtattttctcaagctaaggcaaaaagtaagtctttatagattgaaaggattcactaaataccaagcagaatggaaaaaacttcaaccttgatacataattgtgaaactaaagaagaaaagtcaggtcatctacaaaggaagggtaactacgctggcatcagacttctcattagcaactgcagtttctaccacaggatctttttgggttcttctaaacattccaactcacaagactttcacagaccacatctgatacctgtgccctgaacacagcagggtaacttcaggcagccttctcctgagagtccgcagcagtccatgtagcaattcactcaagtacaaggagataaggtcaaccttgtgagtgtgggatctaccttgggttaaaatatctcgtgttctatgagagacgtattttgaaacatgcatttccagatgcctgcaaaggacatgtctagttacaagttactacacttgagaaactcaaagctatgatttcctataagataattataactttcctagtccagagagattttattagtcaggggatcccttaatcatagcagtgttatctagcagcatacttgacatattattcttaccaggtcactaggtgaacagaactagagttaatcaaatccagaaggggaagattattttattaactgttcatccacagcaacatcagattgcattagaataagtggagccgtggtaacaaattaggggggcaattgatcataaatctgtaaattgggcctagccaaaggattggtccaattagtgacaaataggtaggcaagtactcagaacattcatttcctacccatccttatatgaattccagcaaaacaagggtgaaagaaaggaagatgataatagacataagaaagggcaagaacttacttaggcatctaagaaaaagaaatcctggtagacctctgttgtaggcatatgaaatatttcaaatattagaacaaaagtcaatgtctttcaaaaagaaaagtcaaatagattacaaggaatcagaatgaataagaagtaaaaagatatttgtgatatagtgaaagaatgtgtttttttttttctcaagggagggggtgaaaatgcaatttgaaactcttggtttaaatttgtgtttaaaaacgccatgggttaaatataaaatacatttaaaatggggaataagtttgagatattaaacattgacatattatccattggatcatttttagtttttgaggatttgggtttttttttttttgagttctgtttgtacagattgacatatcataacttctgttctttcttcaaggtcttccaaaggacaagatacttaaaaattttcaaatagaataaaactcattctattttgcaattctgttttgcagtatggatccattggaatcttttataagtataagctacattatgggacctttaatgatcctatttttcctctttcttgaagtattttacaatttcttcaccctaggaattattttaacaattatttgcaagagtgctgaagatgactaaaacaataagaaagcagaaaaatgatggaatcattgagaaggttgatgtaataataaagtaaataatcactattctcttattctttagttttcttattgtgttgcctaaagtattgcatcatttaagaaggtgtaaaagaagtctaaaggcacaatctttaggtttgtttgttacagctttcattgaacaaaaatgagaattcagaatttttcactttctactataatggcaaagagaataattgacagagaagacttttcacaattattagacaaatcagaagatcagtgcaaagagccaaatagaagcactgtaggccgtaatgatgtgggtgaaattaataatataagtgaaatctcaagactgagtctttggatgatgatactctagatcttctcaaacaccttaattttgatgagtgagcaatctgtttttaaggacaaaaaagaaacaggtattctcttccagttaatcattctgcagcaaggactctatcatgtagtagttttcagcaagaatctggaccatctcttttagctaaacgaatgcatgaccctatttcattcatcttttatgatgcttgtttatcagcattgacttcatactgcttttaagtggagaaatgctgaaggctggtatgaatataaaagtgattaaaaggaaatagattatgcagaagtagaaaaattcattggattcatcattgtaattggtgtttataaatctaaaattgaaaatgttttgcagtcatggaccaaagaagataactgttctcttttcaacacaattgggagccatcagtggttttagaagtgttgcaatttgacagaacaaatgcaagaaagaagaactagattaataagctagcgcctgttagaaatattttttgaaatctgaaatcaatatttataagataaatatgttccaagttcaccaaaagcagtagatgagcagttagttgcatccaaaagatgttacccatttcaggtatagatgccttcaagtccaggaatagttttgggttatcattaaaatgaaaatttagagtgaagtttttttacaatttaattattcctctgcaaagttttgctaagatgacttaaatataaaagattgaaaagattcgttgtatctagattgtaagtgataatgcctgtttttccttaatggaagcattaaaaaaaaaaaaaaaaagaaaagaaaaaagaaaaaaaaggattccatttgaactaggaacattctctttgagtagcccaaaggagaaaaggaagtattaatgataatacatatttcttgactcttcagtgtgtattgtttagccaataatgttgttgcttatgtgctttcaactttaaaatcaaccagtaaataaagcatgaaaaagtcaattacggttatagaaaaggatgctaatgtactagattatgcaaagaaaaagttggtaatggaaattaggaagtagaagcagcagagggaacagtggtagaatgaagggttaaattgcttatgtccttatttctagcagatcaagaaatagtatttggaatggcacaaagaaagacttgttattttttaattataaaaggcgagtgaaataattctttaaactgtgataaaatacgcatattataaaatttacagttttaaagagttaatttggtggagttaagtatggtcgcaatgttttacaactgttaaccgctatctagattcagaaccttttcatcatgccagaagaaaaccctgtacacattaagcagtcactccccagttttcctcttcccctagtccctggcaaccactcactaatctgctatctctatggatttgcctattctagatatttcatataaatgaaatgatataatatgggaccttttgtatctgtcttttttcacttagcataatgttttcaaggtttattcatgttgtagcatgtgttagtacttcattcctttttgtggctaaagtaatactccattgcatggatgtcacaattttacatttatcagttgatgaatatttggcctgtttccatcttttggctatcgtgaatagtgttgccgtgaacattcatgtatgagtttttgtttgaacatttgtagttatctgtattttatagatgaggacagtaaactacagagctagattagtaagtagcccaggatcacacaagtaagagatggtgaagccagggatacaaatccaggcaatttgatgtcagaacctacattttttaaccactgtgcttaacctggcagctactaggtatccagtaaatgttaactttctcttccttttgagaagtttattttttaggtattgactatattaattttgcgttttattaagctttaagtaacatccaatttaaattttgctgtgagtgctgtttaacctacattttaatactttgtatatgttggttatagtttggctgtagcagcaattcctgaaggtctccccattgtggtcacagtgacgctagctcttggtgttatgagaatggtgaagaaaagggccattgtgaaaaagctgcctattgttgaaactctgggtaagtctgtgttaagagcattcttatgcaatgatgcgtaagtttatgtcaatagtgaatcatctcagagttttacagtttttatcttagagatttgcataatgatgtttggcttatggcaaaattggatatggttttaacaaccaaaaaaggcaattaaaaattcctatcccttaggtgaggggacttgaagagaaatctttctacatcatgttctaatgcacaaatcatgttaagaaaatccatacaacaactgaaatcttggagtaaaattaatagaatttttttcttgtgacatgtcaaagaagataatgtattattacagatcccaaatgtcatacttgagttgaatttgcctgtaagaacagtaaatttacagtagttatattgctgtaacaaaactttatgtgcaatatgctttgaaactccaaaaatgtactgaatttaatttctagtttgtattttaatatcttctccatatatgagaagctgaaataccttgaaaaatcctgattgaagaaattatacgggtttatatttagaaactctccaaactttctagaaaagatgttatataagatcattacataaagctaatgtgaagtagctttgtagaaactaactgtatataaataagaacatgtcatcatctaatttttatttttaatttcagaaactgtaccttatgctgaaacaagcataatgagagaagttaatctaaaattaacaatgagtttgatttctataaaattcagagaagtaggacaggattctagtctttgatttgttttttaagtgaacctatatttctccttgattcttttggtgacttgtaatgatttaattctttaggctgctgtaatgtgatttgttcagataaaactggaacactgacgaagaatgaaatgactgttactcacatatttacttcagatggtctgcatgctgaggtactctataggtttttaaaaacaaacaaaaacagtatccctttaagaaacttggtgtttaacattcctaacagttccagtgtcttaccttcaaaagggctgtaaattagtagtggagttattttctctctctgtgattttaccaagtctttgtctcattccacttgtacacttgttcaatccaaaaactttgattcctccttgacatctctctttcagtcaccccttcatctatccataatcaaatcctaccaattttgacttcctaaagaattttcccagccatctactttatagccagcttctttaagttaccgccatttctcacctgccattctgataaagctttttgactggtctttttccattcttgatgccctcactccataagcagtttgagggatctttttagaaccaaattttaagcatgtcactccataaattaaggtactccaatggttttccattgtgatcaggatcctgaactgtggcgtctcaaagccgtacatgttctgtcccttattttctcctctacccttatatgctaccctttgctttctgtgcaccaagtatactggctttatagttctttcgatgtgacacaattattcctactttaagaactttgctgcctttgtcactgtttaggatagtctaatgcctcttcatcctttgcaccttaattccaacccacttcttcagaacacccagaagtggccctatgttatatgttgtcttagcatttcatacctcttagtccttatcttaggtaaaattttctgtcccttttccccattataagagagcaggagctatattgcctagcacacagcctgcttcatagtaataaatactcgataaatgaatgaatgaatgaatcactttattttaacaattatatattgatacattgtctcttaagtgcacatcactgtgcagtagttcttcctgaaggtgcttatggacaggtctaatcctactcagtctatgcaggatttctgactggaatgctcttaacactacttatgttgggtacagtgatttaaaatgtatttatagctaattcattgagaaaaataagcagtaggcaaattgacagaagttgtacttgggtttatttacgtccattttacataggttttgaaaagagactcttgatatttacggtgttagatctggtcaaagatcccccatgctgtgttggtgaatgtgccctttctggatgattcagaagggtcattgggattacatgtgcttatatgatccaggtatggaaggtagaatattagtttttcttttgttttaaggtcatgctatatgtaatgcattaactatttgttaattgttttatctctcaattaatgtcattaaacattttttatttatttttatttttaatagagatggatcttgctttgttgcccaggctggtcttgaactcctgggctaaagtgattctcctgtcccagcctcccaagtgttaggattacagatgtgagccaccacacctggccactaaattgtatgatttttattgtgaaatttcttttcgtttggcttggtttgttctagacatatgatataaatacctggtttgtctctacctctgatttttaaaattggtgtgtaatatgctgtgttaaagtgatttgtaagtgctagcatatatctcaatgtctccaggcctgcatgtttgcaaaaagaatactgcttttgtctaagtcacagctttgtgttgtatgttacatatggtaatgcatttgagttctttgcaaactgtagtatgctatataagtgtaatgtcatataagtttaagcttacttatgtatattttcatagcttattcttttaacagtatattgtaattagaaaacaatgtctttttagattaataattgtgatgagaattagaatctatatttctttactaaatgtcctttttaaagacaaattttaatgcttttctaggtgaacacttttaacagtgtcattataaataaaatgaacagaactcattatagtttttgggttttataggtcttgtcaccaccaagtgtttgtagtgtttgtattattgatcccactttgtgatctttaggttactggagttggctataatcaatttggggaagtgattgttgatggtgatgttgttcatggattctataacccagctgttagcagaattgttgaggtaaatatttttttttccaagatggtgactttcttcataataacttaagacacagtgataggttcatagtttatgtgtatttttcttaggcgggctgtgtgtgcaatgatgctgtaattagaaacaatactctaatggggaagccaacagaaggggccttaattgctcttgcaatgaaggtacgtacctaaatttctcttctttgacatttgagacactgccctcacaacagaatgcagtgtcatcaatttcagtattactggtttttaggtattgagtgaaaaaaactcatactatttcattgtttttactatcttttaggtatcagttttattcctataaatgtaaagtatagacttttttcagtataactttattgttcacatgcaagttacaaactaatgagcagtcattgatttcttgtgaagaaatgttcctgtcttccacaatgttgagatctacatgtgaaatactttataaatgtgtgtaattgctgataaatactaacttttgaatgaataaaaggcaacattctttagtatttctatgtaaagataataacacagtcatgagaaaatagctttgttttcccagtctttcctttctctcctttgttaatttctcaaaatgattgtgaagttataatttgttttggggagaagaagtctcagttaacttttcatctgtcccaatccgtctccttatcccctaagtcctatatttgattcagtgagaaacctagtaagtccagcctgtcactcataacaaaaataactattcctacctttaagagtattcagagaaaattttgatacttgtataaagcaagaggcttctaaatgaggttgcttgaaatgagagacagtacagaattacaggttattataacatatttaatgaaataaaattgatagttttagaatatatagtttccttggcagaaaagcacatttctgtatcatttggtctccttacaactaaaacagcatagtactcaaaacatgaatccgttatcaagtatttcctgtgttatgcttataaagatattagtttctttgagggataaagaatatgaaactatctttttatgggcagagacctcacattttaggtagggaatttatattgacattcttgagacaaaaggcagtccaagacagcagacactgaaatcttaaacactgagtcacatataagataagaacaatgcaaattcagagctgggatatgagggctttgaaggataggaagggtttagatgagataagctagggaatgaactaaagtagaagtagagaggaataaaagagcatagagttggttgtggctaatgagttggccaaactggatgaaatgaaacgtatttgcacgaccaggaggatttttatagacgctgtatgtggtgggtttctggagaacctttaaggccaagaagagcctgaacatgtttcagtagaaagtagaaagcaatacatggtagaattttgagtagtttaaacatttttgatatttggaagatattttttgatatttttgatatttagatatttgatattgatgcaaacgctattaggagggaaaacaacaacatgactggtagtattcaggatataaagtggcagagggtaagggactaggatgataacaggtgagccatttgagtccctaagaagtgagagatttaatctaaaacttctattgatcataaaaatacatgctcagaattggttgggtacttttatttatttatatcctgcttcctttcagaatttgagtgggtagagggattaatacagtgtgtatgggaggtttagtcagcgtacaatccagaaaacctgccttagactatatctacatacctgggctttcatgttgaaaatgtatgctgatgtgtagggaagtacagtatatatagatggagcatttactatttcactattaactgaaaaataatccagccaacctagttacaagtggtgacccttgttctttgttaaaggaaaaaataatcacatataggtgagaattaactttctctttgtgccatatagatgggtcttgatggacttcaacaagactacatcagaaaagctgaatacccttttagctctgagcaaaagtggatggctgttaagtgtgtacaccgaacacagcaggtatccatctgtttaaagaatacttatttcctgtttagcttagatgactattttttcatttactgtccacctttgggtttagtcattgtacataataaagacttgttgctttaaagtacatgtaattaatagtacactcatctcttaattgtttgtgttctctttgatagtctttccttatagaatccatgcatagatatattcatggagttgctgctgtgtgagcaaacagcttaaatgagttgtagcctagtctcagtctcctgaagcttgtgacatcagattttttcagaattttttctcttcttcatgacagttccttataaggtctttgcagactgtgtttcaatctgtgttctttcactgaaggaatgtcttatctttagaacaaatgaagccaccttactttttgaaaagtagtttgcaaatgtatgtcattcatgttgattactccagcttacaagctgacaaaatgacataccgatattttaagccgccaccttgttcctgggtgcttgagaaatttttccagttagtgtaataagagttctgaattatctacagtgtataattatatcactcatagttgctattaccagcttgatgatgaaacttaactttaaaaaatattgaagcttgggctggatgcggtagctcacgcctgtaatcccagcactttgggaggccaaggcgggtggatcacctgaggtcaggagtttgagaccagcctgaccaatatggtgaaaccctgtctgtactaaaaatacaaaaattagccaggtgtggtggtgtgtgcctgtagtcccagctactcaggaggctgagacaggggaattgtttgaacctgggaggcggaggttgcagtgaggctgagacaggggaattgtttgaacctgggaggcggaggttgcagtgagccgagatcaccccagtgcactccagcctgggcaacagcctgtctaaaaaaaaaattacacacacacacacacacacacacacacacacacacacccttaaactttccttcactcttttgcctaggctgagtgcagtggcgtgacctcgggtcactgcaacctcaacctcccctggcacaagtgatcttcccacttcagcttcccaagtagctgggactgtaagcacgtgccaccatacctggctaattttgctaattttttgtagagatgggatctcattgtgtttcctaggctggtcttgaacccctggactcacatgatcctccaccttggcctcccagagtgctgggattgcaggcgtgagccaccatgcctggacttatttgttatttttatagttcctttgacaggaatgactagttggttatatgtttttacctatgagcaaacacatgatttttgcatgtgatacctatgattacgtctctatagaaaacaggaatgaagggatctcccttcattcatataagtggaaacatacagtttttaaaagaaaggccaggttggttaacactgaactttgaattgaagtcttccaggaactatgttcatgagggccaaaaaaaagatttccgtctattctttaaaggaacttttacaagcttaggtgaaagaagacaattggaaataaaactatgaaaatacaatacctttcactttaaacgttttaatgtaaagctttcagaaattgcattaaacttaggcgattttcagctgatgtcccttaaccacatagttatatggcaagcatatgcatatgactttttttgataggtctatttcattacattttgtaaaccatcacacggtacctcaagatagtgtggctcatgtaatgtttaataattttacttttcaggaacttttaatgtaatctaccaaagttttacattggaagattaaatcttcttagttgtgggagtgggggacagaaagtggcaggatatgtttggaaacatttgattattcttcacacttgctgacctgaagagttcctcttgcaagtgaaaaccaaccagtgaaatgaacaaacaaaacccaacccacagatgtgactcaggatctagaagaagtcatcctgacacagatagggaaacttaacattttaaaagtaacttcagtggctcagatagtttgcttttaaaggactttcacttgaacatgacaatatatatttatctctactatctccctggaacccaccaaaattactaacaaggaataaaagatataaactcagaaagtatagggaagattcaaaggtgccaggtacctttgaaggcagggagtaaggcataaggctaaaaatagtagagaaatttgaaattctgaataaggaaccaatagaactcccccaagtacctttgctgcttctttaggccagacggttagccttcctttacccctgtggaacaccagaaatctggggataagagtagagggtaggattaagccttaagactgaaaacagaatgattaagaagatgtcattgtcctgaaggataaagccctagttcttaacaccatttgtctcttggaatacatgaaggctggcatctccctactgtcattccctaagtaagaagattcaagagttttagaaaagctgcctggtctcgtaaggcagtggtccccagcctttttggcaccagggactggtttcctggaactcttccacaggcaggggatggttttgcgatgacactggtccacctcagatcctcaggcattagattctcttaaggagtgcacaacctagatcccttgcatgtgtagttcacgatagggttcctgcttctatgagaatctcaggccctggctgacctgacaggagattgagctcaggcagtagtgctctcttgcctgcagcccacttcttctttgtggctgggttcctaacataccatggactgtactggtccactgcctgggagttggggagccctgtcataaggggcacctttgagctaagctctttgttcattggaagcacttacctactcctggacttcatctcatcaccctacagcaaggcttaccagttgatccttagctctgccagtgctcatggagcttctagtcttttagtttcttcactcttttttttttttttatatactttaagttttagggtacatgtgcacaatgtgccggttagttacatatgtatacatgtgccatgctggtgtgctgcacccattaactcatcatttagcattaggtatatctcctaatgctatccctccccctccccccaccccacaacagtccccagagtgttcttcctgtgtccatgtgttctcattgttcacttctcatctatgagtgagaacatgcggtgtttggttttttgtccttgcgatagtttactgagaatgatgatttccagtttcatccatgtccctacaaaggacatgaactcatcattttttatggctgcatagtattccatggtgtattaaatacaagtgaacagggagggattactagatacttggagaaaatctttagtatgaaagccaaagaccaaaccaacagagaaagggatcttagagaaaggtagtggcagatgctgaagaaaatttccaaaaaccataaaaaagacaaaataactttcaataaaatgtttattaaataaagtcaagaaatgtatcaaagtagaacagaaagtcaaagacatgtacagtataaaaggtaaaaatcaaaacaaatacagaagatccagtaattaccccatagtggtaataggaagggtaataggaataggtaataggaagaaagaacagaaaatgagaagattttatcaactaatgctggaaaattttccagaatgaaaagactttagcatctagaataaagtggcccaccaactgctcagcacaatatgtatgttaaagcagagtggggtgagggataaacacaagacccataattaagaaatttgaggacacttggagagggagaattcgaagagcttctagagagctttaagcaaaggggagatcatataaaagggcttaggaactaaagtatggtagtctgccacttagcccagcgggatacattccaagactgctagtggatgcctgaaaccatgaataatattgaaccttatatataccgtgtttttttcgatccggtaacatagatggctactaagtgattaatgggcagggagcatatacggtgtggatatgctggacaaagggatgatgtccttggcaggacagagtgggatttcatcaccatactcagaatgttgtataattggaaacttatgaattatttatttttggaattttctatttaatatttttggactgctgctaagtaacagaaactgcaggaaattaaaccctggataaggggacactactttaatttctttatacttttcaatgaaaacattgacactggaggctggaagataatagagcaaagccttcaaaatgagaggaaatttatccctagctaaacttacaaatgtgaggatagaagaaaaatgtgtcccacaccacacaccctttcttagatattggtggataaaagaaaaaaaagaaaagggagacttaaaagacttaaaattcagtgaggatagaggtagagggttgttcctagataccagtggtacagcaggcctagaaatcagccaattagaaatggaaagaagactgaaggagggtggtctccagtaataatatagaggtaatagcttatctgcttctttgttgttgtgaaaaaataccatgagaagggttttatattacattgaagagtttaggaagaatgaatgataggtatacagaaaacaaattaaagaggtggttattaactttataaaagacaaaacttgaacaggaaaagaagtatcctatttgagctatcaatcaggataggccatgaaaacaacatcatgctctcctgctgcctccctgtccccaaatatctgctcattgtagttacttgggaatgcaggcagatggaagctccattttaatgtgagcacacactgtcacagcaggggtagaagaataggaaattgtgcactggcacctacatttccatttggaagtgacacaagtactcatgtttattggccaaagcaagtcatacctgaccgttgtggagtgaggacggcaatagggaaatacattcctgcctcccaggagaactgggatatttgtgaactgctatagtcattaccacacttggcttagcagcaaagagtcttgttgtaaacaaaatactggcagattttgctttagctatatcataaagatggggagggggggaatagatagtggaaatggggaaattaacatctgtcacaatagacagtgtataaaattgataactgatggagtagcagtataaacatgttaaaaacatgagggtaaatatcagagaaaacagctaagagagttaaaattattttgcttccatggagtaggactagtggtgagaagcgttgaacaggaaactgcagtatttcattataagcttttgaagattatttaccatgacaaaaaataaaagaaaaagtgcgataatacccataaatacagtgtgattgggagaattaaatggtgttttaggtagatagatatagacgtatatagtagctaatagagaacttgaaccattgtgagctgttatttctcttccatttcctgttatgttgcagtgagcctctttccacatttcagagtgccaaatttggggcttagtatagcattgccttttatgtgtgggatggtgggatagatgttttctatagaagatacagaaagctcccctataggaatatttaatcttcagagttcaggtggcagtcaaaaccttaggcttgagtaacttctctgggaattatgagaaatgaatgccacttaattttggactccaatggcaggtaagtacaagttgaaattaaacttgtgtttggtacattttcttcttaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagaggtaaggctatttcagcatagtcccctggggtggaaaggtagagccttcttttaattgcagatgaattcatgcttcacatttgagctgtccaactcacttccaggatttgtagaacccttgccagtattgaggtgttaagttttagttggttaattggccctcaaaagatggaaatttgagaatgtagcaaaatatgaatcactggttcttttagatctccagaggtctctgagtagctgatagaaattttattttaaacaagtttatcttatgagaagggaaatggatcgaggtaaaatggtgttactctctttttatcactttgttttaaagacaaaaatacttttctaaaaattgagtctgaagcctctaatatatcctttaaggtgattgctaacttgatctgttactgttcaccagggaggtaaagaagtccccagattctgcttacttatatgctgctgactgagcagtgatggggagagggtctgctggacacacacacattaggccacctctcctagggatgtcatgtgtaagactcgggggttggtggttggtgtcctaacctgattcttaccttctggatagtcatctggcttctgcagaatatatgtagttatgtagtctctcacagcagttggaagagttggcttccttaattttattattttaatgaaataggagtctaagcactacaatttctgggaggaagaaaaacaagttatgtgaaaaatgtttttatttgttgttcacttaagcaaaggctttttttgagttttaaacattttgatggatttatagggcttctgttcttaaaataaactaagtttggaaaggtactcttaccagcagagaacattgctcccagcctgctgccattgcccttctctctgaaccttctgtgctgctgaaccaagatcactcctcatacccctgcccccagagcctggtgcatctcatctgggatatgggctgtattgtgaccatcttaacacttcatcccctgtctccaaggaaatgggaggcagagactcatggctgagaagttattttgcaaatggatattttggatggaaaaaaatttaaaggaaaacaacttttccttccccctttccccttttaatgtaagaggctttgatgacaggttctagagtttctggggtttcatcccaaaggcctgaatctggaacatgccctggatccccccacctcagtcctcaagctttctggacccctgaagccaaggcagattctttctcccagcgtcatttctggggcaggaggaatctcttttctggtttacctgggccagacctaagaatagcaggatctctgaaaccacagggttttgatgtgtttttatcaagccaaatgtacaattgccaactgacactctggataattgagcacagggggtgccctcgtacattgtaccgtcactcccttctgaacagttggcagaccaaactgtttggaagctcagatactctggctcagggtaacacttttgttccccttacactcctcaactttccacctcagctagggaaagagaatgacagttaaggcttgacccaggattataatcgttagagcaagtgggagtttcagagacttaaggggcactgcagggaggccttgctgccacaaaattagggtttggattgataaagcctgtgtcggaaggggcagtggcagctccactgagacaatcctgggaagactgtggtgcagagggcctgttactcccctgattcacctgattctggggctttgaccctttctttttaaatttacttttgctaagttgcacttatttattttttaaaaagaccgttggtgaacaaaatgtgaacccatttctttcctcttttgaacttctgggatgtcatcacttccagtttgttggctttgtttccagctattaataaagcattaaaagagtggagaaaaaaaggtagggaagtgggcagagtcttgctactcttagcagcacatagcaagaggttttaaagtggcatggatttagaggacttaaagaggtcttgaaggtctaatatatgctccctctttttgttagtttctggaacaaagttttcctacctcattatattgactaattcttttcatatgaaggattgtggaggtttgtgtatgtgtgttttgtactgtaacattatgaagtagaccagagttggtagaggggaaagtttttgttgcacagagttttgggaaacattctgctcatttgtctcttgcttcatgtcttttcttctttatctacccttgtgctccacttccatcctccccctgagattaccgtaatgaagaacagaaagattttaaacctcagttgatatgtacttacattacatcttatgaaacaagtttcttaaaatactgtggttcttaattttgatattagagtatattttgttttatgtcaggggctctccacatgaaaaaagtttacctatccttgactcagagagtagcagcagattttcactggtgctaaagaagcaaataaatacaggatactaacctctagactagtgccacccctccattaggagtgcgcagagctgatctttccgtcttaggatttgctgacatatatttttgtcactgtccccttctgttaccatcagcctctatcctaacaccaggaactgtgaagtggctcattctctcaagggtgaaagcctttggagcccacatctacataaataattaggtatatgactcttactttggaaaaatagaattacttgcttttaaccttgattttttttgagcatatgtaatctttcataccttctgcttgacgaagaatggatagtttctttggtctctctggggcttttcagtctcctcttgacttatttatgtttagtttgtatgtgcatgttacaagttgttcagtctaatatctcagatgcaggcacatccctttggttaataaaagtagtttccggagttccataattctgagagcaagctaaatgatatttgggaaatgaaaagtactttgtactatatcttacatgcccaaggatgatgacagggaaataagtagaaataataatatgatggcgttatttacatactcttagagaaccaacgttacaaataagaaatgtctgttcatgttatggaaggagtaaaagaatccaaactattgttggtattaatggttttacaaccactttccaaattagctttaccttccaggagttttcatgtacaaagttgttacaggctgtgtataattaactaatacagccttctcttcagagtgtttaatttttctggagatcttggaaatggaaagatgaagatccgttagaagccaccttcaaaggtgtttgcctgtttaaaattgactttaaagcctaacaaacccatagtttctctaaataattaattctattttttaaagaggtagagttcctgttgaaagtagctgcatgtgattactatgtgaaaatattgttcattttctgtctcttgcctactctgcccttcagttctttagtttgattctttttaattaaaacagcttaaagggaccccttatccagaaccattaaactataatgttttggtctgtaatcattttgattttacaaatgacattatagtcttaagtgatttatttaagaagtgttactgtctccaatttctatcaactaaattctgatgttttcatgactcacttttttttgttgttgtttggattttattatttcctaagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcggtataactagactgctttcttttgttttcgatagtttttcttaaaatactgtggtgcataattttgtgaactattagttatgaatatgtttatgtaatattgagattatgcaattgaaatcgactcatggttttgctcatggtctatataaagttggcaaaactgattatagtttaaaaagtaataactttgacatgcataactaaatcatgaaatcacatgcattttattcacagaagggtaattatttttaatctcatgatcaactgtgatgacagagtaaaagcactagatcatgattgtcaaaggaaacatgaaacttagtttttcctttcaacttaagtataattttcaaagcagacttgtgcataatttggcagaaaatagcttgttatatgtatttgtttttcatcatgtatacctatatttgaatgctatttaagattaccgtaagaagtagaataagagcgaagaagagaatgaaagttaatttcccagagcctctaaactgtaattcatactgataaatttaacagttggctaaactccattaattcttatttggagaggggctagtccaggagtttcaaactatatattgtctaagaacaggtcactaggaacattatattattggaagaataacttttcgatgtttattttcatttatgtataactacatgattaccacagatccaccaccattttgtctggcttcggacactgtacttaaaatgcactctgatcttcgttacatttcagctgctgagcagaacctgattggcctagtttcgattcttaggtatgctagcttaaatagtcaaaattctttttttttttttttcctgtagagacagggtcttgctatattgcccaggctggtcttgaactcctgggctcaagtgatcctgtagccccaaagtgcagagattacaagcctgagccaccgtggccagccttgaaaattctttattcttaaatttaaacaaaaatgaaagtcaaacataaaactccagacttaatactgattcagataggtttgtattactggtaggtaacaaaagagaacagataacaaatcatactaaatgagcattacgttgactagcctgtcaagcaaaaacaatttggtttattacattttctctctcatttgctttagccagtcgtctgggattgtattccaaaacttcccagtcagtctcaggagaagaaatagatgcaatggatgttcagcagctttcacaaatagtaccaaaggtaggcctaaactaaagccttttggactgaaaggccttattctaagtgttaccatttctactactatcttaatgaaactgtttaattgtgaacatcagggatttaaataaccaccagatttgttggttcaaatcctgaaatgaagtcttatcattgaattagtcttatcattgattatttatgatatgatgtttatgaatatcagtgcaaaattattaattttagcaagaaccagatttcctctgagaaaagtactgtggaaattaatagtgcttgtatttatgaattagaggatggagagagatcattgatttatacttcttactcttttgttcaattttaattttagcatgagtatgtgattttttttaggtacaatttacatatagtaaaattcgcccattttagtgtatagttctgaacattgagtgatgcatgcagtcttgtgaccaccaccacaatcaagatatagaacagttccatcatccccccagattatcttaggcctttttgtggtaccttctccccctacttccaggacttggcagccactaattctttttttgtctctgccactttaccttttctagaatgcactaaaaattgaatcataccatatgaatgaggcttttgaatctgcttctttcacttagcataatgcatttgacatttatctatgttggttgtgtgtattagtagtttgttgttgttttttaaagtaatattctattataggtgtaccttacctattcaccagttaaaggacatttagattgtttccactttttgatgattatgaataaagatgctgtcaacatttgtgtacaggcttttgcagtttgtacacaaatttattttgcatgaaaatacattttcatatctcttgggtaaatatctgtgagtaattgctgggtcatacacttaatgtatatttaatttcataagaaactgccaagttgttttacgagatggctttattattttgcaaccccaccagcagtgcctggaacttctaatagtcctgcatcctcactagcacaagggattgtcattgccctcctcccccattctgataagtgtacaatggtatcttactgtgattttaatgtgcgtttccctcacaactagtgatgttgaatatcttttcatatgcttatttgccatccatatatcttctttagtgaagtgtctgccctgcctattttttaaaaattatgttttctaattattgaattttgagcattctttatataatgtggatacaagtcctttattagatatttgtttgaaaatgtttctttccagttggtagtgtgtcttttccaagagagaagcttttaattttgattaggtctagtttttcaatttcttcttttatggactatgcttttgatatctcagaactccctgcctaacccaggttcacaaagattttcttcgtgttttcttatagaagttttatagttttgggttttatacttaggtctgtgatccattttgagtgtatttttttgtatatgttgtaatgggttacggtttattttctttgcatatagatgttcagttattccagcaacatttgttgaaaagactgtcctttttccattgaaatactttttaacttttgattataatgcttttctaacaaattatttgtaggaaggaggtatctcctgccccacagcacagtagcttctttaaagccaggttccctgatatgagattaacttactttattatcttgggctgccttgtaaggggcctatcaaagcctggtttgtggatacccaggtcccataggaagtgccccataagaggtgggcagcagtcttcccagttgctgacagttcagatttcttggttttattgttagttaacttatatatgcacatctatttgtatgtccttcaaaataagcacttatctggaatttattttattagctattttgtagccatccattgttactaataaaatgtgctacctcctccttcatttattttacacttacaacttcaagttatatattcagaatgtggaattttcttaaattgtttctgcatcttaaggtatgtctatacttttttgattagaaaatttattcattagtggtatatgttcaacatagaaaaatcaaataatatagaaaagtaagagctacaatagaagttgtctgtaatctaacccacactcaggttatgcatccacagagtatccataataagttaacctattatgacttaaaaaaatgtgtttaacaaaacctggttgctactttatactgttataattctgaacattcattttacataactttggcatttctgaaatcaattattattagaaaacatgtttttaattgctgtacaatattttgagtataccatgtgtatgtgtgtataaatgcatagcatgcatatatatatatagagagagagagttacataaccattttcctgttgaaatttgagcttctattctttttactactgtaaatgttcctttaaggataatgacaatagcaaccatttattatctgccaatgcatgtattacctacattatctaatttacttcttatagctaccttatgaaagataggcagcaccgctttaaaaattctaataattaataagccttatttcttagcagtgttagatttatagaataattgagcagataacacagagttctacattcctactccatctctaccctctactcttacacagttcctcttcatattaatagactgcattactgtagtatatttattgcaattaatgagctaatattgatacattcttatttcatggtttacattaaggtttactttttgtgttgtacctttctaggggttttgacaaatgcataatgacatatatccaccattacaatttcttttgagacggagtctcgctccaccattagaatttcatacagggtagtttcattgccctgaaaatccctgtgtttgacgttttcatccctccccactccgcttgaatccttgacaaccactgatctttttactgtctctgtagttttgccttttccagaatgtgtatggttggaataatatcatatgtagcctttgcagactggatttttttcactaagcaacatgcatttaaggtttcaccatgtcttttcctggcttagtagctcatttcttgtgagcactaaataatattccattgtatgaaagtgccacagtttatcacttcaccttttgaagggcatcttagttgcttccaggtttggcaattatatataaagctgctctaaacattcatatacaggtttttgcgtagacataagttttcaattcatttgggtaaatactaagcacagttgctgaatcagatcatatggtaagagtatatttagttttttaagaaacaggcaattccatttttatagatgaggaaattgaggcccacagtacttgggagacttggctgatgtctcagagctagtaagtggtggtgttggcattggaactggaatccaggtctgtatgctccagagttcatctgttgtttgctgtttctttgaatattattgaacctaagatgtacccaactctgattattattattattgttattattttttaccactgcccttatccatgtacatctgattatttttatacactaaattcctgcatgtgaaatgattggactaatgttcaacacatttgtaaggccgttaacatatattgctgaattgtcctctgaaaaagtttctgtttatatttccataaactacacttcatacagtagcattaagtccctagacctccagccccacttccctcatcctctagcaagtggttagattttggatgttgttactaatagaaatacactattttgcttatccatattttttatttctcaacttctaatcactcatgaatgctgttttcagagagagccaatcatagtcctgaaagatgtaatctctaatgttgaaatcctgaaagattgaaatccataaagtcttaaaatcctgaaaaaccacagtccccaaagatcaaaatcctaaaaatctaattctggaaaaaataattttaaaataaaataatttacatttttaagaaggaatttatttgagaaacataaaaacatgaaaatgcttcattggtcactttatacaaaataagcaataataaataacctacatagttttgcaagcatttgcaagcataaacactcaggcatattatatgacagaaagatataacataggactgttatgagcatatgaactgtatttataaagaaataggtcataagggaaatgcataaacacctatcactgtggttgctaattgtgtgcaccccactttataactgtgggtcatttttatctttcacaaatgcagatgtatgaaaaggacatctgttcatttattgaggaagtttcaacatttttacatacatgtacagtgcttacatacaaagtcaacattgtgatcatgcactttcgtgaagtcagatttgcaaaacatgcataaaacaaattagaatcctttaagtctctataacttacgcttccagtgttggaaatgatgcaaaggtgaaatacatagcatagcaaattgtaaaaaataatactcacaatttaaaatagcggaaaaggaaactaaaaaaagaaaaataatggccgggtgtggtggctcacagctgtaatcccagcactttgggaggctgaggtggatggattgcctgaggtcaggatttcgagacctgcctggccaacatggcgaaaccccatctctactaaaaatacaaaaattagctgggtgtggtggtgggcgcctgtaatcccagctactctaaggaggctgaggcaggagaatcgcttgaacccaggaggcagaggctgcagtgagctgagattgcaccagtgcactccagcctgggctacagagcaagactccttcccccaccccacctcccccgccccaccaaaaaaaaaaaccaaattaacaacaacagcaaaaaacctaaaaagaaaatatgacatggaaaagcatattacagagataaatgatggacagttgcatggagatagtccataaaagctggctgactttcacgatcattaactatattttgaagtcttgcagcatgatgagtagttgcttttttttctttaagaacatggctgtcagcgtatgttcatattcattttctatgtggcactgctgtttttgaaattctatgattcgatgtacactaacatgaacattctctattaaattttcctatcctgtgattgtgattttcaggagtttagactttagggattttgatctttagggatttcagcatttgggattatggcatttggtattgcatctttcaagattatgatcccagtatgttgggatcatagatgactgttgggatcactgccacccagagagctggggcagtgtggatgtttgctttgtttttggggtggggaaggtgtttatatatttgaatagggctttttttttttttttggtgcacgtcctatcctggtaatctcttcctgaagtttatttctgaataaatcccatattggatttttttagtggtattgggacagagtattagtaaatgtatgtgaaatctgcagttacttaaacattttaccattagacttctgcataacttctcagagatgctaaaggtggtgaaactttcattttatttgctttcttcagtttgtcctctggctctcttataaaaattaaggtgaactctggaaaccaaccaaagatagttagggaagaaagaaactaattacaaattacatcatcagcctggacaaatcacattgttggggtttcccaagtagagtgtgtgtgcgttaattatagcagatatcctgatgctattccaaggagactaaaacaaaataagacctaagccctgtcagaagctcgttgaattgcttaaattcatcctactttaaagtggaattctataaatactagccctgcctcccaggtattttgtatcttttgaatacctaagtcttttctccaaatattattagagaattttttgtctcattaggttagcaggacggcccccaccctcatcttgtctttttccctacttcattttgtgttcatgtgacccttttatagccaatatgtttatttggccttcagctttttgattagtttagtttagtttagtttagtttagtttagtttagtttagtttagtttagtttagttagtttagtttagtttagtttagtttagttttagagatggtgttttgctttattgcccagactggagtgcagtggcatgatcatagctcactgctgccctgaattcctgggcccaagctatcctctgccttagcctcccaagtagctggaactgtaggtgctcaccactatgcttgggtaattaaaaaaaaaaaaaaagaaagaaaatccatttctgaatggatttttaaacttttttgaaagaaaggatttgcagaaatggagtctcaccacgtgttgcccagactggtcctgaacttctgggctcaagtgatcctcccacctcaacctcccaaagtgctggggttataggcatgagccactgcacgtagcctcgtcttctgctttcctttgtttgttttttgagacagagtctcctgctttgttgactaggctagagtgtagtggtgtgaccatagcccactgcaacctcaaactcctgggttcaggtgatctccccagttcaggtgatccctcatgactcagtctcctgagtagctgggactactggcatatgccaccatgcctaggtaattttgttattttttatagagatggggtcttgctgtgttgcccaggttggtctcaaactcctgggctcaagtgatcctcctaccttggcctctcaaagtgttgggattacaggcataagccactgcactcagacagtttgctgcttttgcttcacatcagtttgaataacttttattattgttacaaataaaacagaccttttgttctaaatcattagcttgttgacattttcccccatgtactagaatcatattaattgtgcccctcattaaaatatttttcagccatcctttttcataattcttttgaacacatttcattctccttttggaatatgaagtgttgctatgtactttgacctagagccagttaaaaagtagtactgaatctcagttttgcttgttattaagtcatctgggaattctcagtgttttccatttatgactttttctagtgtgtcctacattttccattgatccattgatagaagtggtcatcctctttcattcttctttttctgatttttacagcattacttgcatttatatttctactgaatctattcaccaagtccccatattattatcacaattcatatagtctaatttttaataggttgtaaacctttatttcaatcacttgttttttcttcagtgcattagttttctttaatctgtcctagaagatttgaggatcttcggtaggttattctaatgcaagacacatcttttccattaatctctcctttaatattttcctttctttttttttgtaacttcctttccctagtacatcttgtctattaatttccatcaaaagaactgtgagtgctgaccacaaatgtgacactgaaaaggaggactcataagaagagaaaaataccccttgtagattgcttctgaaaatatgtggccttgttctactctctttgatgatttttatctcttcctccaaatctaaaatcaggccaaaatacccaactgtcacaactggatcaagccagctgcaccttttaccaccaagtacaaggctcactgcaacccacggatacccatctaacttcgggacagccatgatccccaataggcagggatgacacccacgaccagcaagaagcagctacagaaaattgatcctcagtgcctctgcctcccataaagatttatggggatcatgtctctcggagaaatgaggcagaatagggaattagggtaatcaagggttaaggcataagtaaaagaacagtagatgcagccagttctaggcaagattaggcagcatttaggccacatccttaatcctgtgataacaagacagtagtctccacttcagcctctgattggctggggaccaagtctccacttcagtctctgattggtcacaggctaatccttcatagggtgtaaccaattggaggcctctaaatggcatctggtagtgttaccaaattcttttaacttaataaaaaccctaggccgggcacggtggctcacacctgtaattccagcactttgggaggccgaggctggtggatcataaggtcaggagttcaagaccagcctggccaagatggtaaaaccccgtctctactaaaaatacaaaaagtagctgggtatggtggcgggcacctgtaatcccagctacttgggaggctgaggcagagaattgcttgaaccaaggaggcagaggtagtgagccgagattgcgccactgcactccagcctgggctacaagagcgaaaatccatctcaaaaaaaaaaaaaacaaaaaaacaaacacacaaaaaaacggctgggtgtggtggctcatgcctgtaatgcactttgggaggccaaggtgggcagatcatctgaggttgggagttcgggaccagcctgaccaacatggagaaaacctgtctctactaaaaaatacaaaattagctgggcgtggtggtgcatgcctgtaatcccagctacttgggaggctgaggcaggagaatcgcttgaacccgggaggaggaggttgtggtgagccgagattgcgccattgcactccagcctgggcaacaagagcgaaactccatctcaaaaaaaaaaaaaaaaaacacaaaccctaaagaacattgtagttgggactcatgagccgcttgctcgagcccgttctactctatggagtgtacttttgcttcaataagtttgtacttctgttgcttcgttcttttgttcctttgtgtgttttgttcaattctttgttcaacacatgaagtacatggacaactcacagtcacaacctttcattcgctaacttattttgcagcttttgccaaacacttgttatatttcagtgctgtgtgctacatgattaatttctgcagtaattagagttttcacttggaaggttaccagtatgttttggatatatgtgtaactcagtcttttttttaaaggcacactgaagagtttctgaatggatttttgaacttttttgaaagaaaggatatttcccaaatataagttatgtgattcatgatatttggattgcctagggataatcagtagtgtgatattacagtgcagctgagtcttttgtttaagaaaataatactttttttatttagacctttattaaaggagagaaccagggaacagtctttatggtagtactgagatttattcagttgttcattcattttatttgtctttatagagcgctgttggtataggacaaaaatctctggcttcatgagtcttagaagataaatgaatataatgttaaataagtgcttaagagcaacccccccccccacaaaaaaaggcaaaatttgaatgataagagagggagattgaaatttttatatagtaagactagggagggcctcactgagaaggtactatttgacagaagagggacccatgttatatccgaggaaagagcattccagacaagggcagaggctggaagtgagtgtgcctggcatgtgtgaggaacaacgaggaggccaatgtagttcagtcaggaaaagattaatgataggagtgcagtgaggtgtgaacttcatgagggacccggtagataataaaggacttaggcatttgttttgagagagatgtgaaatcatttgagggttttgagaagagacacgcgatctcacttctgttttaacagtgccactctggctactgtgttgcaaattgactgcaggaaactagggcagaaataagaaaatcagtttggaggtattggcccagagtgtgggcaatggttttggagtaaggtggttgaattctggatatatttgtgagtggagtcaacaagattcgctgtcaaactgcttgttggcacataagaaaaatggaggaattaaggttggctcccaaaatttggagcctcagcaactgcacatatgtacttttcactaacagaggataggaaggagcaagattgagacatctaagaggaaatgtgaagtagggatgggaattagttttgctgatctggatttcagaagaaatgtctgggcttgagataaaaatgcattcaaaaaaatgcatgtaagtaaaatccaaagccatgtgcctgggtatgctcacctgaggcgtagggaattctgagacctcttatagagaaaggaactgagccctggggtgctccaacatctaggcatcaagagggatcaggagaagtctgtacaagaggaacagccaaaaaggtaggaggaagaccagtatcggtggtagtggaagccaagggaagatggtgtttcaggagggactaatcagctacgttagggtgcggctgagagattaagtcagatgagaaatgactgtaggcattagcaatgtggtggtggtggtggtggtgcaggtctttgaaagtcatgaatcgtgtttcactgcagttgtggtaacagtatgatcatgggatggattcagagagaatgggagacagcaagtataggctacttgctaaggagctctgctccaaaaatcctccccgttcctatatcaaaattttttccttgctgctgcactttaccatcagtatacaaacatgtttcctcttccatttaaaaaaaataaagaaaaaaaagggaaagggtggcagctgaaatgggaagggaagagaagtggtttttctttctttttttatatggaagggacaacatgtttttgtatactgacggtaaagatatagcagtgaggaaaacattttggcacaggagggaggagaatttctggagtaatggtcttaataggtaagaaggtagaatctttgacctgcagtagatgcatattgagttcatctgtagtaaaaccagaggttagttcctggatacagatactgagttgggggaattgtggaaattctcttctgattctgatttctccaaagtaggaagcaaggtggtcggctgagaaggaggctagagaaaggggatagattgcaggtacgaggagagaaaactaatatgaactaatcctctaggagaataggaaagagaatggtgtattatgtatattgaaatcaccataacttgtaaatattgttggagagagtgacatggtagtgaggcagaagttaaaatcattgtgaaatgaggggctgtgaactccggagcagtgaatgcttacagttagtgagttacagtctcatctgacattcagaactgaggttttatgaagggagaatagcggataccgtgttccacctgtaggctcccccagtggtactatttgaggaggttatagggatggtagtgttttgtggaaacactaggttagagcaaagtactatttgaggaggttatagggatggtagtgttttgtggaaacactaggttagagcaaagtgaaaaagagtaaaaaatagaggagatttgttggaacacagtgaaacgattttagatcaggagatggggtcagaaaaaaggattaaatatttattttggagagataaaaatcatataagcaatttagaagtacagtggaagagaggctaatgagttaacctgagtaaaagggaatgagcagacacttgacactgtaaaaaatggctctacagacactgagaagcagctgttctttattgctcctgaagacagaacaaagggaaaaggctattttagttgtatgcgagtgtcataggaaacagacgcaagagaatttttcctttttttgtctctggaacatttcaagaataaggctgttttctttccagagtttacacataatgatataaattggatgacttgtttagattgtgtatttcctgtggtacctttggtaaagattgaaatgaccatgtcagattaatgtcttaacaaacatatgtcatattgcttaagcttgatctcagtggcaaattaaatacagcttaaattgatgagtttttcatcattagttatgaatgcatgggttattctgtagaaatcttaatattgaagatttttagtgtatcttgtattttaacaggttgcagtattttacagagctagcccaaggcacaagatgaaaattattaaggtgagtgtgtaagaatcagattgttttatttctgtatacaaaatgctgctactttacttttgttatgtttgcattacagggagtagagcatcaaggtcagaaatactgtgaagcaaaacagttttttttttttgtaagagcttgacatagaaacactaatagagaatttagttggcataagatgtagaagaaaacttgaatgaagtatctgcaaatacagccttctttaaacagttagacagtataaaacaatgttctaactggggtccatagccgagtcatcccagcgtaaatagcagtaattagttagaaactaaataaatacagcaaggaaatagtgttgtgacagtgtgaacagtgcttaaaaggctatgattatttatattaattagtcaaatgtatttaaaccaactgatagagtatccagtagttaatggtcttaagttatgatagccagccattgtgtagttcagagtttctcaaccttggcaccattgacattttggactggataattccttgttgtgaagggctgccccatatgttattgaatgtttagcagcattcttggccccttcccactaggtgccagtaacatcccccaaatcctgatagtccaaaacatctccacacattgtcagatgtcccttgggagacacaattgcccctggttgagaatcattgtatagttgtttgaagaacagaatttagagatacagttctcacagatgggaatattagtagcaactttttctaagctttatcttactgagatctccatttgttgaagttcattgaacaatgggtggtctatattatttctaatcttaattatgtgaaaaaaatagggaggatttgtttatcgctttgtatggaagcaacatttttatcaaaattccttcctctcccctgtcctctgctccactctagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtaagctttgtttcagtgaatgcctatcagagaatcttcccctatcctttcctgtcccccacccctagagaattcaactggaaaagaattagtatttaaacattaggtaaactaaaccacttttctagggtaattatcctattttatggtatgaagaagatgatttgtgtggctggaacaggcatagtaaatggcaggaccctcatttaagaagtatttgccaagtgccagccacatttcacctttttctgggcactaatatgatggtatagtaatggcctttattttagttaaattcaggtagttagaaatatgcatatgtatggctctttttttggctttataataaatattgaaaattatgaagtttacatccatacctgttttttatatcagtaatttattcatcttgccctcatttaatgttataatttattaaatttaaatagctctatttgtgtcagccacagtttccagttgatttaagactccagtgtaatacatggtggtgtcagtttcacagtgttcaggtggggatcatgtgaatcccatttatttatttatttatttttttggtagctacctgttggatgacctgagtttagtgataaattccaattatatgttccaggctgctttattactctgttttggcctacagggaaacatttgggagcttaggactcacagtatttgccaagcttttgcaaggatatgagttttttctttccattattataattatatagaaatcttagaagaaatggggagttgattaaaaagcatagattttcctggattcagctaaatgaatgagataatttatatgaatccttgtaaaccatgttcttcatttaattcctctgcaacatgtgatctacttgatgtgcaggagcaacacgtagcttaaattctataattcctatatatctcattgccatttgattcctgacatgcattagtttaaacctttactctgcattttgtaccactaagaaaaatgagcttagaggaaggtgaagaagataatcatggctgggcagggtacctcatgcctgtaatgccagcactttgggaggctgaggtggatggatcacttgagcccaggagttcgaaaccagcctaggcaacatgtcaaaacccatctctccaaacaatacaaaaaaaatagctgggagtggtgatgtgagcctgtggtctcagctactctagaggctgagctggaggattgcttgagccaagaaggtcgaggctgcaggtaagtcaaggttgtgccactgcgctccagcctgggaagcagggcaagaccctgtctcaaaaaaaaaaaaaaaagataatcattttatgtattatgaatgtgaagtattttctcttgtgtgaagagacaatgcatgattttaatgttgaagtatcttcttcagaataagaattttaatattgtgacaaattagttcaggtagagcttaggcttgactttaattctttgctaaaataaatgtttccatattgatacatgtgttgtattagttggaattttattttatttatttgtttgtttgtttgagtcagtctcactttgttgccaaggctggagtgcagtggtgtgatcttggctcactgcaacctccgcctcccgggtttaagcgattctcctgcctcagcctcccgagtagctgggattacaggcatgcgccaccacacccggctaatttttgtatttttagtagagacggagtttcgctgcaccatggtggccaggctggtccgaactcgtgaccccaggtgatctgccagtttcggcctcccagtgtgctgggattacaggcatgagccacagtgcccggttggaaatttattttcaaaattagctctacagtgttttagtatagatacatttttgtatgataatattttctcacttcatctttattttttaaatttcaggtctgcaatcgaagagggtaaagggatttataataacattaaaaatttcgttagattccagctgagcacgtaagtttgcaagaaatttgtcaccatgggtcttctggataaattatatgaaaagtagaacttaagcagaatgcctagaaacttctctgccttatatttgtgagcattgttcatatgtcagttttccaaaaagaaaatttattgtattctgaaattttaaatggcatgataaataggttgtaaatgtaacagttagatgtctgtatcatcaaaatgtataaatctttgtgatttatttaatagctcacatctcattgtttcctcttggtatctttttccaaaagtagaaggggtattgtgtagtcaaagaacagttaccaaaatattgttgaaactatcatgcagatgtaaaaattctttatttgttcctgttgtctaaacatcttgaaaatcctttgttaaaatactcttagctttaaaatgtccacgtgactgaagaatagtttacttgaaacagtcttcctttaaaagcatagtagtaagagatttttaaatgctaaaaaagtggtatcatagaatcaacagatttactctactgatatttttaaatgactctctttttcaacaggagtatagcagcattaactttaatctcattggctacattaatgaactttcctaatcctctcaatgccatgcagattttgtggatcaatattattatggatggacccccagctcagaggtacgagttttttaattgcatgagctggaaagacaaggaatgtgtactaccctgataattaagttttaaaacttgatttatggacagtgttggaaaactttgcagcaaatgttttaacatttatgttataaattgtgtgatgtgtgtattttattaattctttttgagtgtgcatgcagtgtagatctgagcctttccactgttagatgcctagcctaaggttgagaatagatcaggaataggtgctatccctgtcctcaggaagtaagtaagccttttatttctaagaaatgggtataatggagaaatttctgggttcagttttattatctaggttctactgtcagttttagagactttgggaaagtattagaggacctgagtgtcataacttttttaaaaaatttaataataatggggtagttgagtgatagatgtcatttggccactccagcaaatcatcccagttaaaacctctttatatgaaagatatttcaaaattcagtcggtaggtcatgtatttcacaccgtatttgaaataggtaaacttacatgtaaatgaattggatggttttttgaaagttgattatctatcccctatcaaattgtgccaaacaaataaagaggagagaaaaagtgacaaaatcagtggttatttttgcgtaatcagccagcgttttatgatgcaacattttgtttctataagaaagcatttagtttgccgaataattgaggttagtgaggttgtgaaagtaacaaatccagaccttaaaacttgaaagtaatttatttttctgtttgtttttaagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgaggtatattcactggccaagctgctatattaacatgaattctgtatatctgataggattcttagttattttgatgggttacccagaaggctgggaagttaagggagctcttttagtgaaaaatataagaacattttaaaagagtttgatttccatctttatggataaataaaattattgattcatgtattagaataaatctgcagagaagtatcagttacaataaaaatacatgaaaatttagagagaagttggaaaatctgagtcttaaaatcatagagccactttattatttttaaataataacagtattttaatatctaatacatagttcatgagaagttttttttttactttttattatgtagattacagctattcactaggtgatttataggaaatttaggtagcttttatgtttcatgtgttaggctaaagttatttcttcctaatggaaagaaaatgtttatattttttaaaaagcagcgatttatccattaaattcagccactgaaaagtaattttgttattgcctcttgacagctacgagacaatgtgattacacctcgagacacaacaatgaccttcacatgctttgtgttttttgacatgttcaatgcactaagttccagatcccaggtatgtttaggtgaacttagttgattgacttgattgactcacttgagtagagtgctttctaataagtaggcaaagattatgggtttttagctttgcttaattttgtagccacagattgcagccccagacacagccttcttataaacatgtgccattggtcacaatgaggatggggcatttgtgggaggtaagctttatgtctgactagaacataaaagtattaataattcacaggtgttgtcatctgcgtttagctggctatagctataagatagatcgtggttaacattatttgagcatagaacaaacctcatagtttctgttgagattttattagtctcattttaaaagacagtattgctaggagtataagagcagttatgtgcctattttttttcccatcactcctgtcactgtgtcaaagcttaggacattctaattttgcttttcttcccttgttgtatcttaaggtgtgactgctgcttcttggtctaagtgttttgatagaaaataatgggctagagctttatggtacttttttagagcatattgtccttaaaaactagtttcatttgaggcatgactattcatttcagctttaaagcactttatgaatccttaactatattaccatttgccatgctggaacttctgagtacagcgaattctcactaattgaccaatttttgaagaagctgtaatatttatttttttatgaaaagtggttttactttttcagtacacacacaattaggtccattctccaagaaaggattttagattatctaccttagtgaatgtatagaaatgatttagcaaaatacaaataaagtttcttgatgtttgggatgttaaaaggtttcttttctttctatggtctaaattatatagtgtcactttttaagcaagccttttcttgataaataaaataaaagctactttaatatttacttttattccatctgaattattccaaaacagtagtaaaatttaagatatttcatagaattgacattgcacaattcagtgataaagtgacactgcttgttaaaaattagaagtgaatataataaagaagttatttctgtgaccaaggagtaataaatgaactctctgctctgccaacagaccaagtctgtgtttgagattggactctgcagtaatagaatgttttgctatgcagttcttggatccatcatgggacaattactagttatttactttcctccgcttcagaaggtttttcagactgagagcctaagcatactgggtaaagaaaacgttatctttatcatttatgtattttagataaatcatattttctaatgtgtttgttttaattttaaaattcttttaaaatagcaaaataagtaactcacttgatttgaaaaaggagtctattttttcacttggggaagctcaggggaattactctcctaactccagggttttggtttttgctcttttataggttatcaattgttataaaaatcataatacgtgattctcaaatatagcaaatcaaaacctgctctagagtatagtttataactttttatgtactatgccatcttgtatgaagagaaaactagacttaatctccctgaaaaccaagttgctctcttctttaaagttagaattttcagtaaactaataatttcattattctttcttgtttgtacattctaatttcacaaaatgtcagtctgaccaaatagcagaatgttttataaagactatttggaaattacacatttttcttacattaccatttattaaatgtataatacagtgcatttaaaaattagttttcctgtgtaggtgtgaggaatgatatatttgacagtaatgctatcctttattgagttctcaatttgggtatttatgaaaaggagttatacagtttcactgtattttttcttgtaagttaaaatttaccttaaaattgaactagttgaatttcagtattttaattccatattcacatttcttcctctttttaaaaaaatggcattttaaggaaacatctgcaattttccaagcagtaaataagaattgagatagtgtggatagtattgtaaagacaagtcttctatgctttgaaatagaacatattaatgtcaaatttttaatcttcagataggcattgtcattcaaattgtctactactgttgatacagtacttttttaaagggctgtgtgatctatgaaataaactccttttgttggtgatactgttaaaggctagccacataaggtttcagggaaagtggtcagaggacttgggttctaattctggctgctgcctttcctagttatgtgactttggataagtcacttaatatctttttttcttttcttatttttaactgagggtgattgtgcctgccttatggaatagttgtgaaacaatgtgtttgaaagctgtggtggccaggcgccatgcctcacgccagtaatcccaatacttcgggaggctgaggcaggcagatcacttgaggtcaggagttcaagaccagcctgtccaaaatggtgaaaccccctctctactaaaaatacgaacattagccaggtatgatggcacatgcctgtaatcccagccacttgggaggctgaggcaggcaaatggcttgaacccaggaggcggaggttgcagtgagctgagatcatgccactgcattccagcctgggtgacagagcaagacttcatctcagaaaaaaaaaaaaaaaaaaaaaaagttgtgttaaaatgctagaaaaatgtaagctattaagctttgcaactgtaagtttcaaagaaatgtaaaacccaacttattttctcttgcagatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttctttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaatgacatcccagtggggactattagcattaaaattatccatatggatgctgaagatacagaaattaaaattatccatatggatgctggagaatgcatagtacacagaatctatgatttaaaaagaagttgaatgtacagtacagatccagattgcaattttccataatatattaatccaagttgacatggatgagttaaatgggctagtatctaaattttaaatttttaccctatttcctaatcctaggacttgctagagtccctaacaatactaacttacttgatgtttttccctgttagactaccttatggagttatttggccccataatggctaaacatcagggaagaaaagaaaagaacttaaaataattcactgattaggtaaacagttctgaaatgatcaaaactggccacacagaacaaggctgaacatgttgtgtcacatttgtgctggacattgcatgacccagagatgaaacaaaagtgaaaccatgaaacccgaagaccctcccctctcaggatacaggctttatttatatagcagtaaccaccctcacaagaataagacacattatttacctgccatgcccatgtagggtatgtattttacattggtagtctttttgagatcacttaagttttggtctccttgatatactatataagtaaagtaagtattggtcacacttaaaaatagtttctcactgaaatgaattggaggcaaacaataaacataatatttaggaaacttaattaactctaccttgctttctgcctctgtcacttggcaattcacttccacatatgactcacccatgaagttagatgatgaactggttatcttttcattacatttttttagtacctggagtgtgctagaagtagaacgataatggcatccctgccctgtaggagcccatgaacacagatagcaggggatataactgctaataagctgtttcaagaaagtaaatagggatctttgcccatttactttaaaaatacacatagattaaaatgagtccagtgcacttttcactagatgtttccttgacattggcatttgaaaatctttgaagtgctttttaagactgagctcctgcaatccaaacagcagctgatttgcatactaaaacgtggtatggatgttcatccttaactagtacgtgattggacagacagatcattctgatggttaagtttccttgagctcagttaccacttgaactattaactcttatttaatgacattgttttgggttttggttgtcaagagttggttattgttaataatggataatggttaaccagtccctggtattaatgtagatacaattgtccataaacattgttgtaggtttagatttaaaaagaaaaagtagtatcatgccttcaggaagttttcagtcagttctggagaccaatgtgaaatatatccactagagtggtaaatgctgtccagaatgctacagtagttgaagtagagaaataacttcatgggatcctcaaagaaatttgtcatagaaatttcctagaactaatgacagctgaatcaaattttaagttgggaaactccagctgagaagcagtaggacagtgcagccaaacagcaaagcctctgcagaggtggtggtaggggctataaggaatctgtgaaaaccacaatgagtttgacactgttaaggcaggaggtacagtgtgaagggttggagagataggcaggaacctaatgctgaaagcagagacatttgatttgtctgatagcatgccagggcatttcaagagtttgatgtgagtttggatttttgtatcgtaacatgctgatggaagcacagagggtcaattgtgaagactgaaatagggagaccaattagaaaatcaaggaagcttaaggagtaaagggataattgagctgtggcagtcaggatggagagaaaggcatggaatttgaattgtcttttttttttttttttttttttttgaggcagggtctcactctgtcccccaggttggagtacagtggtgtgatcttggctcactgcaacttctgcctcccaggatcaagcgatcctcccacctcagcctcctgcgtatctgggattacaggtgcacaccaccatgtctggctaatttttttgtattttcggtagaggcagggtttcaccatattacccaggctggtctcgaactcctaagctcaggtgatccaccagccttgggctcccaaatgctgggattaggtgtgaaccactgtgcccagctttgaatttgtatcttctgagagatagcattgacatgactggacaggagaaaaggaaaatggaaaagatactagtctgtggcctttggcttgaatagtagagctattagcagaagaacctaagctaagcagggtttagtgggacacaggtccatctgaaatgtacagcttgtggtgtctttgagatttcccagacggatgtgttaatcaaagctatagctgactaattataagctagtagaaaaacaagcatccattttttttgttgttgttaaattaagcgataagtcaaagtaaactcagctttcacaaaataagattttctttaaaaactttcctttagcatagttattaatcagcaaacagttgtgtaaattcaaaatgcagaaggacaagataatatttcaatctcctttgttgttgaatgttaatagggaatctgttattaaggttactgactggaaaacactgatctgaattactggtagcaatttttttgatacatgtagtaagacactttctaagaggtgagagcgtgtgtgtgtgtgtatatgtgtgtgtctgtttatgtggcataccacatagcttaaggtatgccacgtaaggaaaccccaatgagtaaataacattaccattagaaaacagctacttactctgaatgagtaattatggcagaagagtagaaaacaatgttggtttttcatttgtttgttttttgagaaggagtcttgctctgttgcccaggctggagtgcagtggtgcgatcttggctcactgcaacctttgcttcctgagttcaagtgattctcctgcctcagcctcccgagtagctgggattacaggcctgtgccaccatgcccagctaatttttgcatatttagtagagacagggttttaccatgttggtcaggctggtctcgaattcctgacctcaggtgatccatgcgcctcagcctcccaaagtgctgggattacgggcatgagccaccacggttggcctgtttatttttttaaattttactcgtaatttttttggcctttctagcctcatatcctacacaatgctccaatacagtccacttccagatcattttggacagtgttactttaagttgaaatcgttttttctctgtcccaatgttgagaatcagagcttttacctctacttcagagcccagtgaaatgccaacaagaataacctttccagatttctagtgtgtgtttgtgtgtgtgtgtgtgtgtgtgtgtgtgtgtgtgtagtacagtttcttgtacactttttttttttttggcagggtgttgctctgtagtgtgatcatggctcactgcagcctggacatcctgggctcaagtgatcctcctatctcagcctctcaagtagctgggactgcaggtgcatgccaccatacctagctaattttgtgtatttttttttggtagagattaggttttgccatgttgcccaggctggtctcaaactcctgggctcaagcaatctgcccactttggcctctcaaagtgctgggattataagcgtgagccatcacgcccagcctcatttcttgtaaacactctttgaatgtagcaataagtttgcatataaaattgtgggattttatgttttagaaagcattaaaaatttaagttgaaaacacttgttgataaatctaaacagaaatttggtgatctctttcattcaaaattaaatgtcaaagtttggggagaaaagtgaaaacaattatttgagccattagtttttatccttagaaatccttttctaatgtaaatctgctggtgttctcgtgtacacgtgaacatatatgatgtaacagcctgtgcttgcacagctgctccaggtagatggtgtttcatttgcaggtcaccgtacacacctgattttgctattcctatcctgttttacgcaaatctggccaaactgacaaatatactgacaaaggcccacatttctgtggtggcttcatggctgttaggcctgacagaacttcttttcatatttaacccaagggtgccccagaatcattatttcttaagcaatagttgcattgctctacttaataacccttttgagtagaaaccacatctcattgttatgagcactcaatgccagaaactgagcaaactgttctatataaattccagagatccatttttgggctctggatttgtagcttttgaaaaatgtgccttttaatacagttttttaaaaaattactaatcttctcaactacattaaagaactttctattaaagttttctctgataagtataccaaagtgccctttagttgacaagtgacaatttggtgccatcttagggtcataaataaaataccatataatgcctggaccattgctcttatcaggtctgcatcttgcaggcatactgtgaaacacgtgatatgtgcatcttacaaataggtgactgtagaaaatgtatgtctgataggaaagacatgacaaactttacatttaagcattattagatcaattttaacaagctataaattagtatgttttaattcctattcctgtctcattcatctgtgtggttgcgtaataggattgcattagattttgtaagtatttttctatgtggagtgggtctggatggttggatggtccatgcatcagctagaggtattacaagttagggaaatagtttaatttgatcttgtttaactcacccacatggagctattatttagttttggtgtagaaactatggccaggcatggtgactcacacccttaatcccagcactttgagaggctggggaaggcgggttgcttgaggccaggagttcgagaccagtctggccaacatggcgaaactaaaaatacaaaaatctgtagagcgtggtgatgcatccctgtaatcccagcttcttgggaggctgagaaccagaactgcttgaacctgggaggtggaggctgcagtgagcctagattgcgccactgcactccagcctgggcaacagaacaagactgtctcaaaaaaaaaaaaaaaaaggaaagaaaagaaaaactgtgccatgctggtcaaattctcctgttgcttatttttgtaaataaagttttattagaacacaactatccacattcatttacaatattgtttattggcactgtcatgctgtggcagcaaaggtgagcagttgcagcaaaggtgagcagttgcaagggactatatgacctgtaaagcctaaaatatttactatctagccctttgtagaaagtttgcctactcatttagatattcaaaaagaggaaaataggccctgtaccttgcattcagtggattagaaaggaagtaccatcaattttctctaccctccaatctcccaacagtatattctctcttgaatggatgctcttggtagcagatttgatgtcagtgactactctgagtctccatcaaggcccccatgtagagaaagtcagagtgtctcagactgttgttaaaacatcatcaaccaggaggacatgccatcacattatcaaggcttcttgttcttacagtggctggagtgttctgatctgccgtcccatctgaattgtgcttcccatctctctctctttgctcacccaattttttatccatctgaagcagtctgctcctatctggttgatgggctcacttctacctcttggatgcacaagagaagtggaggtttccctcctattggttgtacaaacccagagaaataaagcttaatctgaataggcttaagtatgttatcttgcttagagaagacaacatttagtaatagcagaaactaaactatcctaacagctcagtcttagggaaaaaatatactcactaactcattttttcagaacagaacattctaaaccaaaacatatttgcatagttcccacagataccaaaaggtgactgtatatgtgcatgtatacataaatataaaaatatatttatattttgagagaaagacttagctattttaaccaaatagaatgttttcaggagtagcaggaatagaagagattgcatgtgcattgtagcatgttcatttttcatttgatttctgtccctaaaaacagaatccagtgaaactagctggaaatacttctttcatgtattatctcattcatttacttctctcattttaacagactgttatatggcctggtgcagtcacgccttttaaattttaaaacttccttccttaacatgaagttctcgtcttagaatttttacagctggatggacttgaatttggtattactcacacctctggaaagaaatgcagaagcagcttatcctgtatggctcagaaagctgttgctgaaagtggggtgtaatgtttttaatacatttttccaagagtagtatttaatttcaaattggtacaagatgcagaatcactttcagctgtgatgactgaaatgtgtcattaagacattacgagataaacaccaagtaccccacatctgtcttattgaaaatacagtgtcatattttgagtcaggcaccactgaaagtttatccttttatggaacttcctggtcttggtagtgacagctttccaggtgctgctcaggtaaatggtacaccagccagccaaacagcatgtggtagagagcagcacccagtgaaatctggcaaacttgctagggggaaaactgggtttggcctccttaggattatggagtagggccaggttataaccctggtagttgcaggaagaggaaattcctaggaaatggtaatatctgctcttcatctttttctatctttttttttttttttttttttgagatagagtcttgctctgttgcccaggctggagtgcagtggaacgatctcggctcactgcaagctctgcatcccgggttcacaccattctccggcctcagcctcccaagtagctgggactacaggtgcccgccaccacacccggctgatattgtttttgtatttttagtagagacggggtttcaccatgttagccaggatggtctcgatctcctgacctcgtgatctgcccacctcagcctcccaaagtgctgggattacaggtgtgagccaccacgcccggccacctttttctatctttaaacatgccaagggctctttcaaattgggctttaaaaacactacagaaaactctctgaacataggaaaaagggctcaagggggacaggtactcacatggggataattccttctggtcttttttcattattttctaagtttgagcttggctgcccattgaaattgtcttggtagttttctaccctttccagtgtggctacggctggagttgctataatattctcacattcctgcccatctttcttcttcaccatatttgatagtgttgatctcctttgcctctgcaaaattctgctcttaaacctgtggcaactctggtctcacgttgtcttaatctttgtactgcttaacactcactcacttcttcccacattccttgctttgccctggcttttcatgtgcggatataacaatggctatcacttataacacacttttagtatcaggcactgtgctaagtaacttaaatatacttgttattgtatcttttacacaataatttggactgttataatccttattttgcaagtagggcaactgaggcatagtcattgatttatttccttttgtgcacaaaggagaaaaagataattctaagggctttttagctatggtctttatcttctgaaattcaaattcagatgtcaaaaggttaatttgaattctttccccatgatcaaatggcatgaaagacctgtgattatatttacaggatgcatattaaactttcaaggtccaggtgtctcaaaaagtgcttttaaaaaatagacttccagtataattttatcaccactaaatacagaacatgattaggttatagtaaaagttttcctgtctctgcagctttctctctaaaatttattcatcttagctgcccagagttccttttgttacttgaactgctaattgaagacagtttccaaagcctaagatgagatttcatttgttagaactgaattagaaagagcaggacctaatcacttgattgcaaacataggaaactagattttggaaagggaatatgggatgtacaatattctgcttctacacaggtgttcctaatgtatatctgatctcaattttaaaattcctattctttaaagccaggtcaaaagccaggtctgagaatcttcttgtgatttaacctcttctcatcctggtgaccgctgtttccttattgtagtattcagtctgcactttgccattttgcacttgacagactgctttatgtaagggtaaaaaccacagttacttttgcaccaacttaataaaataatctcttgtcatttcattgtgtgttgtctcccaagcagcctgaacaagaatgtcttctgcagggggttcaggtgctatgtcatcatttttcggtgaaccaccttacatactcctgtgaagtgcctgtgacctctcatctaatacatgtaggagaagatatacaccagagtagtatacttaaagggacattattagactgtcactgctttactgcaaggctggataatttcagtggaatggtcctgagtgccatggttagagaaaggaacctgacttattacttctgctggaggaggacacttttaatgaaagaaaaacatggtagatgtaattcagtggttttaagaagcagtgttgatgataacccaggaaatgggacagttatattaatatagtctccagattagcttcaaactccaggaatcaaggtagggaggatttgatataacaacggtcttacatggtttttcttttttctttttttttttttttttgagacagtcttgctctgtcacccaggctggagtacagtggcgccatctcggttcactgcagcctctgtctcccgggttcaagcagttctcccgcctcagcctcctgagtagctgggactacaggtgccctccatgatgcccggctaatttttgtatttttagtagagacggggtttcaccatgtcggccaggctggtcttgaactcctgacctcaaatgatctgcctgccttggccttccaaagtgctgggattacaggtgtgagccactacatccagcaccggtctcacatgtttatagtcctcattagataccttattttccagtaacatttcttctcaaaaatagatgtacttgactactcttttcttgattcttctgggagtaaccatctctttggagatggttgttagtaaggttataaaaataaccttactgaggaactcccatgcaatcctctgaaaataataaaaatttccttatttcaagaactcttatttaacaaagtaattgttagggttgaatactctaggggcaaatgatttattgtgccttttgtaaaagtcaacacttggcaggtgtgtgtttgacactggctgatgctgggcttatttctctaagagtatggtaattctagtaaagtaaagaaaattgtttatcagatattaggaactgtacataggcctgctcaaaatggcagctttaaagctacctttagggctattcctgatggaatataccagtgggagagtacagaaggaagaacacaatttgtatgaatacaagtaaaatgaaggttgagtatattttcagatcttgcccaatgcatttattctacttggttctctttattttcaagttctcatttggaactggccggcactttcagaactctgggtatttctaattttagcagcctctatttggcagtattttccagagcagtaccttttaaacttcttccctacagtccacagtaaggaatatattttacacaatcacctaatacatgatatgtatatctgatattttccattctaactttttcattaaaaaatgctgggtatgactcattaaatactttcacatctcattaatgggtcaaaatctgtagtataaagagggcatagggtctggtattgctgcatatatctcttgatattttcacttctcactgtttcctccttctccaggtctaacagctcaggatgctgtttcttatttggctgaagccattagtttcaacttctcctttaaaacctggagtgcacctaaagtgctcttcaatcctgtcatggtctcattgactaagtacttacttttagtagagacagttttctgtctggcatcctcacttctaactttcattggccagacttcatactaaagtacaaagaggaaactgtttttaaaactttttgaaatgataaccagctgctacttaaaggcaataattgagtgagacttctactttctgagaatgtagctggctaaattgctgcaatttaaagcatatagactatattaccattaacttgctgaaatggaacatgagaagtataaacatggtttcaaacatatttagaaatacagaagcttcttaaatcaggttgtatttattaaaaacaaaatacaaaataacttggaattcagattattgtgatgtttatcccctaacaggtcagtcctaaagaaaaagctaattgtttcaagggtggtaacggaagaattttaagtaaggattatattaaatacatctagtttgatgcaaactgagttttattcaatgttggaggcctcactatgttcctctaagttttcaaccattaacaacccaaaccggttgtttccctcataccaacacttggtgtgtgcagtggttctccctctgttcttagaacagctggtattctgtttcttctgcctttttttttttgaatttgatctaccttttggtaggaatatttcagcgggggcatatgaccttgtggcattgaatagatattcataaagttgcttagcctcaggacatatgctcaggagactttctacagaggtcgatgctagcagttgctggcatagtccgtgcaccaggcttccactgtacagtctgttcaaagcaagaaaaaagtatgttgttaaagaagtaattcagtgcaacaggataactaccattgacatagcttcaacaaatgcatctaaacaatgagagctcttattgctctataatattatcgaaattacttaagaataatctgttctttgaaggaaggaactgagctggtatgacaaagattctttgctggtgatacttaaaaacttttcatcaacaaattacgtgatgcatgcttagtggttttgcagctagccccagactgagcaggtgtctttaacaaacactttaattttaaagaaaaggaatttaaaaggaccctgataaaccaaacaggcagtttgttagaatatgagaaaatttattggcatcatttgcaaggtcattcactgagactaaaaacctacttcacaaatagaagatgggattaattggaatccacaagtttattatggacaaagctgataaactggtaccttagcaatccatgtagaaccatcatttaatcagtgtaacatctctgtgtaaaaagccttggttatgctaagattcaagaacaatcctgctgtttaaatcattattaagagaactgttttgttttgcatttcctgttttgttttaaaaggatttgtggtaactaaagaggatccagtcaagaatggccttaaattattaaacgaaagaaataaagaatccaggggtcaaaggccaattagtcttatttgtgttagctcagatataaggcccagagatatattaacaacactgtttactgccaggaggctttttaccttgaaacatgtaaagtcccaccatattttgtatgcgtccatatatcctcattcaaagtattgaaggcactggggctgcaacagcaaataaaatagacaagcccctccccccacagagtttacatctgagtggagagacaaacaaaacacaatctatctcctttttatcttcatctctccctcaagtacctcctggatggtcaattaccaagatgtccaatccattgatcctatcacttttttcactgctccacaccctactgctgctgtcacttctttttatcatacccagcttaaactccacagacaaacattataattactctgtggcacataggctcaactcccttattgtccttcttgcctggtaaagcaaacatcctaggttaagttcacttgggcatctactcatcatctcacttagaatgaaagctccattagagctgagattctgtttttgtccctacaccctagcacagggtaggcatttaatatctgaatgaatgagtaagccatatgccaagtggtaagaaatgcaattaaaaaaaaatagagtaacaggactagagtgaatgagggtagacagtgtgtctcactagggtgggttatcagaaaaaggctctacaaagtgacatttaaagactgagaggaaaggagagagttgtatcctaccaatgattgcctcccctctcccacatattaatgtattacttaaaggaactgattttttaaaattggattgaatcatggaaacattctttgagaatatggaaataatttaatatttttcccgtttccagctcttcagctgtaacagtgactcaaaatcaattacattaagattagtttttttttgttttggtttttttttttaagtaactttgttgctttaaatataagtgaaaatactgtatttacttttgtgtgcttccatctgaactaaagtttcccatggtgcttaccgagttaggtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatattattctctttactgttctctttcaccgaaa

SEQ ID NO: 363 - DNA, 379977 bp, Homo sapiens
cttctgctgtcaagtagccagggtgggctccgccgaggcgaggaggggcgccggtggggagatgcgctcccaggtgtttgcagcggaagtgggaaacctgtagggtatggtccagctgtgccgcaccgaggcgagcaggagcagggaacaggtaggaagctggacttttccttctttgcagataaaataaagaatgcgcatttccatgctgttgcttcccttcccccagccccgcccagccctcgtcacccccaaatctcctgtggtccctgcagctctcgccgtgcggcgcgggaaggactggggcggaggtggctggggtgcggggaagcaggggtgcgggatgccggagccctggggtgccgggcaaggcaggacggcagtgccctagaagagggctccgagctcggggtctgtgtctcgtcaactttcctttcggaggctgccgccgccagcgccgggaactcgccccagggatgccatatcgcctcggcaggggaggggtggggaagcagagaggtcggcagcccggggcctgcaggtctttttctcccgacgccggcccgcacctgctcatctttcccatcccacctgggcgcctggctagcgcatcccggaaaacctgggagcggttgcggagaggggaggaagcgacttgtttgtcccctgacccctctgttaagatctagctcccttcaggagatgggggtggggaagaatccctgcaactcgaagggcacgttccgattaattacgtctccgttgagaaggcaccggcccttctccacgatctgcggcaggtgggagggagagaccgcggagccacggccccttccctcctagcctggcgctgtctacgggaaccaccttcacacctagtttctgaaaggtggatttggcttcagggatttccagggagtcaagtgattgtgcccggatgggctccgagcggctgcgaggctgcctccctaggtgaccgcatctgggtagtaggtgttggcccagtgccggttcctgcaggagtcagattgctgggagcagtaggcagaagaattgcagagagatccgacgctgcatcaccctctgggactgatgacaccctgctttgaaaattcctgaaaaattgggatgatgggaaagagggaaagcggatagctgcgacctttccttatttatttatttattttcatgccaaaccgggcatgggtattcgtacgtgtgcttgtgtgtgcacatctccaaggtggagctatatatagctcctgcatacccagcccggcttccctgctgctgagccggctgccttggccttctcaagcaatctggaagcactgagtgggcggggcaaaagggaatccaattctccattgggggaaaagccggagaagaagcattcagactgctgaaaccctgcgtgaaataatgtttttgtaactcacgtaaagatcaatatttcatatttcatgttttcaatatgtcatatttcatgttttcaatatttcagtattttgcaaacattcttagagtgccaatataatcttcatccatttcgccgcatttttcggtttctaagtgtacatatgaaccttaccagcccgaagtgtaacgcaaatcaaattaatacatgccgtatctgggatattttattagactcggcataatggtttggttatttggtagtaaatttatttcagtggtaacttatggctaacagcatttggggatctgggaatggatccacccactttccaggactaaggaactgctagaacccttgcgggggtagatgtgaggtatttctttgtacagattttacatgtggacctgatatttaaatttgtactgctttttcatatcacatctatttgtactatgtgaactttcttttatagattgatgtatgtgcatttatctttgccattccctgaaattacttattcctgatgacaacctttccattttcacagatgaagaaactaagattcagaagacacaagtgattggttgaaagtcttctgaaaactttaatattccaacaacctgccgtgtaattatactgcatagcagtttcccctcaaatagaatactttttagcttcccaggatttttggtcctggcaacaaaatgtggttaatgttgataccaggaacaatataaaccaagtttattcggttctagtctgacatgtatccctacaaaatttaattctgtgttttaagaacaaaattctaacttgccaagtcattttgaagataaattatttaatctaccaagttaccatcataggcagtgcgagctggcttttaattttgctctgcaacttcctgatgatctgatttggagcaagataattaaactctgagaatctgttttcttgtcttcaaaaggaattttatagcattgaaatttcaggttgctatgagggccataaaaagcatgcatgtttctatcatggggatgggcgcatagtgggtcattaataaacagggctactggtaataataacaatacataggtatgtatcaactaaatgcattttaaaattcatggttctaacaaaacgatcactcctcttcagaatctctagtagactattttcacttgggaacttaatcatacttagtcttattttgttgcttaatcctcatttgtatgtctgatttgttttctaattaggaagtactttgcagaaaaagactacacttataatctttttgtataccccaccacattgaacacagtcctataataagtagccttaaagattcttgttcaggaagcatcatcctaagaagctggatgggtgcagcaatgatttggggatatttttttggtagaaggctatgccttgggaggaaacttcctctggctttatgatcctctccatgaggagtaatggatgacataaggtgtttctatatcttttcatagaatgactcggttctacagtagggattatgactatgtactggttctatgtattctcttgtatcttgtgtcccttgagaccaactaggaagagctgaaatagacaatttatatttctgtatacaaaatatgtcctgtaattgccttatttcaaaaaaaatcaacaaattctccaatttccatctatttctacatgtaaattggccatggtctctatcatatcccacaacttattctaactcaccagtaagctcctcctcaattccaatgtttgttttctttttattgatgtattatcgattgttctcttctgaccttctattttccatattgtccatcttcttgaaattttgctccttgacaccacaatgctctgatagcgtacttttttcttaatttttctaactttcctttctttgtctccctcttatcttctctttctacttctagctttcaagcaaatcccccaaattgatgacaatttatcttattgaaaataaagttctccttctgcatttccattcctaatctccctcccattagccatttcctttacacttaccctatcggctaagagcacaggctttgggaggaagcctgcaggtgttaatatttatgtatcatgatgcagttaagcgaacatcagcaagtcaactggggattatcatagcacttacgtgagaggattttgtgatttgtaaaatattaagtgagataatgcgtgttaaacattcaaaataaggtttggcccatggtaattactcataaagaatagctattaataatagaagtgctattgtagcaattgtaatgcacaaggtgaaaactggttttgctttttccccatcaataggcatcattcctaaactggcttttatcaatggagactacaactttacaggctttctggcttgtggttagttactttttaagactttctttcctctagtccaagtgttcaccatatagtcagtaattgattcatttttattttcaactctaatttgtatctttctctgcttattccagcactagtttcttctggcactccatgcctggatgagtccagtaggcaagttatcaaaacttccaatttataagtctatctgctttaatctaagatgccatgtattattggtataatgtgttttcaattttcattagtgcttctactttcctttgaaactttcactgtactttagttcgtatcttaaaaagcactgattttggagcaggagactcaggttcaactcctgacaacaggactgatccgttgtgtgaccttggaaatgtagcagcaggaggatggggcattatttcacttcaataatatgaatgaccaactgtgtaaagttacactcaaaagtctatctatttaatattcaattgaaaataatatcttattattataaggacatctaaaatcattaaagaaatactgggaataaagaaaaatccaccaaattccgcagtacaaagagatcctatttcaatcttctagtcttatttctattaatataaataggtatttttcaattatagatttgagtttacagtgaacattcacttttgtatttagctttttaaacttaatataccataaacatttattcatttcatttaatattcttactatccatgtgttttttggctgtcaatattctatgatagatcttcagattgttttcagttttgcatcgtcaagaacatgaacctttgtatacattaatatttgcatttctgaccatttccttatgacaccttagaagttacccaggcaaaagtgtaaatatttttagcctcataacacttactgccaaattgcttcccccaaaatgtaagcacagatttattctctaccagtggttgtaccagtttggccatactctcattaacacttgatattatttttaaaaattgggatcattttgatagtacaaattgtgtatctagttattcttctgagttattgttcctatgattttggatgagttcaaaaatgttatatttataggttctttgtattttttaatttgtgaatttcatttgactctttattggagtgttcatattttcttcatgtaataggaaatctgaggtatactgcaaaaattgtctgcatcttgttctttgcattttaaaaaatgctttctaacacacagaaatgtatagctttactgtagtttataaatctatttgcagtagtgtctctttgtagctttcaggttcagaaaactttctaccacttaacggagaattgaatataaaaacaacatgtgacggtgctattgctgaacttctttcctcctttgaagcagaatctggcttatgtatatcatatgtatatcccagtgcgaaatggctctggggacacataaaatccactcagtctattaagatcctattattctttaggcagctctcccatgaagtgaatagtaccttaattctttctgagctactattgtccattttaaaagagccacagggcagaatgcactatggaagatattaatggccaggttactcagccagagcagggcacattgtttgcacaattatctgaatgactcaggcactaaatctgcttctgccaggattatccagatggtccttaactcagtagataatttttcactcctgtacttgattttgatggtgtagacctgagcatgtcaccacttttcctgcactgtcttgttactactcaatttgcttagggctggttgctttagtttcttttatgagaggcaggtttgcccggttctccagagcataggtgttaagagttatgcagagctttgcatgaaacctagctcagtcagttactagcagcgtgctttgaggccagccacttaattttttttttttttttttttttttttttacggagtctcgctctgtcgcccaggctggagtgcagtggcgtgatctcagctcactgcaagctccgcctcctgggttcacattattttcctgcctcagcctcccgagtagctgggactacaggtgcccatcactacgcccagttaatttttttgtatttttagtagagatggggtttcaccgtgttagcgaggatggtcttgatctcctgaccttgtgatccgcccgcctcggcctcccaaagtgctgagattacaggcgtgagccaccatgaccggccatgagaccagccacttaaatttttttacaacattgttttctgtgtaagaaacatattcagagtttgaagtccctatttcattctcctccctcatagtcgccttcttctaagtacattctatatgtcataaccacagttgtctttctaaaaccaatttcatcgtattcttcctctgctgaaaattttttgagttagttcccctttttttgtattagtaagatgtctgaagtcttttgcattgcacctaaagtcctttattaaatggtacgtggtaacttctctagattcattttctgattaatcaaatttcttccatctccaatctcccgtaatgtcaatcaactgaacggtttgccttctcctaatgcatcttgtttcctcttttctcgcaacaccctcccatgttccccatgttctattctctactataaataacctgttttcttgtctgctttttaactgacctaaccttttcatgccttgggtcaggtgccaccatttcttggaggacttcccctgaattcccagtcttaaattttgactccctgtggatatccctgccgtgtcacttaccatactatattgtactgattggttacttgtctcttgcctccaccgtaagtccttgaggatagacaccatatgttatttttctttgtgtctgatagaggacctgacatagagttgatacttaataaatattttctgaagaaatgaataaaagaaggttaagactaaattagtttttaggatttcaacaaatgaaggattcatatctttaccctggaaaccaatcaataaaagctaaaaattatgtcaatcttcacaatatttcaaaaattaacttcctggttttgttgatttatacagagtaaataaaagagagtttttttttaatgaggaattttgtaatgaaaagcatgcctaggacagccaataattccaaattgctaaatcagtcaataaatatcttttaaataattctgcattttaaaaggaaagaggaatgcatagttacatggataatgtcgatgtataaatttagctgtgttggaattaaataatggcaaagttaatttcacttttctttatttaataaaaggtcttccattggtgtcatctttggtagattacaaagcatggtcacatgcatagccttatttgatccttcgtaacagttttgaaagttagattcaaaggcatggttatccacatttacagataaaaaaaaaaagctcagagaagtaactaatttgcccaaggttacacgttagtggcaaatctggacaagtaagatgatcttgctcatagttgagtgtcccatgtgttatggttggcccagaacatttcactgagagatgactgccatgattttgtctaggttaaggacaacaatcttgataataataatcccctgaaagtcctgagcaatctagtaaaaatgtattgcattattacctatatagggtttttacttagatttttagtaatctgagaagaaaccagctgacagaactttttgctttaaacatattttaaagtcttatatttagttacttgatcatttagaacacacacacatacacacacacaccatattaccctttcttttgtttgttttgaagtatttgccttttatattaggtgacaagtacaatgctctttcccttactttttttttaaaacttgaattattaaaatatttttttcagccaggcatggtggctcacgcctgtaatcccagcactttgggaggacgaggcgggcagatcatgaggtcaggagtttgagaccagcctggccaacatggtgaaaccccatctctattaaaaatacaaaaattagctgggcatggtggcacatgcctataatcccagctactcaggaggctgagggaggagaatcatttgaacccgggaggcagaggttgcagggagctgagatcatgccattgcactccagcctgggtgacagggtgagactctgtctcaaaataaaaaaaaaaataaaaaataaactggattttctttgtttagtagacaatgttcaactttagtcttcaggttttggcttagcatatattctgtgtaatcttggagaaccagataggtcaaatgcattttttaggaaatagcacaagtgatgaaaaagaaatttatgaaaaacagatgggtacttagtaagaatggcaatctatcctagtttgaaaattacaaacaccgagatataagattgatttttaaaaattgacttgtgcaaacatcttctctataattgcacctcaattactaacaatcacttattgagcactcactctgtgttgggcatttaaaaaaaaatgtgttgcacatgaccatctcaaaactttacaaaaccagtgaaaaggatttttaaagtttattattccgattttgcagatcagggaagttagttattaaaaagttaatgcatggagaggctagaattcacacccagattgtctgactctgaagtccaagtttttaattgctgtgttattcagcaccaacccccagtgctcatgatagctggttttagtactttgtgagtcacggtttaaaatgctgctattctaagtgaccggaatctatccctagaccctcaaataaatttagtattaatacaaggaattaaatcattctaaatttgcatatgttttatttatgaatatcttattgatatctttcactacagtaatttacatggtgcagtttcccaagcatgaattggaccattacaatgtgtcatttaaatatgcctctaataggccaatcatttgaattttgacacaagcaccagaagtttttatgcatttctgccctaattttgctttctaacatctcaaaccataaacagtaattctctcctaaggcttctaatctgatagtatttaattgtcatggttactaaaagtacagatttgttaactgtaacagacaagatgaatattataaataatatttataatattctagcttgaaaagctgtttactgtaatagaattttatctcagataaaactttcctttgtagagtatttttatacattaaatgtggtgtaatataatttaaaatatttgtaaatgcctaatggattgactttatttttcttttggtctacttatattattttggagagcataacaactttcagattgcttgaaaattaacctggtttctcaaaaaatgttattttctaattttggtttctgcacaagttgagtggtaatgaacctaagacatcaactttaagtaaaacactgtattattacattctttccttttccctttttcattaaagaatggcagacatacagaaaacatttggcccaatgagctataacaaagtattcatactatgaaatcaacactcatttcagaagaaagaatcttgtcagcacccaggtaccccgcttccagccccacttaatcactatcgccttactgttctccaaagatagcttctgactaataagactgtagaatagttttgtctgtttttagaatctacataaacggaatcatgaagtatgcatttttgtatcggattttttttttttttccctagagacagggtcttgctctgttgcccagcctgttctcggactcctggtctcaaacgatcctccctgctcagcctcccagagtactgggattacaggcatgagccatcatgcctggcccagattccttttgttcaaaattttttgtgagctgtgtcaatattcttgcatgtagcaataatttattttcattgtactgtagaattctattgaatgaatgcccccaaaatatacatatttattctattgttgaatacttgggttgtttccagttttgtgttattactgatagttctcctatgcatgttttcaaatttattagacattctttttcttttttctctttgagacagcgtttcgctcttgttgcccaggctggagtgcaatggtgcgatctcggctccccgcaacctctgcctcccaggttcaagtgattatcctgcctcagcctcccaagtagctgagattacaggagcctgccaccatgctccgctaattttttgtatttttaatagaggccatgttggccaggctggtcgtgaactcctgacctcaggtgattcacccacttcagcctcccaaagtgctggaattgcaggcatgagacactgtgcctggcccagaattgaattatgctatatacggtgttctgccacttccttttatcttggacaactttttctttccacatagtatagtgccaacacattcttttcagcacttgcatagtaaccctttgcataaaacacaatttatttgtctcattgttggaactttgggtaatgtttccaatgttttttaaaaaagaatgctacagaaacattattctacgtgtagttttgtatattcctgggaatatttttctaagatatttccagaatgaaattgctagccaagaggtatatatatattttttacagattattgatatttccaagttgccctataaattatatagtataaattactatggtaatttataatcttagaaacatgaataagaatgtctgcttttgcatattctccctagtactattatcagtctttcaaatatgtttggattttgtatttccaaataaaattattactgaaaaaataatataaatgaagcatagctgtgtgctaaagagatcataaaacataacatttggtatttccctatagactaaattttgctattttatataaaaatatttcagttatttttggatttgtaaaaacatttcagttaatttaagtggatcctaagttaaactcccctgctttcatcgttatttttagtattacagcttttcaatggataaagatttaaatctatattctggcacgtagtagatacgtaattttggaaaatttactcagttcctcttactttgtgtgccttcattttccgaagtcatgaaaatagatatggaagttaagtttgctatatcgctctcatctgattgttttccaggtttgatttagggaattaggctacttaggcaggtgcctgtttctcactgacctatttatgaccctctcaaagctgcttgttcttcagtgagaagagtttctagacatgtaaaggggcctgtttcctatgaataatctacaaagtagtctcttctgctagttagaaatggaaagaagtgacgtgaataatatttccttctttccttcatttatattgttggtgagaggagggagagagagagaacagaaatgcagatctaccatgtggtagacgttgcattggggctagagatacagtaatgattaagtgagactttctcttgccttcaagagtcttctaaactaagtgtgtaaaatagataaaaaggtagttcaaaactgcaaatgggtgccaacatgctaggggaattgttctatgcagaggacaaataaagacctggaggcaaagaacagcatgactggttcaaataacaaaaagaaataaagaaatatggtatagtataaattatacagtagcaagacaaatggctgaagagcagaaaaagaaagtttctttaaagtgttgaagtatgtgtcttattctcggagcaatggtttaaagaaaggcagtgatttaatcagatttcataattattttttaggatttaacaaagtaaaagacactagctatgaaagggctgtaatttcaaaaatgttaaaataagtctagatttgaaacagcatatctagatcattcttgataagaaaagaaattttgaaaaattggcaggcctatactctccaaattatcttttaataagatctagtagtaattttattattgacttcatcttgctgttaggtatcttatgaaaactccctttgagtagttaagaaaagataattaaacatagagtcatattttttcatcttcatctttttcacagcttctttgatttcacagcttctttcttgattttggctaagacacatatattttaaaagccataaaaattcacggatgtcctagacttaggattttatccctagctatggcttagaatactaccttgcttatttttataaacacgtatggtttcctgtttgtatacaatcatatctgttatgggggtataagaaatagtcatttacaatatgactaaatcactaaggaaaagatgtacagtaaaacttggattttggagatattttaaactgatggtttctataaaatgctattccctggaacttctcatgcctcacatcaccaggctgagaatttttttgtcttatttatttttacaatggtaaagtgattagttgtaaagaggaaaaattgccattgctactgacctaaatgattgttagtcatactgaaatgtgctcagagaatcattgctcaacatgtgaaaagcttatccttgcaataaaaatccctctattttctgatactctgataacattatatattgagaagtcacaaagatttactgatatatagcaagtgtaatttcttctttgtttcctctttactttctgtctctttttagtgccttcattgttcagggaagtgtcatgccaaggtatattgacaatactggtcctttttgagcatccaaaaacagtggtatttctcgaagctaatgattgcctattatttgtttcattagggaattaaaatttgtcagccttttctccaggattttgtttcatccagagaatattttccttcccaattgcttgcagttgacaccactatttgaatcctgatgaattatttctgcttcatgtttgccatagaccttctgctcagcttgcgtatgcttatatactttacttatcataaacttccttgtgtttgagatggggtaagcgttgttgatgatgggtagtaatagagaattattccatctacatcagatcacagttttttttttcaatgtttaataataggttttagaattctgggcaaaagtaacatctcttttttttttattatactttaagttttagggtacatgtgcacattgtgcaggttagttacatatgtatacatgtgacatgctggtgcgctgcacccactaactcgtcatctagcattaggtatatctcccatgttgtgttagtccattcctgcattgctataacaaaatacctgagactgggtaatttataaagaaaagaggtttaattgacccacggttctgcaggctgtacaggaagcataatgcaggcattgcttctgaggagacctcaggtagcttctaatcatggtggaaggtaaagagggagcaggtatctcacatggcaggagcaggatcaagagagagtggcggggaggtgctgcatgctttaacaaccagatcggtcaaaagaactcactcactgtcttgagacagcagcaaggtgttggtgctaaaccattcatgagaaatctaccccaggatccaatcatctcccaccaggccacacctccaacattgggtattaagatttgacatgagatttgggtggcaacagagatccaaactatatcatttgatgctttatatatatatatatagatatatagatatttttattatactttaagttctagggtacatgtgcacaatgtgcaggtttgttacatatgtatacatgtgccatgttggtgtgctgcacccattaactcgtcatttacattaggtatatctcctaatgctttccctcccccctcccctgatgctttaaccagagagaaatctttgcctgtgtcttcactgtatatctggtaaacatctgctcatttctcaaggttcctccatgccatttttcaggaaggttctcctggcctgacttctcccaggcagatcgacacctccctcctacgttcctagtgtatcttgtataaacttctcacatagcctctttaacacttcattatccatacttatgtccatgtctccctttctttactagattgtaagagtggagaatatgtcttttcaatttttattttgaatcttcaatgcctagaacactgcctcaaacttataggacccctcaaaacacagtaatgttttggatgtttttaagtaaacaaagagaatattttagaaatgttcttttgtaataatatttcatattctgaaaatcccagaggaaggttgtctatttattagcagatgcccacactacttcttccatattggtagatatgatcatgataatatatgtgctgtataactgatacattataaggcactggctgttctcaatatttacagttcataagaattacctgagattgttaaaaaggaggaatcctgactctcatccctacagactccggcttagtagatctgatatgggacccaggaatctgcatttctaacagtgtctctgttgcttctaagagcacattccagaaacaaaaattttgatcaacctagatggagttaatgcttgtgcttcaacaaaacatacatataaagacgtgcgcgcgcgcgcttgcgcacacacacacacacacacacacacacacacacacacacacacccctgctcagattaagactatagaattgcttttaaatacctcaaggatcaccacaatgccagagccatcaccattacttctttctcttactctgttcattgcttttctccttttcctctttcatttcttttctttttctttttttttttttttttttttttttttttttttttttttgagacggagtctcgctccatcgcccaggctggagtgcagtggtgcaatctcagctcactacaagctccgcctcctgggttcgcgccattctcctgcctcagcctcccgagtagctgggactacaggcgcctgccaccacacccggctaattgttttttgtattttttagtagagacggggtttcactgtgttagccaggatggtctcgatctcctgacctcatgatctgcccgcctcggcctcccaaagggctgggattacaggcttcctctttcatttctattatctttcttcttttctaacaaaggatggctctttacaaacattgctagccaatctgagcatccctttcctttcatgttaaatactaatttatttcagtgcacaaaatgttctaatctactgtgcttgtccagatattttttttgatgactgataatgagtgactgatttgtctctaaaggaagtgtttcattgtgagatgaagaggaaaatatgaggaataaaaaatactttgaagtcttcagtttcttgggtggccattggaaagatggtttctatattgctaattttaaagtaagatatttttagtcaaccaaattctcaatgtggctgcaaaatgaagcataatttatgtacaaactaagagcaaaggccacttgctgtaatttttacataactgttatcaaaaattgatgcattattttataatattaactcttccaatgactttttagtcctagatacttttctcaaatagaaattatattatgatccagaattttgaatataatttgaagttacattttcttccatttgttaaattttacattaaagagaacttatggtatattactcatactatgctttcattttggaagtcaaaattgtaccactaagactctctattaacatttcttaattaactattgggtttctggcaagctatgagcataccttgtagcttttgtgggtttagttccagaccactgcaataaagccagtatttcaataaagagagtcacacacattttttgatatttcaatgcttataaaagtgatgtttacactgtactgtagtctattaagtgtgcaatagcattatgtctaagaaaatgtacactccttaattaaaaaatactttgttacgaaaaatgctactaattgtctgagccttcagccagccataatctctttttgctgggagagggtcttgcctagatgctgatttctgaagactgatttagggtggtggttgccaaaggttggggtggctgtggcaatttctaaaaagatgacactgaggtttgtgagatcagttgactcatctgtagcatgcaattctgttttatagccttttacccacagtagaacttctttcaaaattggaattgatctctcaaatcttgctactgctttattcactgaatttatgtagtattctgagtccttacttgccatttcaacaatgttcacagcatcttcaagaggaggagattctatctcaagaaccactttcatccataagaagcaactcctcttctgtaacagttttatcatgagattatagcaattcagtcaaatattcgagctccacttctaattctatttttcttgctatttctaccacttttgcatttattttctccactgaaatattgaactcctcaaattcaacttcttccaaactcctgttaatactgatacttcgatttgacttcctcccaaatgtactcaatgacatctaaaatagtaaattcttttcaaaagatttttaactgattttttcccagatccatcagaggaattagtatctatgcagctaaaatcttatgaaaggtatttcctaaataaaaaaaacttgaaagtcagaattactccttgattcatggctgcagaatggatgttatgttagcagtcatgaaaataacagcagtctcttcatacatctcccccagtgctcttgggtgaccaggtgcattgtcaatgagcagtaatattttgaaaagattgttttttttctgagcagtcggtctcaacagtgggcttaaaatatttagtaaaccatgctgtaaacagatatgctacatccagactttgttgttctatttacagagcacaggcagagtagagttagcgtaattcttaagtgccctagaattttcagaatgctaaatgagtattggcttcagattaaagtcagaagctacattagctactaacaagaaagtcaacctgtcttgaaattttgaacccaggtgttgacttctcctttttagctctgaaagtcctagatggcatctttttccagtataaggctgtttcgtttacgttgaaattatgttgtttagtgtagccaccttcatcagtgagcttagctagatcttctgaataacttgttgcagcttttacatcaccacatcctgcttcacttcacatttttatgttatggagatgacttctttccttaaacctcatgaaccaacctctgctagcttccagctcttcttttagcattcatacaatggaagagagtcagggccttgctctggcttaggctttggcttaagggaatgttgtggctggtttgacttctatcaaggctactcaaactttctccattatcagcaataagtctgattgtctttcttatttgtgtgtacactaaagtagtactgttacattttttcaagaatttttcctttatattcacaacttagctatttcgccaggagccccaggttttttcttagctttccacatagcttccttactaatcttaataatttttagcttttgatttaaagtgagagatgtgggactcttcctttcaattgaacacttggaggccattttatttgacttttttcccagaaccatcagaggaatcactatggcagctaaaatcttatgaaatcttatgaatcttagaggccattgtagggttatctgaactaatttcaatattgttgtctcaaggaatgggaaggcctgaggagagggagaaagatggaggaattagcccttggtggagcagtcagaacacctattgattaagtatcaattaaatcttacgtaggtgcagttcatggcaccccaaaacaattacaatagtaaaatcaaagatcgccaatcacagatcaccataacacatataataataatgaaaaagtttgaaatattgtgagaattaccaaacgatgacacagagataagaagtgagctcatgctgttggaaaaatgatgccagtagacttacttgacacacggttgccacaaaacttcaatttgtaaacaaatgtaatgtctgtgaagtgcaataaagtgaagtccaataaaatgaggtatagctgtactgataaatttccactgaatatggaaatctaatatctgatctaaggtggtagatatgaatatagtgactggtattcatttaagatattttttgagtacagacttgtaaaacaatgttacaactgtttttacaaatattatttattcatattgtcctctatttctaaaaagaatactgcaaaaccaaggaatttcttatgggttcttgcaaatatacaggtagagacaatcttgctgttctcaacaattattttatctttttagatttcatagtgtaactcacacataagctagttatttctacttttgaattttaaattcagcctttttccacatgctttggaacctcttctagaagaagacactaatacttatattgctaaaaatatcactctgaggtgtaatatcttagttaaattcggcttcacctcagcatcactatttctacagctatcctttaaacctgtcagagagaggaatctcttctctttcatatttctaatccctctactggtgctgtggatctcaactttccacaacatgaagggaaattttctcttgtgctcagaagtttctactccagaaatttcagtctttccctgtcaattctagaattctcctgccttcaaacttttgggttatgtttctctactaacttttctagctatgtttttctttcatttttctcttcccttttcagaattactggtctgtagtttcaaaatctcttccacccaatttattgtagagaaaaagtaaagccaattttggtcaagtcttctttctcctcttgggttctgggttatatcccttcacatttttagggacctcactgtattcattatcacttcttccttgtatcctaaaccttaccctctctattgacttcctgatgtcaggatttatgcttggctaactctctttatcttaaaaacaatgcagaagaaattaaacaaacgaaaactctccttaaacttttgcacccccaactaatgaccacagtcatttctccttcttctcttttgtagccaaatttctttctttctttgtttcttctcctcctcctcctcctcctcttcctactcttccaccttttcttctttttttaagagacaggatcttgctctgtcttccatgctggagtgcagtggtataattaatagctcaccataacctcaaactcctgagctcaagtgatcctcccatctcagcttcccaagtagctggcactacaggcacttgccattatggctagcctgttatttttctttgtagagaagaggtcttgctatgtttgctatgttttccaagctgttctctaactcctggcctgaagtgattgtcttgtctcagtttcccaaagtgttggtattacaggagtgagccaatgtgcccagccccaaatttctttaaacattcatctatgcttacttcacggttctttgccttgaattcactctatacctctgaaatctgctttttattattttattaaagctgcactttactaggtcactaaaatatccttatttcataaattctatgaatacttttcagatgttatcttactagacctttcatcactaattaacactgttcaatttttcttcttggaaaaaacttttgatagtttggatttgtttttcagcaaattttcatttatcttctattcctactgtgatagagcatactgccatgtcagttgatgttgtgctaggccatatgattttctgtgaccaatgtaatagtagtggataggaactaagtagaggtttcaaatgtgtatctgctattttattttattttattttatttttttacttaaagactagtgtgatagtaatgcttggttcttatactctgtcatctgccttgagaagcacatatgctaggaacctgctgatccaaggtggatgtggagagatctgagcagagttgaactcaatacaaagcttagagcaagcccaaccaaccccatagcctaacgtgtaactggcccagtcaaactgtggacctatgagcaagaaaaaaataaatgcctgttgtaatttgggaatgtttattttgcagcattatcagacaatagctgattgatataactcaattcctagaaatttaataaaaccatcttctggatttttcttttaaatttcaggaaccattgtaatatgctatcgtttggatgtttgttccccaaaacctcattttgaaatttaattcccaatgttggtggtgtagcctaatggaaaatattagggtcatcagggaggatccctcatgaacggcttgctgtcatcctgcaggtaatcgggggatgtgagttatttcttaattcccatgagagctggttgttaaaaaaaagtctggcacttcccttagcactcttgcttgtattgctataaaggaataccagaggctgtgtaatgtataaagaaaagaggtttatttggctcatggttctgcaaactgtgcaagaaaaacaccactagcttctgctcctgctcaggacattatttttgcattcatttcaaaaccaagtacattccattaaaaagtttttaaatgaactgagccttttattttgaatcctatatcatggcttttttttttttactgctttctcaaaaatataattgaagtgatttatgtcatctagaggagtattttttctccctcaagtcatggattgatatagttcatgggaatagttacagggatttattgagcagaaatttaaataaacttgatgttggacaaaatcaatactgtcatactgaggagcattttatcatggttgttatcatacttgtttatattatactaaataaagtatatatatatatatttaaatgcagaataaacttactcagtgatttctgtttctttatgctaataacctattgattatttggaatattatcatgggttgatttttctatttatatagaatgacataacacatataaatgccccccacacaccataaaaaacatttgactaatgaaagtgctagagaagttggctgtagatgtaatatttttaaggtcctatcatgttaaaaatatgccataaggcataggaaaagaaagtcagtatttagggagaatgaaggaactctatatgttcccaatacaataaacaaaaaagtaaatgaaatgtccaatccaaaacccctgtgcattattactatgagaaccactgaaaaatagagtcatatgtcttttccacatttagtgctttggtcaaatctattgtttaatgacagaatcatacctttttcccctgtattatgaaattacgctcttctctatttctcactgctaagaggaacaggattaggtcaagtgacctccctggtgggtaactgggattctgccgatcactggaaagatcttattttattctttgactatctatgtggtgtgagatgggaatgattaccagctgttttattttttgtttgtgttattcagaaaatagcattctctacttaaagaacttacaattggaatttgacttagcatcttgtctgtttgaaaattcttcacagatagacacatattaaagatttttggattttcaaaaagcagattttcactttaaacattaataaactcaagaaagtcaagcagtttgggcacttcatgaagaaaagtggaacagtatgtgtgtttctggaatcaatgggttgctggatagtaactgtaaatcttacacaaatgatcccatattactgaataatagcaccttcccccatctctccaacataggcatgattaaaatgttgattatttgtgaagttacgttatccatctttattggaaaatgaaaagatacagtagcatgtctaatcctttattatcaagatgctcttatgttttatatcttcacagaaatagaggttgagatcaatattatatattatttgctttaagaagtgacatgttgaatcagctttcctgcaggctttcatttattcagccttgaactgattaccttgtaagatgtcagggttgtcaaaaatgctatttaacatgaattttttttatagaaatgaagcaactaaaatgcaagattatatttcagtgagctaaaagtgactatatcatatgaatattctgcagcttctgaaactttgggattttgtactatccagttcccgagggattcttactgcctcaggacctgctgaaacaaaatatgcctttgatatttaactctatgctctgtatgtgatccactcaaaaatagactgaaagtcttttgtttcttaaaaaagaggtaaatattgactttagacaagaacttcaagtcctcatggtcattctgcagtggattgaaaaattctctgtgaaagaaaactattttgtaagcatttttgtagaaaaattaaaaaatggatgtagaaagacatgcgataagaaaatctaataccatggattaagaactgaatttcgtttgttttagatttcctctaagcccatgattgttaagcataaatgtacattgaatatcactggaattgcttgttaaaacagattccttgaccccgctatcgaaaagtctaattcattaggtctggagtggggcctgataatttgcattttaacaagctctcaggtgatggtggtactgcttttttgagagcctcctttgggtaccactgccctaagtagtaactttagtgccaacacttctctgttaactggtaactcttatctcagaaaatgataatgatgccaagagtattaatgggagaaaagaacaaaacagattcgtttatgcataggatagccgcattagcaggattttttttgccttcatttaacattactaattttttttattaattggtgcaaaagtaaccgcatgaacttttgcatgaacttgatattaaaaaacaactaaatagtcttccagggcttgatttgattccccttgtgttggagaaaatattgacattcctgttgcttttaagcaataaatctgttagggtctcaagtttttattacaatcaagcctttgggagagccagtggaacagatctgaagctttttcattaactgatttcaaatctcttataatttagcagtcagaggagttgatgtaatttgccatcacaaatcactagtaaatgcacccttgagattaagaatcaaattccacagatatctgtaatattttaaaagtcaggatggtagagtgactcacaacctagttgaatgttaaaatcacctgggtaactttaacaatactgatctgatgcctggacaccaccattcagacattcagagttagttagtttgggcttgcatcttgacatagggagatggatagaggataatagttaaggagggagaggtgcagatatgaagacaactaccatttcttgagacctactttctttatgtcaggcactacagagggcattctaaaaatactatctctaagcctcacataaactcaaaaggtaactttaaaaaaaatctaaggaaagaagcttgaaaaaaaggataaacttttccatggcaagagattgttaagtaatgagggactggccccagcatccttgcaagggtactagatgcttccattccttctctctctctctgtgtctctctctctccttttcttcttcccttccttccctccctcctcctttccttcctctctctccctttcttcctcctctctcctttccctcccttcctttcctccttccccttcctcctcttctcctcctcccttttcttctttcttcttcctcttttttctcctccttctccttctcctcctttattcttccacaaatctaaataccttgggacaagagacaacctctaacaaatgttgaaagtcccatgtaaggaggaatgtatccttcaaaatatacacttgataaagctttgcctacaccacctgggtgttggacatgggcaattacaaatgtatctagagactgagacactagctgcatttccaagtatatctgaaactcattggcttagccttcaatgaaaagggcattggaagatacatagatagtttagattgagaatttggcaacaattattactgtaattgtagttgaaaaccatctgtgatctcattacgtagttacagggacaagatgagggtaaacctctgatactaagaataaatgaaccatatcagagagaacaccagaaattctttcttctctgatgttaaggaacccatgtagaaatcagtctacttaaaaacagataaatataacctgctcccatgtatattaacaacactttaaagctaacaattacaaagctcttttagatgtgttttataatcttatttaatcttcacaacatctttttagagcaatggggaaagagaaaataatggtttatatattaatagatgtgtacaaagtcttttgtacatatttttatgtaaccctcacagctagccaaaagtgttattttttttctgttttataagaaaggctcagaaaagtgaaataacttgcacatagtcattgattcagtaactactggagactgagatcaaaacctgaacccagtacaagcaaaaagttgactaaaattactactctcactctctttaacagtcatttgtattaagctgaaacacagttgaacctctgtatagaagctgttgttttacctaaatgtatatataaataagaaaatcaatacaggacattcattaacctaaaattataaataataaatccattaaactcaactaaaatgaacactgagctacttttcacataaagggctttgaagaatgtcatagggtatagttattatattcttgatatgcattggatttccgacctaaaaatttttttcttcctttcagttccaaagtacattcttatttaaacttcagctacccatccaaattggtatttaaaataagtgaatttgtgctcattcacctggtgtcaatatttgtaaatataaaatcattttcagatgaacttcatttattttatttcaagtcagtttcttgaaggagccttatgacatcatgaggaaagtcatttcacagttttatgtagaaatatagttttgtttttctagcattggttaagttgaagctttagaattgcgggcaccactggataaaattgctcctgtaaacatgggacacctggtggattacttcagcaaaatagggccttgttgaaaagtaattgtgcccatgaattctcacaaaactaggttcatcatctttaggtctatattaatcagctttagtgagctttgaagttactaagaaaatgagacttttttgtaaataggttatatattttgtctttaaagaagaaagattctaaattttaattgaatgacttaaaagtagattaagttttaattttttctcagtgttttatttatgttttcacatggaattgggtctatttagtttcttttatctcatctgacggatatctctttcttaaagtaatgtgcattctcatttgaaaccaagaacatgctgaataattgtaaggatatttcctgaggttcatgaaaggttttttgttttgttttgttttgagacagaatcttgctctgtcgccaggctggagtgcaatggcgcaattttggctcactgcaacctccacctcccaggttcaagcgattctcctgcctcagcctcctgagtagctgggactacaggcacgtgctaccatgcccggctaatttttttttttcttttttgtattttactagagatggggtttcgccgtgttggccaggatggtctcgatctcctgacctcataatccgcccgcctgggcctcccaaagtgctgggattacaggcgtgagccatcattcccagtgtttttcagtgccttctccgataaggaacccgagaggcttccagtcaacactgggggctgggttcagtgaattcagtcatgctggtagagcccactatttttgtcctagtgggcaaaaaaggaagcctctaggggcaatgactaaagtgttctaaaacccatcatgttgcagcagtacaactaaatagagtcctcacatggcactgtgaggtagactactatcccctatttaaagatgaagaaactgaggtcaagtgaggttacaagtttagagtcaataagtgatagggctgggattctgagtcacatctgatggacgtcacacctgcccttcaaaactttctctcaccctactgttatctttatttgaaaaggcctttgtgtgcatttctgggccctggctattcatatgatgaatatctgggatttttttttttcccattagagaacattttccaaagatgcccttagaaggatggtttcatcacattttctttcccctcaccttggatgtttggaggggttgatttttttttaacagaggctatttgagatcagcattatttggttacctgcatgttattacggttcaaaactttttaaacactgaacaactgaagttaatcatttacttatttgtcccttgaacaagtgttgcccattcagttagaaataatgtgctcaatatggaaaaattaacagttgctgagtcatcaaaggaaataatgcaatttatggatattctttttttataatattagagtttgctaaataaatcagtaatatatgaacacaatgggaagatgaattaatagttactttgatttaagattgaggataattgtattttcggagtatggtatttatggaggctttatatataggcctaatcatttagacatcataaacttctttaagctcaaaaattgctgtataatttctaagctttttataagcaaattctaattagttgtccttcttaacctgatgatcgatcgggcttataaaagagttactaaatgtcacaactgaaagaaaagaagcagtagcttttatgaaaaaagagaatctatctttgaatcaagactgaaaccttaactatattccatgtgtaattgtgaaacttaaattatcttatcgtgctttgagatcaataagatatatcatccttatttgcttagtatattcttgcatggttcaaatgaaatacataacatgcttgctacataactgtagatcttagacaacgaagcaaatatttattatttaccatgtgtcagtaccatgcaaagttaaaagagtagagtttgttaaaagatttatcttggtccgaatagttcgacattcatcaatgtggctttctgtttttttttcttttgagacggagtctcgctctattgcccaggctggagtgcagtggcgcgatcacggctcactgcaagctccgcctcctgggttcaagcaattctcctgtctcagccttctaagtagctgggattacaggcgcatgcaccacgcccggttaatttttttttttttttttttttgtatttttagtagagatggggttttaccatgttggtcagcctggtcttgaactcctgacctcgtgctctgcctgccttggcctcccaaagtgctgggattacaggcatgagccaccgcgccaagcctaatgtggctttcttagacttgtctactcatgactagtctaagaattagactatttgtttttattttcacctatatttatctctaaaatatgttagaatcaaaagagtaagttttgaaaaacatatttattggtactaatttggtctcttcggttctagtttttttcattgacttttaaagacttaattaagagtatgcttatttcattgttaaatactatagctagatcacaggataagtaacactcatctcaaaggggtgtgtgtgtgtgtgtgtatgtgtacacacacacgagtcatgcagtacaaccagtgaattaaggcacagagtcaaataccatttcgtttatgtgactgtttgttttgtgtttttgagaagtgaattgtatttgaaatgcaaagacaatacagtagatggataattgaatgatattttaaatctccttgaaagtttaataatcataacaattttttgtgtaattaaaatatattgtcaggccaggcgcggtggctcatgtctgtaatcccagtactttgggaagctaaggcgagtggatcacgaggtcaggagatcaagaccatcctggccaacatggtgaaaccctgtctctactaaaaatacaaaaatattagctgggcgtggcagtgcatgcctgtaatcctagctactcgggaggctgaggcaggggaatccctcgaaccagggagttggaggttgcagtgagctgagatcgcaccactgcactccagcctatttgtaacagaggaagactctgtctcaaaaaaacaaaaaaagagaaatatatatatatatgtgtatatatgttataacatatatacacatatatttatacatatatgtagtcagattgtttaaactgaaatccagctatgaatgtgtaaaatataaagtgaaatatgttttttctcatttaagaaaacaaatgcattagttgaatctctctctcctctttcggaatcccaggcatcacacttatctagacatctcacttatcagaattatgtttcacacagtgatacttacataaaggatataatgcattccatctccgtcctctttcatagcaatctcatgtgccagtttgtcatgtttcttatcacattctctgccccaaaatggcaaagtagctacatggatgatgactataaaaataggcaggaccacctccttttttttatattgaacctttttttctaggttttaaggttctttatgtcatataaaggtctctaaaaacatcaacttattttccctgccaaagagaaatgccaaagaaaaatttgactttgattctcaatctcaaaacttaatatattcatttttataatttatcatgaaggatgctgtctgctgaattgggacatcttacattaattattattattattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctatgtctatgtgttttcattgttcaattcccatctatgagtgagaacatgcagtgtttggttttttgtccttgcgatagtttactgagaatgacgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttggtttgagccgtggggaacaacaggcttctctccatcagctaacaaacaccttgtaggggagctaagcagggacaaaagaagtacaggtccacatttccttccttataatatggaaattcaaactaaacatgcagtgtctgtggctcatttggtgacaaaaatttgatcttgacctgaactcacttgttaggataacctgttctgaactggtttaaggcaatttgtatcttatctattccacttggtgtgaatattcacaatattcagtttttgctgaagaaatatggatgtctttgattatatgttgttattccaaacatgtatatacacacatatacacaagtttctaaaaattataaaaaatacctaggtccaaaacatatctggccctatgagctttggaaaagtggttgtaaggtctctattagatattgtccatgtcttcaagccacttgtagtttattgagattcgtgacagtaaactccactctcaaacagagagtcaaaatagttattgaaagtctaacagttggccgatatatacatatacatacatacgtacacacacatgcacgcacacactatccatgttttatatatattatatatagtatggattttgtggtacaggagaaaagtagtgttaatgtagaataagtctagtaatgtaaaatatttcagagagtaatagaactggttctttctttactaagtgtatttgaatttatttcttaataaaataaagcaaaaccacagccagtaagaaaacctctgcatatatgctgaaggaaaatgtatataaggcagtaaaattttcatgagagccctccaacaaatgcattttttttcctatgtaaaggaaaggtgttttgaagatagagttgtgtaatcagtttagagcaaagaactaaatagaatttattggctttcactctcgccttactagatctgactttaggcaagttacttaaaatctctcagcctgctttattgtctatgaaatattaataataaaagtagccgccatagagagctgttagaggatgacatgggatagtgcatgtactggcgggagcctggcacagaggaggtaggccgacttcgctccttatctggaagctgttccatccaggcctaacagatgatgtttttagactgtggaattccacataattaattcttagctattcaggatcattattttcattgcatattagatttccctttgctgggctaaattgttccataatcttttaagatttcatctctaataactaaagtagttgtctggtgaagaagccaacctcagctgctttacgctttcagttttattaacccgaaagcctccaagatgactctcatgagacttccagattgaaccttcagaatttttccagagagtggaggaaactggaactaagtggaatatggctatataaatgttcatctgagtgatttttgagctttgaaagaatatatactttattatccctgatttgttttttaaagtgttttatgaaacacttgatgtgttattcatggacttagaggtgactgaaacttttatagctgttattcattccaggcatgaagtgatcacaccttttgccctattaggattgtaccacagtaagcaataagttacaaaaacaggggatatatggcaatgggtgatattcacaactagaaactccaacatatttctgctagatatagtgaagtcatactagtttgaaggaactactgatgtgaccaagaatctctgcatgtgtttaaatggtttatctaaaaggtaagtggaagagacggtagcagggcctcattatgactttcatggaccctagacacttctaactgcctgggcctctccttccaatagaaagagaaagagaattataaattataaaggagaagcagagacagagagagttacaaattatattctgccttggtataaagactggattcattattatatattcattattttatatatactattccttgtatgttgaggctggattcattattatatattcattatctttatattttttcatttctaatttaaagacaaattagaacatttttgaacctctaaatgtaacatgtaccctaggcactgtgccttctgtgcctgcctaatgtgtaagtcggtcccggatactaggagaagtttgctaatcctttctcttaaaagccagttatggtcagattctgccatattctgggaacaaagagagggcaccactgcaatccctggatttctacaggagtgtctttcaggcatagagtagaggcttggctcatccaactactgatttcttcaacagagaaaaagaaaactcagcttcaatataggctgatagatcctgtcttgacttccaacacaacttaatttctgtctgccactatcctaggctattggatctcctgactagcaaaataaaaataaaagaacttaaaattatttcattctcctttcatttgtgctagaaatattttgaaatagatacataagttttttggaagaacctatctcaatactcagtattgaaaatgcacagactgtcctccgtgatcatgagcaaacagaagaacacttactttggttcaaaagatagtaatatttaaaataagacagtatagatttatacattgtttactacaacacacgataaaggatttttgaatttattatgctggtatcgaaaataaaccaaggacatgcttttccaattaaggtagaataagaatcatggatgagaaaatactctgaaacaatgagagattgtgtggaatgaaaagcactattgctacatttaaaacctgaaagaaaatagagatcattgatggaattttaccaaatcagccatgtagatgacaagttcaggaaattctcctggaactcagaaaaatataaagagaccaaaattacaaaagacaaatgacatgtgaccaagaaagacttgttccacttaccttgactaaatttgcttcttcctaagtctcaggcccgttacctcccttttctatgggatttaccttagaaaacttgtaattgggccaggtgtggtggctcatgcctgtaatcccagcactttgggaggccaaggccggtggatcacctgaggttgggagttcgagaccagcctgaccaacatggagaaaccctgtctctgctaaagatacaaaattagcagggtgtggtggtgcatgcctgtaattccagctactcaggaggctgaggcaggagaatcacttgaacctgagaggcagaggttgcggtgagccgagatcacaccattgcactccagcctgggcaacaaaagtgaaactctgtctcaaaaaaaaaaaaaaaaaaaaaaggaaagaaaaaaaaagaaaatttgtaatgggaaattttttctctttttctctatccctttgagatgtacataaatcttttcccagcccagcctctagccagttttacaatccaggaatgtctttctcaaggacctgggagccatccctttgaaatataatcattaaggaagatagtgcccctacccctatctcttagtttctataggagagtagaatctaatttcaacaagtgccaattagcaaacacagttgacctaatcacgagtctcaccataacatccttcagtacatgtccaactagctcacctcagctcttaaaatctctctcacttattgttttggtggagttgagtctaatccctttccactattgcaatagtcttgagtaaagtttttctttcctggttaaatttggctggtacaatatttctttgacacaaggaggccagaactctgagattacataggcgtttagtaggcattcaattaaaaaaaaaaacagcaaacaagagaagcaataatttaaaatagtgaggaaaaaaatgtttcatgagttcaaggaagtcttgagtcagcatttgtgtagtaataactgatgagaagacatcaatacacaggtatggtaaaatatctaacatttcaagaaaaataaaacctttgtttaatgactagggagggggaaagaatgtggcaaacagaagaaaataaattttacccactccagaattagaatataactattctttattattgctgatgtggtaaaaagtaacacaaatattaaaatattttaggaaaattaacatgttaaaacaattcagaaactatgttctggtttaaaatagtacatatgaagaaatttgataaaaaggatgtattagttcattctcacactactatgaagaagtaccacacactgggtaatttataaaggaaagaggtttcattgactcacagttctgcatggctggcaagacctcaggaaacttacaatcattgtggaagacaaaggagaagcaggcaccttcttcacagggtggcaggatggactgagtgcaagcaggggaaatgccaggtgcttatacaaccatcagatctcctgagactcactcactatccccagaaaagtgtgggggaaaccaccaccatgatccgattacctccacctgttcccacccttgacacatggggattatagggattacaattggaagtgagatttgggtggggaggcagagccaaaccatgttaagggataattcaacaattcttttctttttatattaataatatcaataaaagatgtgaaatttatttcaagttttaaaaaactctgttggaatagaaatagaatgtttgccttcaaaatcagtagacaaactaataaaggaaaatgaattaaaataagttagccatcacaattttcataatgtatattttctctaaaatacttatgtttaaaattctcatgttttttattagaatttaaacattataataaaattaattatgaaaaatctaaataaaattaaataaaaaattctaatctgatttttaatctaaaaagtcttttattattagaatttaaaaattctaataataaaattatttctttaaaatacttcctcatgttcttttttattataataattaaaaatttctaataataaaaaagaacatgaggaaatatttttaaaatgcgtgatacactataataaatgtgatgattacacttcttcaaggacagtgtcaaaaaaggaaaaacaatacaaaaatcaaagactctaagattggggcaaaaaaaaattccggatatatgctatttacaagagaaaagtttaaaagtttttagtcattatgtttaaaatgacataaagctgtaaataaaatgagaagaatgtcaggcaaatataatagcaaatgaaaagcagaaatactcaacagaattcaaagcaaagaggatacatggaatgtagaggattcgttttataaatggtaagaaaatgtacatcacagattaaaaaaaaaaagaatggtcctgaatgagccagaaaatgtacatgcaaattttaagaacactattataaatacaaggagattcaaatgataaataatataaacatattggatttaagtgatagaactaataagattaacttacatactaaacttgtaacttatttagaaaaaacactttattttcaaatttccatgtagccaaacaaaatcaatcctatattaggccatagacaaattgttgaaaaattctaaaaagcaaaaactacgcatgctacaccctttgtctataaaatacatataggatatttattaaaaatcctaacataaaaatatgcactgaatttgataggccttcccagatgcaagtgatttattaaggaaatatacttaggacaaatctgtaagtaagggaaatagaataatgcatttgagtgggatgagagactgaagtctagtctcagtcactcccagtgtaaacacacatccaaatgaccctgtagaggtgtccgccctcaggcagagcagcagggcttggctggtgtgtcatgcccagagtaaagcagatcttcttaggccaggacagtttcccagagaagagtgcagctatgtggtcacagtagctgggagacattcatactgattagtaaaaaaggattccgggttgaggactgacatcaacaacagccatgctttcaattaacattaattttagcagctagaaggagaaaacataatgaaagtagtataagtaagaaaaggctttgtttttttcatgaaacaggaagtccagaggcaggcagtttagatctgtgcattaactccaggacattcttaagtatctctgctttttctccctgcctgtcccgctccatagtatcctaagcgtgtggtttcattctcatgttgaagatgactgctaagcctttgggcaagtgaccatatccaggcaggaacaaggggaagggtagaggacctaaaaaaaggcaactagtagtaagctctgtaagacttcttccagagctctcctggaaatactacctagcgacttctgttaatatctcactgggtagaactagaccctacttgtaaggacttggcaaaaatgttggctatccacattctataggaaaggaaggcagatgagaagtgggatttggaatggctctaaacaccaacaatgtttaccaaatcaaaccattttacatttgagataaatgactctcttaattaactcttaggaaaatagtcacttttacaattttatcatgcttagaaaataacagagattaaaaagtacatataaaatgatgcacaagcgtcctcctcctcctctttccgggtgagtgctcccccagtaggcaggcagcatggtggccaaggagacaggtggctggagtccccaggtcaatctctattgtcctacctgcatcaactgggcatccaaggcttgtaattctgctcacagaatatttcaaagaaaattgagctgctcacaaattattacataagaaagcaaaagatgaaaaggaaaagcaagaagtgtctttctggactgtagaaggtgatattaacactgacccgtgggccagtgttaatatccatacactggtaaacttaggccacattatccactgatgacaacaagactggtgccaagttataggcaaagatgattttactgatcattccttgggaatgtctgaatctgaacaggctcttaaagatacttctcaagttaaatttttctgatctgaagatcaaaagggatgcgacttgtatctaagctgctagagaagtgttgaatattgctgctgggctggttaagccaggtgtaactgctgaaggaacagaccatgctgtacacttagaatgcattgcaagaaattgttatccttctcctctgaattattatactttcccacagaattccagacagtccttggaagaaggtgatattgttaatgtcgacatcactctttattgcattggttatgatggggacatgattaagacatattttattggcagtgtggatgaggatgcacggaaatttgttcagaccacgtatgagtgcctcatgcaagccatcaatgcagtgaaacctggtgtttgatacagagaattgggaaacatatttcagaagcctgcccaagcaaatgaattttcagttgtttgaagctattgcgagcatggagtccacaaactttttcatacagctcccaatgcactccattgtgcctaaaataaagcagttggtgtgatacaatcaagccatgtatttacagttgagccaatgatttgtgaaggtggatggcaggatgaatcctagccagaaggttggactgcagtgaggagacagctcggttccactattccttgctggtcacagacactggctgtgaaatgctaacctggcaacttgatagtgaatagcctcactacatatcccaactttaatttcttccaaaatagcacatctcaatagtaccttcttactgtactatgcatttttgggggagtagagaaaggaaggggacattttttatcatttgttttgttttgaccaaaggtaagaaaggactatagcaatttcatatgtgtcctcaagaacttgttttgagtctaaaaaagctgagaagattaaaggaaacattgctcaactcctttcagtgctgtcccctccctctaaatctttctacacacccattttctcattatcaggctttttaaagtttagattatggcaaaagtagccatgctcccagtggtggctgactgttgcagggcatgagaattttgtagtacactgctatgccaaaccgctagttggtcagaaatgggaggggcaaagccccttttcttctcttctttattttatttcaagggcataccttggagattctcagagaagggtggacggtgcactgtggaggatgatggggaaagagttctaaagtgtctccagctgtgagcacagtgagtcaagtgtgctgttagattctgtttagtaaacctgatggtgactatagcagggatgtaactgtccatggtatcctgaaaacacacctcacctttacatagttgagaacctcattagaaatgacctcagttgcccaatatctatgttccttttgacagttgtccaaataggaatgtatccaatgactacacatcagatcctaaagtcattgtcattattagagtggacttaattaatgggtatttgctaactttcatgtaatataatttcataccactgacatgttatatcatagttgtaagagaatatcttttccagagtgtctgaggccttattgttttaaaatagttataataacatttccattgcttttattattttattgatttagtaaagtgactatatctggtttcaatttgggggagtatgtgtgtgaagttttcatcaatctgtaatatttgtgatggaatgccttgcaatgtaaacgttaatataatgtgtagaatgagatgtaaaagtttaaatgactatcaaaaaagatattatgcaacgggcatagtaaagcctgaaaataagtaaactaacaattaaacaaactaagcattagaaaaaaagagtaaaaatatatacttgaggagagtaaagaagaaaaaagtcaccaaaaacaaaagtttaaatttaaaaattgggataaaaatgggaaatgccatttttaatttaatatttgttctttgacaaggtcattaaaatagaccaatccttggcaagacatataggaaaacaaaggagaaaagaaatgtataatgttagaaatggtggtgggagggatataacaacatattttgggtgttttttcccttaacaataaagcaaatactatgacaattctatattttttaaagaggccaaacaggaatgaattacaaactttttagtaaaccataaatgactaaaattgatttgacagataatataaaaccatggggaaaatggataaagcaaccgttaattttcaaaacaccattggtcaaattgaaatggaaacaacagtctgagcaaaaaatcctcagcacaatttaaaaatataaatttcaaaagttttttaaaatgtacatattctttagatattttgctcgcagggatttttattggggaaagaatgaaaagatatacataaagattgatgtgaccaagtatgcaatataccatagtttattagcactacttgttatagaaagtattgataataatttcagtattcaactgcagaaaattaatatattccatacaatggaatatattaattaggttgaactgtatcaaattgccactattgaccatttctaatcaacaaaaacagtgaattcaaacctaataaatacacacaaatacatatttaaatatcccagtaatttaactgtggttatctctgactggggctcttttgggtgatttaaacagtctaattagattctaatacaggaacaaaataagcacataacatgcatgtattactttataatatttcactaaattatgaactcttggggaacaggcatttggttttggtaatcattacattcttggtgcagaaggaaatctgaaaatatttgttgaatcaatgactgaaaaaatatttgtactataaaataggaaatgttaaattgcaaatgagaaaagctagagaaattgctcattaaaccatttgcctcaccgtatggaagggtcagagcaattttaagcctatagtgcttaatttaggcagtaatttttctgcaaagtattcagtatgtatagtatctgataatgttatgtctattttctagctatctttgaaaacatcttattaaatttcataaatttaacatgtggagaactaaggaaaattccaatgataaatggggacattcaacattaagagaacattcccgcataaaagtttggaacagaactgcagcataatattttaatttatcataatgatttatgaaattacatcaaatacattttactgtctcattatccaaaattctcaaatttcaaaaatgaaatatttgaagatgtcaaataattatgtagaccatgctgacagtctgccaggaaaccttcattgcagaattgtagttgagttgttttctcctctagtgcatagaggggaatgagaaaccactaactgtgatggtctttaatgtcatgcaaaagaacattgaaatccatatttgctcagaaatcctattagtgtctctattgaggaaacctcaaagaaaagcactgaagtgttaatgatttgcctacagaattttttgtccaaatgtttggataagctgacaggaattaattctataaaaatcctttctttcaaattatttcactaatataaaactccctaatccagtagcattctttgacatttttcttaatatcaaaatgctaattttgcctacataatattaataaatgaagcaggcattttttattactctctctccttactcatagggttggtgtatattttaattagctgcaaaagttacaactgccttgttatttttactagaaaatttattcttgtagtcacctaatggatatgataatcagtacggagcctagaagcttctgcattctgtttataaaagagacacagttcctgggtatgaatttgggctctgagtggagacaggtaaaccaggagagaatatttataaacacagtaagtagatgtatttggttataatattttgttggctgatgttacacttgatttgcagttttcaaaatacaaaatacagtgcccttaaaatacaatgttgcctcctaacgaaaagcttataaacctgaataaggctatattttttttgcttattttttttggtcacaaacaaatagcttaaaaatgatggctgaaatacgcattctagatgtggattccttatgttaaaagtcagattttttttcataaattaaaatatattcagtggcaaaatttgacagcacaatgtggggttcatatttttactatcaagctattattctcaaaagtgttcaggtaaggaggtcttcctgccctcccccttcccctgccagaggaagaggtacaagagatttttggcatcatgagataaagaaaggcagcaggcttaaaaagcaactaaaggacttgattgtgaggaattctttattcccagtagtgtttgttcaacgttgaactaggaagggattgcagaatatttccaatttgataaaaaaaagtatataatacattctaaatattttatatttaaaaagaataaatattctttcttgtctttttacatttatctctactgccacacagctccatttaatggaatttagaaagtttgtctctgaaagagtacagtcttcaattgatcctcacgtttgtcaagaacactgatgcttgatttgattgcagctccagcagttaaaggagtgttcatttcatgatcaagtagcctgaaaacacttctttaaaatgaatgtttcttttatatttggtgattcactgctcaccagggtctctgttcctgggttttccctgcaactctccttctgacatttccattaaactgtaaaaagtaagtgttgactgattaacatcttaagagctctgtaaaaagccatattcatgaatcaaagtcagtgtgccccactggtaattaacttgacaaaattcagctttccaagctaatcatcctctggctgctttatgtaattgctgtcaattcagatctacaaaacaattggagtccactaaaaggcagagagagcataagaactaatgattaggccaagttctctagctgagaacatattctgattaaaatgctggagtataatgaggaaacagaaacattcaaaatgttgacttgagggttccacatttataattatatgaaaacagcctatttaagatcaaactaatggtaagggttaagtggtgagattcaatgtaataaatatcctagggtttaccacataaaagttactgagcaagaccctgaaaaggcagtagacctttagggcacagcagggcatcgtggatgaagagcactgcttctgcactgagacatttaaatactggcctttggctagttgtgtgatttgggacaaactgctcagcttcattcagcccacattttctcattaggaaaatagaaaaaatgattttacttagcttatacatttaaggattaatgcaaataatgacttaatctgttacccggaatttcgtagatgacaaataactatcacatattctattatcattacaatttatcactaagggaaaagtcaagtatgcaaattaatataacataataagcatgctaagaaaaatacagatgaaattgcccattgtatttacaaatggagaaccaacatctgggtcaggaaaccttgaaggaagagaaattgattttggaggtgttttctcacaagaagtataatttatcaactaagttgagaagatttatttcagtaaagttagagcaaagtcattcatcaggaaaagcatgatgtgcaacagaggaacagtaaaacaatcattttactaggcatacgattttatgatagtgtaaaagaagattatactgcaaagaagggttggataactattgtgggttgactatttaaatcatcattgttgaatgtttcaaaggatattttgttcattccttaaagaccagaatatttcaataccaaagagttccacagaaccaaaacaggctttctctccccataaactctcagtagacatatattcaataattaaagctatgtatactttcttagattaaaatgactagcttttatggaagtcaatttagtactcttatttagaagtgacaagaaacttcaaacaatgtaagaagattcctcaaaatacacatttggtacacacaaagaaagaaacgtaactagaatattttaaatattattaaaagcctatatttgtttggctaaggcaatgggcgtcgttcccacggaaaaatcacctatagagtttatcaaattaaacatctcttgggctgagtcttaaaaattctgatttcatttgtttagagtgaagctcaaagcatcagtaattttcaaagatataagggaatcctaactgtgagaaaggagaccaaagatacttcctctttctctcctctgaaatcatgtaaacaagaataacaagaaaaatgtaaaccatgtttttgacaaaaatagggatatctataatcttgaatcacaatttaagatgaagagctgtcaaatgcaataaatatcaaatcagcgtgcaggaagatactgacagagggcatatgcagttacatatctcagacacagccagccaaatgcaaacattttccagaacattgggggatgctaaagaggaaaatctacagtcctcggtttgagtcaatagaaacaacatgtttgagctggctgtagaaactctcctgtccaccatttgttactaaagagaggtgggggaggtaggtctcattgaggaaatcacattgcttgccatctttgctggaagagacatgtggaataagcagaggagaaaacatctattgtgattaccctgcagctgtctcagaaagatggggcaagacatgctggcctcatacaaacatccaatccccagggtaagctgaaggaaaaggcagcactctgtgagccagggccagtttctcttaaatagaccactattcggacacacacagacacacatacagaatcaatcaatcaaacatgagcacttggaagtgtaaaaggtatataaattataatgaagatctggcagtcattaatacataggcacaagtaaaatggacagaaatatagtaatacaatattctaatttatataggatattctaatttatctctcagaccacggcaaacaaatagaccaaaagtaatgcatagatcttaataatataagtataagatatggtttaagaagctcttgcaatattcacatgagaaaaaaaataatagattagaaagaaatcgctaacatatttcccaaaggaaaagaattagcttcactgatcacagtgaaataagtggctctcacaagtggcttttgggttaaagatgaagttcagagcaaaagagcagattacttggaaagtaaatataataaagcattatatatgaagacctatggtatacaatttagtcacagtaactagagacaagttcctagccacaaccacttgcattgataaagaatgaaaataaataatttcggtaactaactcacacataataaaataagttaaacaaatgaaaatatttaataatttaaagcagaaagtaatgtcttagagaacagacaaaacagagctaataaatcaacccaataactgggtcttaaacaaacaaacaaaggaaaaacaatggctaacctaatcaggacgctgatggtgaaagcacaaatacattaagaattggaaatgggaaaatatctcaaaggcagaagacattaaaagaattgcataaggttagttttttcaacattataaaaataaattttaaatcctacacgaaatcagtatttttctaggaaaatagaaatgagtgaaactgatccttgagaacacagaccaattgctaaagaaaaaaattcaaaaactttatcatggagatattcccccttccaaatcagtataaatccagattgattggtggattttatatataaattttttatcttcaaatagtttgaagcactacaagaaacagatgcttgtagcacttcaagctatttgaaaagataggaaaataaatatttacacttgtattagtcagggttctctagagggacagaactaataggatatatatgtgtgtgtgtgtgtgtgtgtatatacacatatacatgggagtgtgtgtgtgtgtgtgtatatatgtgtgtgtgtatatatatatatatatatatatgagtttattaagtattaatttacatgatagcaaggtcccacagtaggctgtctgcaagctgaggagcaaggagagccagtctgagtcccaaaactgaagaacctggagtccgatgttcaaggacaggaagcattcagcatgggagaaagacgtaggctgggaggctaggccagtctctcctttcacttttttctgcctgctttatattcgccggcagctgagtagattgcacccaccagattaagggtgggtttgccttccccagtccactgactcaaatgttaatctactttggcagcaacctcacagacacacccaggattaatactttgtatctttcaatccaatcaagttgacactcagtattaaccatcacacaattatattttctaatctagcattacattactaccaaaatctgacaaattaaaaagatatatagacaatagaacttgaaacaaagatcaaaataaaagactagcaactagaatgaaacatcacaaataaagagtaatataccaccactaagtgtggcttactctaggaactctaatatggttctgtattgaggcatcatattaagagatcataagagaaaaatcaaatatttaaatacatagagactgaaattatttgcataattcagcatatattctgtatttttagaaacttttaataagatagtaataggcttgtgtattcttaataaataatctataaatcccaaagtgattttgaagaacaagtgaaggggaactgctgtatcacataccaaatttagcataatttcataataatatgatatttgttcagagtgtacaatgttgaacaaaacatagagctcggaaacttatattgatgtcattatatggatacaccaactagtgcgggaaaagaaaactattccacaaatggcactgggaaaattgctgttttattttgggagatggggcagaaatttttacttcatactaataaaatcaagtccattagaattttgaagggtaaaaaaaatttaatctttagaaaaacaatttatgaaaatatgtgggtgacttttgtgttgtgaagcatttcttaaacaaattacagaaagcaaaagggaaagattaaaaatgtaaagcttcattttgacaaaggacatcattaaatacagtttgaagtcaagccataaactagcgaaagtaatatacaagacctacaattgaaaaggaaccacaaacaagatataaaaattttataactcagtaactgagagataaatgacccgttaataaagggtcaaatattgtgaacaggcatatcagagaagagaaaatctcaatagtcaataaatacatgaaatgaggctccatggcactaacagtcaaagaaatgcaaaataaaactacagagatttaatgttttgtgtctaccaaatttgcaaaaattaaaaagcatagcagtggagagttgtacctgtagtcgatgggattttgaactagtaaaagcactctggagctcaatctggcaatatttagtaccatagaagattcataggttcacagaagattcatagattcaacctagcaacttcacttctaaaaatatatgctggagaagaacagtggttcttaaccttgggtgcacatgacagtcataccagtacccaggctgcactacaaaccagttaaatcagaaataccagagacatttttctggcatcagtatgttataaagctcctcaggggattctagtgtgcagtggagcttaagaacccatgtaggagactctctcacaaatacctaagaaaaatgagaagaaatctatgagcatattaattttaatcttgtttgtagtaatgaaaaactgcatttcaaatgagtaaaaaacttggatagtcaataaggataaatctcaaaatctcagcatttagtttaaaaagctagttgcagaatgaaacatattgtaccatttatataagatttgaaggcatgcaaaacaatcctctaaaatgttcttgatcacataatgtgcagcgttttgaaatgtgtaagaatgattaaaaaacaatttcaggatatttctagacctcaggcataaggatgtcagatttagcaaataaaaatacattcaaattgtatatcatatgagacatacttatactaaatatttattcattgtttatctgaaattcaaacttaacagggagtcttgcattttatatggcaatcccacttgggaggggatctggaaaggtaaacagaggcttcagccatatctgtaatgttttatttctttaagaaataattgaaacaagtatggtcaaatgctagagtttgacagaggttgtttactacaggggtaacttatatttttctgtgtccttgaaatactattataaacatattttaaggaaaatacaaggaaagaacagacctcagttgtagtaacaatacaaaggagaaaccatattgaaataaacattagtaaatgtccaagatcaataagaagaaaacatattacactaccaaggattagaaaggaggatatgaatagacagacatgccatatcttgcttttggattgttagactttacagtgtaaagaaatctgagcttcctctgttagtccatacattcaataaattcccctcaaaaattcaacataaattcttatgaactacacaaaataatggattctaaactcataagggtaaataaattcacaagatctgccagataaatctgagtgatgaaaaataaagggtagataactcaaccttgtaatgaaacatgttataaatctactgtaattaaaacagaggagtatgtaaataatcatagttacatttgagctgaagttgtgacctttgatttggatggctatagaagtaaaattgtgtcaatcattgcaaaatgcagatttaccccagtatattttaaaatctatgccatcctccttatctttttactttttgccccaattcagatttatgtcacctttcttctggaaattatagtaactctaactgctgttcatacttacagtattttcttcttcaagtttctcctaaaaccttagccaaaatgattgatcataaacacaaaatgtgtcaactccttacataaaatagtttaatgcctcttcattgcatccttggcaaatgtcaggcatggtaacatggaataaaagacaatttagggcccagccttggcctccctcttcagcctcatctctagcactgaaataactctgagagcttcctcttgtcccctcctgatatggttttattgtgtccccacccaaatctcatcttgaattgtagcttccataatccccacatgctgtgggagggacccagtgggaggtaattgaattatgggggtgggttttcccatgttgttctcgtgatactgaataagtctcacaagatttgatggttttataaagggcagttcccctgcacacactctcttgcctgccgccatgtaagatgtgcttttgctcttcctttgccttccaccctgattgtgaggcctccccagccatgtggaactgtgaagtcattatacctctttttccttatcaattattcagtcttgggtatttcttcttagcagtatgaaaatggactaatacccctcctatacacctggccatttctcactgcctggaacttttacctttttgcactcatttcctagcatcctatatatataattgatggttagtaaatgaagtgacctatggaatatccactgaagtcttttcaataaacaattgcatacatgcccaaacaattgatatttaaaatagacaaaaaacaataaacttcctgggatagcaagctggacagatatttctagttttattgactatgtccttacactggtttatttacttcactttaaatcagctttaataaatctgttttttgatatcagttaaatgtagaagaatcaaaccataatccgtatttcttcattttacaatggtggttccaagaaaaactctaatgaggaagcttccctcatctttttgatccatccctttttcttcctatatatgctctataaattatcatacaccacaaaaagaaataaaagtgataaactaaaacaatgggtttaattagaaataatctgatcatttaactttaattacaaggctattggtgtatttaaatttcattttaaatgacatctattgagcaactatttgcaccggatattataaatatcaacttaatacttgaaatagtatgtgcattaggcattaattctattttacagatgatgaaatgtgacattgagttaccactagtaaatgccaaatctcagagaagtagacattatatcatttcacttcagacttattttccttgatacaagtatttatcctatttttacttatcttttgtgatggatatttacaaataacaactattattagatgaaataaattttaatggaaaatttttgaaaattctagaaatgaattcataatgtattatcatttctaattgaatacatttgaacttgctattatgtttttttattttttctttgagaagcagaatttattttcctttctttccctctttactgtagggggaaaaagtctaagctttcaaaacttccaagagttttgtatatatattctgaagaaatgagacaaaactccttctatttataatagggctttttctcaagtcagacaaactgacccaataatatcacattacagtgggattttggcctaaagtacttaaaatataacccgtgtaacctagccacaactgaatgaagccaataatgctctcctactgttcaatgataaaaagaacttcaggaaagtttcatttatcctgctctttcactgttcagcaaggtgactgccaagttgagtttacaatagcttaaatgggctaaaactaaaagcatttggtagagtggtatttcaccatagtagttcttgtgctcaacagctgaactgaatttacacgaaaagggaaggaggaaaatggtttgtctttttttgcagagaattctatccaaattcacttgcatttaattacttcatattttggaaatgacattttcaagtgagtaaagtttgtctttgctgcttttcaactctttcatctttcttctttaagtgtatatttttaatttaattttttttttttctgtgagacagagtttcagtctgttgcccaggctagagtgccatggtgtgatcatagctcactgcagcctcaaacttctggactcaagcaatcttccctaatttctatatcttgtcttctctcatgtcctttgacttctattcctagagacctgtcagcctttgctattaattctcttataaggccttataagcaatcagttttcagtccttaaaaagtgattcatggtgctatgataattttcctcctcaatcattaatcaaatatgccaggcactgagtgaagcattagcatatggtggatgagcaactaatattggatgagacaatgatacaataatgagtaagacccaatccctactctggatgagattattattaagtaagcaagatggaatagccagtaattaaattctgttaccttacagtaggtaatgagttaaatatatgaaaactgtattatgggaatgcggcgagcaggacaaattattctgcaggttgaggccgggggaatgggaggcttcattaaagaagaaatgtctgagtcttgttgtgaaggatgtctagggagaataattgggacagttttctaaccagttgaggtattcacaagcaatggggttgggcaaggaccagttgtgtcctgagtctttctattgagtttggaacgaacacaaggtgtggggcgggagtgacaagtgataaacttggacagttagacttgctctagacattcaaggactttctttgtgatgctattgagtttgaatgtaatcatgtgggcaatgcaagacaaaataattttaaaaaaaattgcaatgagtgacatagaggcagggagattgttggaatagttaaggttgccagctctgccacatactagctgtgttatgaaattacttatctttttgtacatcagttttgtcaacaatatggtgctaatacatatgactggtgtaaagattaaattaggtaacaaaggctaagtatttagaatgggtgtttaggaaaaaacaaaacatgtttcttggccacataaatgtcttcttttgagaagtgtttgtttatgtcctttgcccactttgtaatgggttgttttgttttttttcttgtaaatttttttaagctccttgtagattctggatattagatagattgcaaaaatattctcccattttgtaggttgtctgtttgctttaatgatagtttgttttgctgtgcagagttctttagtttaattaagtcccatttattaatttttgctttggttgcaattgcttttgatgttttcatcatgaaatctttgcctgtgcctatgtcctgaatggtattgcctagattttcttctagggttgttacagttttgggtttcacatatatgccatggaacactacgcagccatgaaaaagaatgggatcatgtcctttgcagggacatggatggagccagaagccattatcctcagcaaactaacacagcaacagaaaaccaaacaccacatgttttcacttataagtggaagctgaacaatgagaacacatggacacaaggaggggaacaatacacactggggcctgtcagtagcaggggtagagggagggaaagcatcaggttaaatagcaaatgcatgtgggacttaatacctaggcgatgggttgataggtgcagcaaaccaccatgacacacatttacctatgtaacaaacttgcacgtcctgcacatgtatcctggaactttaaattaaattaaataaaaaaaaaataaaagaacaaaacaaaacacggagatgaatgcatgaagggaatgagggtggaaaagatccatcaatttcagtagatttctggaatggaatagcctgcatttgggaactggtgtgttgtgatgggaaaggtagagaaagaagtgaaatttgcgctgaggttttctagcatggtagcataaaatgctacagagggccacaggtgattgaaggaattcctgttaacatttttgtacaaaagatgctacaaatctttgcaagaaactgctgtatctttcagttgatattagaatacataggactgaaacttagaatagaagtagtagttagaaaagaaatatttgggaactaagggcgtaaaagacagctgttaaaggcattcaggttgaacgtgtggattaaaaggtggaaagaattgtttgttacagcagtttttaaggatgaccagaggagaaattgctaatgatagattcatagatatattgggaagggagatcttttggtgcaagaacttctcatggaggcgtttaacacctatgttacatatcaggaaaataaaattactgttttggagaacatttggaaaaataatcatatttattttatgtgtttattttcagccctttgtttcctaaacaaatgtttccttacatgtttgtgattggactgtagcaatgtataatctgcttcattcacttaatatttgatgcgatccatattgtcacataatcttcataatcaccgtatttagcagctataaaaagcccatattgaattgcaccaaatttccttgactatttcccaactgggagatatgttaacattttcttcattttgttctgccaaatatcttcagaactaaaatgactttatcagtttctcatttttccttatgttgatgaagagtcaaactctgtaaaatatttgaagagatttattgtgagccaaatatgagtgaccatggcttatgacacaaccctcaggagatgctgagaacatgtgcccaaggtgctcggcccacagctaagttttatacattttagggggccatgagacatcagtcaatacatgtaagatgtacattggttctgtctggaaaggtgggataactggaagggggccaggtttccagcttataggtgaatttaaagatgtcctgattggcagttggttgaaagagtttatctaaagatctggaattaacagaaagaaaatgtctgggttaagataagggattatggagaacaaggttcttactatacaaattaagcctccaggtggcaggcttcagagagaatagaatgtgaatgtttcttatcagacttaaaaaggtgccagcctcttagtcaattctctcctggatcagggaaaaggcctggaaaagggcaagggaattctctacagaatgtagtattttccccacagaagacaactttgcagggctattttaagatatggcaaagaaacatattcggggttaaaatattttgatttctttccttatctgtcatgtgatgttatgccagagtcaggttggaaagtaaggtatgttgtatagggttaaataaaacccctctgatgagactttgtggtttgtagggagtgactccctggtcccttggataggaatttgggcaagagaaggaaaaaaatcaaagtttagttctcacgtaggtagtcctatttatgaaactggatataaatcacaaaatgtctattccacagaattgatatttactttaacagtaaaacatattcaactttccaacaattattgatgcaacaacttaattattggtggcattctcacttgcattattgtcattttccatcaaggtacaggtattggcatcaaatgctcctttttaaaaaagaccaaatattagcagtcttactactaccaaattatacttaactgttaaaacattttaaggtatcaaaatctgcttcaaataatcttggctattccaatacttattaacgagcttgattctgtatttattattcactaaagaatcaaccatataagccattatcatatatgaatacattattggcagcaaatctataagggtctgcagcaatctcaattcttgcctccttagaagaaagaatttgactgaggggcataaggcagaaaaagagaccaaggtaagtttaagagcaggagtaaaagtttatttaaaagctttagagcaggaacaaaaggaaggaaagtactttggaagaggcccaataggtaacttgaaggaaaagtgtggggtttgatcttttgagttggggttttatatattggcatacttccaaggtcttgcatcccgtttcccttgatttttcccttggggtggaccgcctacatgcacggtggtctgctaacacttgggagatgagtatgcgcagtgtgcttactggaggtgtaggcacgttcacatgaagcattcttcccttttccggtggaatgcccgcggaaggtcatataccagttaaactctgccattttgcctctgaagtgtgcatgcttgagcccactcacccagttcctgaggtcttatcaggaaactgtcaatcaccaggttcaggtgtttttatctattaggaaattgcctttccctgatgctggctgtaaccaattattactttagagaggcagtgtgacaactgcctggccatcacctgatggttgcctgacattcctggtggggtacggggagccctctcctgccccactcctacctgactatctactgtaacaaatatagcctagacacattacatctaatggagataattaatctgataacatagatcaatgtgaaaactcattctgtctctatcatttagtttccagttgggaaattcatgtttttgtttgtctcactgggtgcatagtttacaaatgaagtaattatcatacatggcatttctatctcgctttttcaaaccagttgaattttgtacatattataatagtattccaatattttgtgaagggatgtgtgtgtgtgtgtgtgtgtgtgtgttagtgactattttagataaggtggtcagagaaggtatcttcagagaagcaagccgtgcaaagacatgggagaagaattatagacaaaaaaagatgataaaatacaacatgccaggagcctagtgagcaaaagccaagtgataaattccagagcacaagtgatgaggtggctggcctggtgcacagtgatgcatgatgcttttgccttgtgttctaagtatgtggacccactagtggattttaagtggagctgttacctaatactatttgcacttttaaaatatcagtttggctgctggatggagaatagcttgcagaggggagaggaagtaaggaatctagtcaggaagatattgttgtaaattaacagaataaataataacacacggagtggtaagaaaaattagccatattaatgtcgatggacttgactgtgatttgatgccaaaaaaaagtgtttcttaataggaagttgagatacaaataaagacaagtacattacaagcaacaaaaaactactttggtaacaaaggcttcaatttgcatgacttctttctcagcaatcagtagtctgagttgagtgaaatggtgtattcatgaaaggagagtattagatactaaattagatctctgtgcaggcagagagacccacattgtggagggcataaaatacgaagttcagaagtttgtacttcatcctgtaggcagtcgtattaaatgcaaatatttgaagaggaccatggaatgtacaatttggtgctttaggcagtggtttttagtatgttttgagggaataagagtgcacacaagaagacttactggggaataaaataatagatgggatataaatgaatatctgagcagaagccaggttcattgttaactgttaggtgagagacattggaagggactgtctgtagggttgaagaaggtagaatgaagggtaactccattttatttacataaaaattcatcattaatccctgcaacaaactcgtgaggtaggtaagattcttttacagaagaggaaactgagatggccatggcatagtagcttgctaaattctcacaaatagtgagggacagagtgggatttctaagccctggtaaattatataacacagtctcaaaatctgctgaaataattaaaactttctaaagattgattgtgcacacttattgtacatattctcagaatatttatttccttgctgaaatagttgttgtacttgaaaactgttgtgcttatttacattgttgttgctaagctatttaaaacacaatgtaaaatcaaaactttatttaaatagaactttggcttttatcctcagtgtattcatttaatcacaaaaagtaatgttaatgtgtttgttcctaaagtcttttgtattgctgttttgttaaatctatttgcttactgatttaattaatgatttgtctatgacagacctaattggagattactatgcttaaaaaaatgggataaagtcaaagaaataaagctgtagaaacaatttagtggaagagaaaatgctttgacaataagcagtagtctaaaaattttaagtgcgatatatattttttatctatgttttcttgctaagttaaaattaaaatgtgctagacttgaaaacagacaaaacacccctgaggttcttttacctggttttataccacagtattctttgatattagtgaattatttcagtttgcttctttgcattgttataggaatgattaacctggtgttctcctgatttattagtgctatctgaaaagcaccaatactttattatctccctggaattctttttcattttgtaagaatcattgagagactgagctatataatacttgtatagagctgtgtcttcttaaagatttaaggttaatcattataaattaatagtcattgatttcacatagtggaccagtcattgtagcaaactgaatgtacagtaaacagcctatacctctattgtccacctttcagttaacacaccacaattcactgatttctttgactgaaaaaatatttctttttttatccttatgcttagtcctgcacaggagtgtacagatattgtgatgtatgttagtactacttgagacgtctttcaaatgaacaaaataagacttcctctgggtaaataagagccagaatataagtataattcaatattttttttgttaataacctggtaggactagggtgaggtcataaagaaaatgaggaactatctatacaatggtaatagtagtagttacatatgtggttttgttttttgtgttttgtttttttattttttttttcatttaatccttgaaaccactcaggcaaccagcttatttataatcatgccattttcatggataatagaaaataaagttctgataggttaagtaacatgaccaaaatcacagagtttacatttcatgaaaagtaaatctatatgtcgtggcaataggtgttgtgcagggcttcagtgaagcggtgtgagggggagagcctggtgaaagagaagagttggagtctagggtgttagggatgaggtttttcactattttacgtatgtggttaggaagttctgactctcaagaaggaaggagtgatccactgtctcaaattctcctactagtccctataagatgagaactgaagtttggacctttaatttggtggtgtagaggtcactgaggctgtgaaaagagctatttcctggagtgttaagaagataagcctgattgaattggttcagaagaatgagaggaatggagacagtattaacagctcttaaatgttgctataaaggaaagcagaaaaatgggacagtaactggatgaggatgtgggatctaggaaggctgattgtcacttctaagatggaaagttttttaaaaatcaggtttgcatgatgatgagttcatctactagagaggaattatcaatgaggcaggaggggaatattctggagcattgcctctaagtagatataaaggtatggatgtgttctaatatatagggagggattcactgtaggtaaagtagggaagctcatgtattttaacagaagaaaagacatgatgcatgaatacagatgaaagttagttggtgggtgtggtgctggtgatatttgaaagttctcttttgattgcgttttttaaaaaagaattagaaagcatgggtattagctgtgcatggtggctcacacctgtaatctcagctctttgggaggctgaggccagaggatcgcttgaacccaggagtttaagaacagtctaggcaagatagtgagacccccatctctattttgaaaataaaaaataaaaaataaattaaaaagcatggacaccagttgagaatcagaaaagaggaaaaatgctactaagggaagagaaatgagacaactcaagaaaaggcactttggagaaaagaaaatatatttatcttgaggatcttatgtttgagatcctctggtcattcaagaagagaggatatctaatccttttgctcagtcaggagatgaagtctagagatagatttgggtatttatggcacagatatggtaatttaaaccatggtgtaaaatatatggccagggagaactagcagagtgagaagaagccaaggtcataacttgaagaatttcattatttgtttaaataatggaagaggagccagcacaggaggaagaaaacaaagatgggtaaagaaaagtaggatcaaacagcaatggcaatgacaaaatggacatttatagagtgttcagtttttaaatggaatctaataggatgaagaccaaaaagagaccactgcattttttaaagttaggaagttattgattatctaactgggaattatttcagaagagtgatgggtttgaaattacaatagtgttggctgcagatttgatatatttgactatgagagtgaaatgaaacatcctgggatgttaatagtttaaactgagtcagaggaagttttatgtttttataaaagttaactaagtatctcctgtgtgccagacactattcccagtagccttggacaaaatggacattgtggaaaacatatagacaaaaatttctatcctcaaatttcttacattctaggttaggttctttcttttagcctggaaattttgtatcaggagaaggagtcaaaggagagagagaaataaaggaggtgtctccagggcactgcagagctaagagaaattcacaaagtgtttagattacatcacaagaggaaaccatgagaaactgtaaaccaggcaaccctggttttcagtttatggcttttacatgaacaaggattttgtaaagaaacactataattcagtgaaaacaacaatatactagggtgtcagaagactgtggtatcagacccacagcattaccagttatatgagttaaggaaagaatcctgcagagccatagcttcttctctgctaagtagcgataacatctacctattgacctccaagtgttgttacattggtcagatgaaattatatggtctctaaagagcctcataaattaaagcgtttactataagaaggtgctaattgacaaagcacatcttcagaatcttgtgacccatattttgtggttctcaaattgaagccatttttattatcattatttattcgtatttatctgagttctactggagtgaatttttttcatcttcttgatgtttttattcttaaatttaaatttgtaaagtatttacaaaacattttattaagtttttttatgagccattaacaaaataaatttggaatatataattctccttgacaactgtgcactaacacagaaacaaaggctttattatgccctgtatggtcacgtgtttataatagatgagccttggcttacaatgactgctttgtttgatgtttattagcccatgccttggtgcaatttaacttgtcctaaattcactgtttcagaactacaacgtgtgtagcacattcattgtcctttgaataatactctgttgcttgagtagaatctcaagagactataaccttgggattttaaggttctttccttatatgctctagaaaacccttaatgaatgtcgattatgtaaaggcattaaaacattttaagtggtagaaactgtccttatatgattttgaaaaaatgtctgtttttaaaaaatatctacgtagaggatcgggcttacctcacattctccccttagtgctgatgttaatgaatgtgatccaggtgtcaacttcaactagtggttattttatccaacttcaaataagacaattctacggtatagtatattgtttataattctaatcttgattccaggaagtttccataattttgatgattattacttaatgttttacaatggtttcacaaaagttaaagacaaaaacattttaaacataacattttaaactctagaacactttctttttagatacccttgatttataaaaacagaatttgtttctccttattttcctcaatattactaaataaaacaaacgggtaattaaggtactaaggtaatgagattatctcattcaatcaatttatgttataattaaaactgaagtttaaaaatattctgtgactgcccaagctacatgattggaatgtagaacctagaatcccttcattaccagagtatatgtcattgcctttggtggttttcataattaaatatcttcacatatggtagtggtagttatggtgaggaaagagtggggttgaccacaatcctgccatgttaattttaccttgcaggggcctgcaaccatgtgaatactctgaagctctagtaattttgaccaattcccactaaaaggagtgaagagaggcaaaccttattcttccctcctcctcatctccttccttttcatcttcttcatcttcactatttgttgctttcttaactttctgaatatactgctataaaaaagaggaaaatgctgaagaaaattacaatgacctataactccatgactcagaaatagccactctctttattctcctatcttatcattatttttattagtcagttttcatactgctatgaagaaatacccaagactggataatttataaagaaaaaaagaggtttaatagactcacagttccacgtggctggggaggcctcacaatcatggcggaaggggaagcaaacacgtccttcttcacatggtggcagcaagaagaagtgccaagcaagaggggaaaagccccttataaaaccatgagatctcgtgagaactcactcactatccagagagcaacgtggacgtaactgctcccatgattcagttacctcccaataggtccctcctataacacgtggggattatgggaactacaattcaagatgagatttgggtggcgacatagccaaaccatatcattatttttctgatgcattttttgtaacagatattttagaaaattgagactatatatttcacactattttataacctgcacatagatttgacagtgtctggagcaacatcaaatatgcttacatgttcttcaatattatgaattttaattgttctataacattttaatataaggatatattataatttaattcatctcctattgttggaaatttatattgtttctattattcactgttatgaaaatcaaattttttaaactttgcttcatatcgttaaattaccttcagaaagttatcagttgatattccaccagtatgaaagccctcatgttcttctatgcttcacaatatttggtacactatagatgtgtgtgcatatacacatatataggataaattataatatatgtttaaataagttaaatacataagtcataatagtacctcattttttggttttgttttacattattatatattggcaaggctaaatacctttcatatactactggctatccctatagtcatcccttgtatctacagggaaattgatttcagcaccgttacaggtatcaaaattcacaatgttcaagtcccttttatgaaatgacatggtattttcatataaccaatgcacattctcctgcatactttaaatcatgtctacattacttacaattcctaatacaatgtaaatgctatgtaaatagttgttatactgtatttttttatttgtacttttttttactgttgcattgttttttaatggttttgaaaaatccttttttatccacagttgtttgaatctgtggatgtggaaagcgcatatacagagagcaactgtatcttcttttgcatttcttaatcatgcattgccaggtttttcttttgagcaatcatttctaacagttatttgtattttgatgatattttctctttttctagtatttatgttgcaagttttttctccagttgtcaatgttatgttcatagttttaaaaattaaatctacctgtattcttttttgctttatcacatctattattaggtccctttctgtacctctactctgtgaaaaagaactctatgccttctattagtaccattttcaatatcgttgttgctttataatatgtcctcatattttaaaactgatttctatacatttaaaaaaatttcttggttgaggctgggtgctgtaatcccggcactttgggaagccaaggtggaatatccctggagcccagtcatgatcagcctggacaacatagtgagactctgcctctacaaaacataaaaaagttagctgggcatggtggcatatgcctgtagtcccagttacttgagaggctgaggtgggaggattgcttgggcctaggaagttgaagctgcagtgaaccatgatttttccactgcattccatccagggcaacagagtgagaccccacctcaaaaaaaaaaaaaaaaaaaaaaaaaaaaaaaaaaaagaagaaaagaaaaagaaatggcttggttgttcttactatttatttatttattccagaaataaaaatactttttcattttcttatttcttatttatttattcttccaaagaaacttatctgggaaaagagaagtaatagcaagtttgtgtgttgataggaattaacaatgggtgttggaaaacattgatgatacaagaagaaaaagagctgggcaaggcgggtcacatgataatcctagtactttgggaggctaaggtgggaggattgcttggggccgggagtttgggatcagctagggaacatagtgagatcctctctctacaaaatatttaattaaaaaaaaacagctgggcttggtgttacaatcccaactacttgggaggtggaagcagaggataccttgagcctaggagtttgagattacagtgagctatgattgtaccagtgcatttaaacctcagtgacagagcgagaccctgtctctacaaaaattaaaaaggggagacttcctggagtgattagagtaggtgagagggataagatcttatgtataagggggaagttttgatcttgtagaatacagtcttgtagacccttattattatatggtacttgcctagtaagggtggaattgagggaagggatattaatagcttaaggagagaagagttaagtttgaaatactaatctagaagaatgggagcaatgaatggtttggttggttcaatttcaggagattgttcataaatgtaaagtgaaaacattctgtatgattatatggtgtgttttgtttttctagccacatttagatacatagttgcaagcacagaaaaggtgtaactgattttaactagggttggatccagtcaaggatacagtgaagcaggagaggagcaagggagttttatataatgaagtgatttttgtaatgtgtcatgaaatttaagccaaataaggaaaatagtaagagcatgagttgggggtgagggagcaggtagtaggatctatggattttaggtcttggtgtggtagaaccattggagttaaggaacttagagcgagtgatctgggaagaaagaaggccatagtcagagagtacagtgctagaaattgagattataaggggagtgtcctcattggtgtaaccataggagctgcagtggcatggatgacaaaattaccaaatgataggaagtcaataactaaaaggtcagtgtttcagaggagccatgtgtatagctattggaactgccaaaaattacaataaaattagcattggagattgtgacagtgggcaaagatgtctgagaaactagtaggtaattgcaacaagaagcagtactggatggtaccgtcaaaggccatgagtttcaaagctgagggttgttaggaaaggcatttgcactaggtgttccccgagcctagaatgctttcccctagatcttgcaaatagtttgctcctctttattaattagttctttgttcacatgtcacctccaagaggcttcgcgtcatcatccaatttgaagtagtccctcaagtcattctctgctttgttgcttgctttatattttaacagcacttataactaactgaaactatcttgtttatttatttgtttttatatactggacactccttcttaggggatatattttgaaaacagttttgctagtctttttgtgtggctagttcccagacttgtgattacagccacatagtaatcagtcaataattagtttttgattgaatgaatgaatatttataggatatcttggtcagcttgggctgcaataataaaattacatagactgagtggcttaaacaataatgcagttcctggtgagggctctcttcctgatttgcaaacgtcagccttcttgctgtaacctcatatggcaaagaaagagtgactctggtctctttctctccttctaagtatattaatcccatcatgggggttctactcctatgatctcatctaagtataattattttccaaaggccccacctcctaatgccatcacgttaggggtgagggtttcaatatttgagtttgggaaggacaaaactttcagtctatttcatagatgaaatattatcttccacattcctgtgacttctttcagaatccaaatatattttttaaagcatcctctagctcagagcattcattcttataagaattcctattattgaccctttcctcaagaaacatgaattaaaatataagaagaaataaagtataaaggtaaggcttgctctgtgatagttaagttttcaaagttaggactcacagatattgtcagttattacttcaagcaattctcaccagtgtgttaatgaacttgaagtacagttatcttttgatgtattggtttcagcttccactatgctgttttgctcagccaatgacaaccttccatagattttcaccacacaaggataaccttgttgctcccctcactatgacattctttcagaattctttgcacattcttttagaaaccagggtgagcatgaattgaaaatctcattggtaagaaaaaaataaaaccatttatctatcttaagttagtctttctttattaaaataatcaaatatctttatatttttgtgctaaatacaaagtactatagatttattttcttatggcttgacaataagcagacatattaggtaattaacatgctatttagtttatatatagaaaagtagaaatagcatggtatagtagaatgagcacttggtgttgtcgaggattaattaagataacaaatgtaaatctgtctccccttcttttctctttaatggactaaatatgtgttattcatcttcttacactttaatttggtgccttagagaaagaaattttttccacattgtagatagttattatctagtatgattctaattgttgctgccctatttttataaaatgccattctgtaatcacatcagtgatttaatgtttctaataatttacatttttaagcctctggtgttatgaatattttatacagtagttgatttctatttatatattcagaatatttgaagttcaaaacaaagtgttttttttttaatttgttggtgttctgagaattttataggagatttgaagagaaatatgtcaccattttaaattctgcaaccagttactgaacacctaccaactgaaagaccttggtctttttcgaagtaaaaattactgagacaataattgcaaaggttatttaatttcctgttacaatgtaattctttatatctgcttaaaaattgtgtcttctgtagattttgaaacatttatggacactccacattgtaatattttgcatcccagcaaactgtgtaatctgtttttgttttattttgtttttattatgaaaaacttcaaatatgtacaaaactagatgaaagagtataatgaactgctacacatacataatccagtttcaacagttatcaactcaagatgaatctgatttttttataccgcacccacttatatataacttacctctttgaacaaaagttctcaaaaaacaaatctgaaggaaagagactttattccagtgaagagtttgcaaaccaggggagacacagccttcttgtaatgaaagtacattccagacaatagagagaggattcaggttttatatatatatatatattcttttttttgtttgtttttgagatggagtttcactcttgttgcccaggctggagtgcaatggcccgacctcagctcactgcaacctcccactctggattcaagctattctcctgcctcggcctcccaagtagctgggattacaggcatgtatcaccatgcctggctaattttgtatttttagtagagatggaggtttcatcatgttggtcaggctagtctcaaactcctgaccttaagtgatccatttgcctcagcctcccaatgtgctggaattacaggcatgagccactgtgcctggtcaagtattcaggttttatagcaaaagttcctgctcagtttcccaataaggtttgtttatacaaatggaggattgaaacttgcttagttctgattggttgatagaactgagccctgattggctgggtcaagggagctctgattggttggtttccaagcccaaaaccagaggtctctgttaggtattttgtctttttctttttcctttttttctctttctttctccctcccctcccctccccttcttcccttcccttccctttccctttctctttctcttttttagacagggtctcactctgtcacctaggctggaatgcggtgaaatgcttatggcacactgcatcttctacctcccaggctcaagtgatcctcccacctgagcatcccaagtagctaggaccacaggcacccaccatcatacctggctaattttctgtattttttttgtagagatgtggtcttgctgtgttgcccaggctggtcttgaactcctgggctcaagaaatctgcccacctcggcctcccaaagtgctgggattacaggcgtgagccacctcacttggcccagatatttttttttttttttttttcaaaaagccactgtgggactggggagtgaatcaggcaacaacttatcttggcacctacaacaggaactgatttgactttattatagaaaggaagtcctgtgatacttttataacgtctttctgagaacacaagagtaggtgaccactcccttacccagctatggccaccaggttctgtcttaaatatagacatctcagttagccacgggggtccactttgcctgttggtcagggacatactttaataccttagatctggaatcaaccactcctccaagttctgattgccttagtattgcaagcccttaatctgggtgccaggggattttattgctaccaagctgggtttgttttggttttttgctttttttagttgacagtataggaaatatgttttgttttgattttgaatataaaatatattttcagttcatactggcttttacaatggaaatttaaggtttctgaatttttaattacttcttacatctgtacatccttcttccatgtgaagcatcccatgtgtcatgaaaacaagagatgactatatatcaaaattatatcacaaatttatatcacaaaattacacatttgttttatcctataaaaaacacacaagaatatctacaatacaaacactgctaccaacattattattattgacagcagttaatgtttttttttttgcagttcttttgcagttccttagattatagctcactaggcgtgtgcaaattattgtgttttaaaatcgcttggaactgctgttcgcagtgtggctataccagtgactggatacacatttggatctatttatttcatattattttgtgattttaaaagctttttattgaaaattggattttattttctaattacccaaaatatttacatggttcaatgaaaaaatacaaaacaaattatatttaagtaaatctagttgatagctcacaccctgaactctatttttttatccccttataggtgacaacttcaaaaaataaatagttcatacttacattgttggtctttcaaaataatgcacacacacacacacacacacttccactttgatatcataaaggccaaggatgtagtccatgttacctgtgttcccctaacttaatttaattttatatgatatgctccagaacactgaattgttcccttggaaaaaaattactctgtcaaataaaatttagaaaaatggatttgtcaaactaaataggttttctggaaatgtgcattataatcttcagagaagattatcatacatgtagcatttcacaaatgtatttcataggtaatctatttgtaaatcaacatgataaaatctctaagtgaaatacagtttggaaaatactgacttaattcatgtactatggagttgtcaacagatttatctaaagacttccaatttttaaatatttttcatctataccaatttttagaaaaacatactcagtaatttagtgtagtaacacttctttttagttagacaccatttaattttctcataaaatagtagtgggtatcttttaaaagcatcctagacttgggaaattataataagatttgttcttctaccaatcttcactggagcacttctgttctttaatctgcggtttccttttctttttcttgaaaagttttagtaaactatttttaaatatatgattcagtcagttttgattcctggttctcagtttggttgtggacatgtggcattaaaacatattttggttttattttatttcttagatagatcagcttaaatactttaaaaggtaaggtttttttaaaaatctactggttggtagctgttgcttgtatgagtatttatatttcagttattttacttgtattattttaaatttaacatttttttctccatagttagagggttttttgtttgcctgtctgttttactgttcacttggattttggggactgtttgtgtcttcagtgaacaatcatcaaaggctagaatcatagagaaattaaaatgttactttagaataggctaaacttctaagcttaattaaactttcaaattaatatcagaatcctaatttaagctgaatggcaatgcaggataactgatttctctgtttttgttagggacacttttacaatacaatcctaatttaagctgaatggcaatgcaggataactgatttctctgtttttgttagggacacttctacaatacacattgactagcacagacatcacaaggtctttacattccagactgtatacacttgttcctctttaattcacaatcagcctcaaatatattaatctctgggtaactacaagtaagtatatatttaaagaaagctagactttattttctttcaaaggaatagtaagtacaaacattatgaattttactgttacacatatacaaagatcacctctaatatagccatttacaagtacaatgtccaaagtagaaatagccttaaactaccacaagagggatttagggcaaacctttgacattttgtagaacaccttcatcagtgacgaactgctagatatactctttaactgtgagtaaaaatcatgatgataagacaaggaattggtccatggacaaatagaagtcatcaccttagaaaacagattaacatttaaatgttcttaagaattcagagaaatagtcagaacttatccaaaataacagtatatttaggcaaaaactttacaaaattttagataagtaatatgtactatcataaaaactgagcataagttcaaaacaaaaaaaagtaaacatctttatataatatatgaggataaacgttctactgcatagaatagtaaaagaaggaaaggacttgtgtcctagcagctgggtttgaatcttcactcatgcataagagctgtctgagtccctgctttgtgctatactgtgtgcaggtaccacagataaaatgatgagtaaaattatacatggccccttttcttttgtggcttacattatagtggctaagacaggaattgagtaaataataataataatgaaagcatgtaattaaaaagtgaaatgggtgctctgaaattaaaatatagtttgaatatttgtcccctccaaatctcatgttgaaatctggtccccagtgttggaggtggggcctagtgggaagtgtttgggtcatggggcaggagccctcatgaatagcttggcgccctccctgcggtaacgattgaattctcactctgttagttcatgtgagagcaggttgtttaaaagagcacagtgcccatcttcacttctcttcctctctttctagccatgtgacaaatctgcagcccctttgccatgattaaaggtctcctgaggccctgaccagaagcaaacgctagtgccaggcttcttgtacagcccgcaaaactgtgagccaaataaactccttctctttataaattacccagactgtttataaattacccagccacctttatggcagtgccaaatggactaagacagtaggcaaataaaatgagcttagaaatcttcatattaatggaaacttaaatcttgagcaaaggtcaggaaagagttcactgatggaggaatttaaggggagatctgaaggttaagtaatatatttattaagtaaatttagtaagtaaatgaagggtgaggggcttgtgcagctgacaatattctagagtggaaaaatgtagtaagaacaaacgttttgcagagggaagaaacacattgtattaggaaaatggaaagaatgtcactgtggctagtgtacagagaaaggaaagaaaatgaaaggaaggtgaggctaaagaaaggagaagaggatacaccacagaaggctttgtaggccatttaaagtatttgggtctttgtctagggtgccacagaataaaatgaggaaaacaaagtggggcttcagagctatgtaatatccatgactaatttattgaaaagtgaatttcaatgaacttactgaaaatatgttgaattatcctcacaatcacaaaatcttattggcttctaagtacacttatttcccactcaatggtctgaacatttcctgtagcagctctgctccagatttcagactctaggcctgggatctctcagaatatctcattagggactcaatatctacctggacaatacttttcttatagcatggggtgtaggagatgggggcggaaatagcatgagccaagccaaaccatggaaacacttttaaggctctgtttagagatggtttatttccatctgttcacataaatgctttccattaactgaagcaagtcacatggctaaattcaaacttaatagaaggggtactccttccatagagggagtgtggagaaatgtgattatttattgaaccataatatctacctgaaggattttctggaagctatgggttaggaacgttaaagaacaatagcaccaggcagattaagcaggcaaggaagactttattcaagactattgcagtatgggagaaagactgttgcagtaggggaaagagattagcctcaactccagtgaaacaaaaggcagaaaatgctgagatgaactaatgctgagatgaactaatggaatagtactgaaggacattaagaaaagaggtttgtctatttgattaagccatctgtgttttctaattgttttttattgatgttaggctcctactctcccacagagactggtagataaaggtattaatactatcttttttgatgactacatttcaaagaaatggcctccaggcccttgagaaagactttcctggtatagaagatttacttctcaaaagtgcagagaaagaactcacaattgcaagttttaaaaaagcaatggtctgagaaaagtgaagtcaggggcttattgttaggaagaaacctgcctaaattctaataaagtcgagggaaaaatgtaagactgtcttggtcagaagaaggaacaaccatatgcttagaagcatttcagcaatgtcccttagaattccacctttcatgagaagatactctccaggcattgttggatttcttctttgaaccattgattgtttagcagcatattgcttaatttaccaacatttggggattttctagttatcttttggtttatgatttcaaattaaatttccattgagattagagaacatattttattttatctgtgagtctgctttacaaaaatatttgtaaaatgttccataagcacttgaaaataatgtgtttttgtagtaattgggtacaatattttatattatatatattaggtcatatagaatatatattttatatatgtatataaggatattaggttaattgaggatattgttgacaagattgataatggatatatatgcagaatatggtaaataaaggaatcaagaataactctagatccttgctttgtggcttgacttgagttgcagtgtgaatgatgaggacatttttctgagaggaaaactcagaaaggaacaggttcgagtaatatgtcaaatttggccatgcgaagtttagatgtcatttgacatacaagtggagatgtcaatccaggagtacagtataaaagtttggagctcagtgaaaggataggaagctgattcacagatttgggagtctaatagtatcacctggacagagcatttagctagagaagagtcctaatgtatttcaacttcagagatagaacagaggcaaaggaacaagcaaaggagaacaagaatgagtctttaggaaagtgagaggaaaataataagtttggttaacagagtcaagggaaaaaatgtgttttaagatggagttcagtggctaactgtgtcaaatatttctaaaaggtgaagtaatatgagaacagaaaaatgactattgattttgacaatccaagacctttgatgaccttgacaagaatagttggcaaaagatggtataacacccatattttttgccaatagaaaatttaaaacattgtttaattctgaaagaataaataaattcacacatttatcaatctcctgctgtatacaggtcactggggacacaaagataacaaatgatgttttaagctttgatggagctcatagtgttggagggaatcagacatgcaaaaacaaactaaaacaaaattttacaagtcctgggcaaaagatatatccaatgttgtggaagctggagatgcctatggttattttaactgtgggaaactaagaggaggaaagactggggcttgagaagtgcttgacggttttcttggcaaacattagaggaaattgcattccaggctgggcacggtggctcacgcctgtagtcccagcactttgggaggccgaggcccgcagatcacttgaggtcaagggttcgagatcagtctggccatcatggcgaaaccccatctctactaaaaatacaaaaattagccggcatggtgacatgtgcctgtaatcccagctacttgggaagctgaggcaggagagtcacttgaacccgggaagtggtggtttcagtgagctgagatcatgccactgtactccagcctgggtgacggaatgaaactccgtcttaaaaaaaaaaaaaaaaagaaagaaagaaaaagcattccagcatttcaaaagcattgaagaatgtgctctaaaggctcagaggcagagcatttaatgaaataatcagagaactgtaccatcacctctgagataattagaaatgtgtgtatgtattggatggggcttggtcctgcaaattttaggtgttactggcctttaaaaggggtggagggtactaaatatcctgtaatccttgggtggattctcttgatcaacttatctgatgcaccccaatagggtgtttccctgtggaattgtaatagaatatattagagtgtgatacatggaaggacaggtggtggtggaggatgagaagagatgttggacagtagagagatgcaatgataaataatggcagatattttagaaatagaatacatttaacctggagaccaatcagttgggtctgaggtcaggcaaggttgtgactgccaccttttagatgtgagtcactgtgtggatagtggtgcttctcaatcagacaggaatatatggacagagcagatgtgagcctgtgggagatgttgaatttatttttgaacaggttaaattttaggggtctatgggaaatattcaagtataatgtccagtataaaactgaaaatagaaatctggacttcagaagagagattgggaatggagatagatttgagaatcatgggttaataataatgaacattatagtaatgaaaagttactttaaacaaatgtaatgattcaaggaaatatatatttttaatatgatcaaggagagtatttagaaatttcaaatttccaatttattttacatagtctctccttggtctgaaaattactaggggtcaaggggtcaataatactatgatataagatgtttacttcttaattagttcttaataattgaattatcttatttctgctgacctttccttttttttttttttttttttttgagacggagtctcgctctgtcgcccaggctggagtgcagtggcacgatctcggctcactgcaagctctgcctcccgggttcaccccattctcctgccccagcctcccgagtagctgggactacaggcgtgcaccacctcgcccagctaattttctgtatttttagtagagatggggtttcaccgtgttagccaggatgatctcgatctcctgacctcttgatccgcccgccttggcctcccaaagtgctgggattacaggcatgagccacggctcctggccctttttttgtttgtttgtttgtttgtttgtttgtttgtttgtttgagacggcgtcttgctctgtcgcccaggctggagtgcagtggagcgatctcggctcactgcaagctccacctcccgggtctactgacctttctttatatgttacttaaatactacttgaaaagttatcaaactgagataattttctttccacttttcttattaatttatattttagtaagtaaaaataaagtgttttccttaaacaattgacttttctaacctagtaaattataaggcccattaatgtttctttaatactttgtattcccaaaaaggaaaatcttaatgtaataaatgattttgttgcaatattttatcagttatacttctaaagactgatcatttctatactgatatacttctaaagcttatacatttatagactgataaaaataattttaaaataaatttcttcacagtacaaatggagattggctttacaacgttactcatattctcgatgtatcctttaaattcctttacaacatttgtattacagtttataatttacaaattattaatagttgctgtgttacttaattgttaccacaattctctgaagtggatgtcagtaatgttatttcatggaaaaagacactttagctcagaattgaaggtcacgtagctggtaagggttgaggggccctcaagttggttcctccaccgcgagcccgcagatctttgtccatacccgggcaatttcaaagccatgtcagtacttttgttaaaacacctgtttgtactgcttttacaaatcccttataagcacacactaattaggaaatcatatcctttatagaaaatggccaagacgtgatccatcttttcctaaccctctgtctttttctcaactaggcactagtaagcatcttgtatgaaactgaaaaagtactacactttttgggttataacaaagcaaggttattttcatctctaacagttcctggctgatcaccgtgttccatgccacagaaaagcctttaattcctttaaacaacgtactgaagccaagaattagcattctttctggctgaattgcaactgcacacaggttggcctctcatttttacaacaatgttttcattaggtcagctgaaaggctgacttctctgaatgcaaagtgagaaacagacaaggaagaggagtttgagcaagaaataatctctagtgagtcccttgtgtacattttctcaaattttaaatagtaagtttattcttatgtgcaatcaaggactatttatttttattttattatacataagaatcttttatttttatgttattgcatatgttcatatataaacatatatgtttacatgttctttcaaactctggtggtgtccccaaaacagtgtgctgtgatgatcagcatgaaccaatcatcccaaagcagggtctacagaaggtctgagtgggtataattgctttctagtggcaattcattattgcaaattacaaagtcagatataccatagtgcatctgtgtggaattataaagtattcattattgttattttcattcctagattcaacatgctttaaaaaaaacataaaataaaaataagcagaataattctatgaagatgaattttagtagttgtaaacaatatatctttttttctgaaacacatgagcaattgatttttattagtgggaggggaagaataacattgcactaaattcaatcttctgataaacatgatgttaatgttattaaatatcatagccaattgtaattattttggaaacaagagcagactatgaagtgcatcttgtgtttgcccatggccaacaattaaaattcaatttatacaggagaaaaaaataaatacattatagatttggtgtttaatgatatttattctgacatttatgaactgaactctagtatgtttcaattaacccagtgtaagaggaaacaaccagcaatgtgagggcttatttagttagatacagtgcataggaacttgtcttcatttaaaatttttgtgttttgttcatcatgaatttttgcatcaattttgctgctttaggatattgcattaaaatattatttatctttattagggattttttttggagttcccttaaattttgcacctgaggcaagtgccttattgtttcatcctggtcctggccctgtactgtttagatattttaaaggcaataataaattgtaatatttatagaaatatacctctaggaaaggtttcatccttggcccagtaattagttatgtgtaaatatctctaacagaacattattaaaaataaaaaacgggaaacatatgtagagaggagaagacctaagggcctatgaactctgttgcagagaagtgagaagagagttctgttaggttgttttgcactcaggcacagtgttcttttgacaggtagtgaaacaaaaactgtaaccctattgagattggaggagctctatagccttagtcatgccaagctttgtattttgttaaatactaccaaatccctctttataaagcaatcaactttttttagcgcctcagagtatgccactgttacctggaaagagggggttccttggagaataaattggcagtctttgtaacctcagttattctggagaggcattcaccaaatcagtgatccagagaaagaacagccctcaggcccagggttgcattcagaaaattttcagaggaaatcattaaaatctctttgagtcttttctaaagggccaacttagatgcaatattatctggaactggaaataaaactagcactagaataataaaattttcagtaataaagcatatataaatggaatcagaacatttctatggtaaacttttgttaaaatacagccattagattttcatatgcatggatgtgtgtatatgtgcatgtgtgtgaatgtgtgtattttcaatgctttaggtattgaagccatgaaaagaattagtaaagggtgtatatatagcctataccaattcacatattgggttcaaataggaattttagagtctagatgccatataaggaatacataaagcttaacatataatatgccattaacaaaaatataatcacaaatatttctaaaatgtgtataaagaggggatgatcagagattgtgcaagagactgagactggcctgacttgattcatgctttttctgttacgtgaactttattggatagtctaaagcacatggtatatgcaaaataataaatataaaatatgaagctattacattttactagtgacaatgaaataagcaggggcgggtgcattatgaaactaatgaggtggaaactcccttattagtgtttcaattttaattcattgttttccaatcctgtgagctgagtcttgctttgcttattgagtcagaaacctcagtgcattttcatttgttcataattatagtctgtccatgtactaaagaagcctgctctaagagaaacccaggaaataaattcaataggatctcatgaaacttttagaatattctaataagaaatcacattagacataaatttaattctgctacaattagagaaaagattgaggcttgtgaaagcttgttgaattaggatcacactcagagagtattagaatctgggctagaaccatttctcaggcttgcaaactaaaattcttttcttcatatcagtctgtcatcctgtattctttccatgaatggtcactatgtatattttttactttggctttaggataatttgccgagaagcttaattttgaagtaaaataaagtcaatgtctagtgttatttatttcttttataatgttgttcttgcaaatattctgctagatatgggaaactctatatatttaagagggatatgttcttatttagacagcccagacagaggaaacctgactatttatctaatctgtgctgatgcagaaagtcctcaattcaggattagtcaatgatagtgtaaataagtgggaaagatatgtattgctgctttcatgagcaactgagctgcagaattaataagcacaataggcacctataagctgtgggttgcctatggccctacccaaggagaacggccagttgtaaaattggttagggtgggtggtgtatttatgaggtgtccaaaaaataaaatatgagatctattataattatttggtaatactaattatttaataatatcaattttatatgatttttaatttttgtttaaaagacaatttaaatggtcttgatctgcaccctcttccttaatgctatgccgagggaaatacacacatagcaatttggacagaacacatggcaagtggcagaggaggattagaatctaagtctccagggctcctggctccttagatttctcagaaaattatgcttgtaactttatatggtcaagtaaatttactggaggagaaatctggttatccagatactggaatactaattttggcttcacctccaacccttcatataaacttttttctcatatttatttcttatctgcaaaataatatactgcagatgttatatggaattgtgaattattcacataattcggaataaagttgtttctaaattgccttcaagtatttgtgctttaaagatagattattttttatccatgtggtacaagtaaaaagcaaaaagaacatgaactttctttggctgaagcaatcacgctcatttgtttgtcatcacatattgtgtcttatcacaatgtaatagatgacttccatagtaagttacctagaggaattttaattataatatgagaagttaaagccagagaataaagaattaaaatctaatctggtattaaaactaagaagaagcaaaatagaggggagatattaatacttgccacagcgttataagtttgaaagattaactttatacctatacctgtacaatttttgccatgttttctcttacccagtaattcaatactgtaagttgagtatttaggcttatgaaaaataaatataagtatcattctgtaccttgataatttcaaaatgaatattgagctgatgttgggaaggcattgaatatatcttaacaggacaatcagattattatggctgtgacataagaatgtttctctggaatcaatgcgccagataaactggaaaaggaggctaattaaaaagttgttgtaattgtctaagcaatagaaagaagggcttcattagcatggggacagtgagactaaaaagattgtagaccccattaaaattgccacttcacatgctgttaatttctatgggaagtggaactaaaatgcactgtgtcaagctcaggtaagtggaaaagaagtatacatatcgtgtgtgcgaatatatatcgtggattggatatacgcacattggatatacatatattccaaacttttgtaactaatcttagataggcaaatgtgtataaactttgctttggttgatatattagttcttttaaaaattcatgcaatatatccaccatatgttgactctaatattaatgtttctgtcaaataacaccttcaaataagtttaaactccataaaaattaatacctgagttaaagacaactgaattccatatttgttttatgagacaaagtgctgataaaacactctatgtaagcctgtagcctactccttttctgctctgactggcttggcacttttcgttttagaaaacgatagttaagtcgttttagttttaattttacattcatcctgtacaacagtgaggattcagacatttttccatcctttcaaattctcaaaacctatatttatttttaaaaatataagaatagatgtgtaaacctaggaaatgattttaatatacatagttaacatttcattgactttcatatgttaaatctgtgctgtgtgagcagcaggaagctacagagacttccgaaaacaaaacaaaacagtgttagctttatgatagtgctcagcattcttcactttaaacaatgtttttctgacctctgaccagaaactgtatatatatatatatatatatacacatatatatatatatacacatatatatatatatatacacatatatatatatatatatacacatatatatatatatgttgctattctaagtactttctggcaagtgtgagctgttatccctgttcttaacaagcaaattttgcacaaaaattagagcatatttccaaagcaatgtatcagcaaacattagtttacattatatataattgttagaagcatatctttagtattggacacagaactccagatatgatctcgtcaaatgcaattttcatggaacttatttttgtcagcacacttaccatcttctttctctacaatttaagctcaacgacggaaaagatgtgtttgacttgttctcattggttgtcactgtatttgcaatgccctgaagaagctggagtatagaacaagctgaagtaggcagaccctcatgagcaaaaacatgtaattccaaacaaggaagattgtaagataacataataacttggttgatataggtgggacgagttgatcagggaagagagaagctcaaaacaaattgaagactacatttttttttgtaaaattaagatctgtaagtgaggattggtgacaaaaggaaggagcctcatatttgaaagagctcctcagaaggttgccaagtagtgtggggtttgtattgttggaaaggctctctaaggaaggcagtcacgattgtgatgtctaaagagaatttcaaagactggattcatctctgaatgtttaagggaagacatcgatctatcagtagttcaattattcatgagagggaaatttgcaatctcacaagacagcacatatttaaagaatgattatagaaaatatatgtgatctgatgagagtctcctccaaggagagaaaaactaatggtgattgtcaactttcatgaatattttaacaaataaataaactcaatgtgataaagtctgctttataacgtattctactgcttcctctccagtgtaatttcatgaataactacagaaatcacacacttaactctcatctcaatatataatttagctattattgaatcttcttgcactaagagaacatttaaattatgcttttagtcttctacttttggccttttttttttattacctttctctagttttttaaaatcaaagtttactaaaatatttaaaagagaaattagagcaactaagtctttttaaattttttattagtatggttaaataatagttgtacatatttataaggtacatgtgatactttgatataagtatacaatatgtaatgattaaataaggataatagagttatccatcatctcaagtatttatcatttctttgtatttggagcattccaattcaactggcttaatttaaaatgtacaataaattattgttaattttggtcactcttttttgctactgaacacccgctcttattccttctatcttactatatttttgtacccattaaccatcccctctttattgttctttctaatgtttaataggaaagtggttatttatcttgatctactatatggaggagagattttaaaaataactttagatgctgtatttggaaggaaactaacatatttaaatgaagaccacaattaaatgtttttaaatataatgcatgtttctttaatataaatgaattatatataatgtaatgtatatttcctttggtagatattaatttggaaaaatttttaggtatgagatataattacctagaggcctagaaacttgggtaagtagtttatctttagttctataattatttttttccattatattttgggtactaaataaatgtctctttgattacagatctaagcctgatatcctagtagggaataacatatgtatattaggactaggccacggtttatctttttttctgtttactttttacttcatttgagaaatcgtttctcctaatcacaagtaaaatatgaacatactttaagtctggaaatcagcaattcaaaaactaaagtgtacaaatacataaatccatgagtttaaagaaagacagtagaaagacagagttacataataaattttgttatgtgtaggcaccagcaagttttttcttataaattaagacctaagttagacacaaataactaagacaatggtgacttgaaatgctagaaacattgcggggtaacattgccaaaaacaagtaagcaaacaagaaaaagccccagagatcaatgtgagtcaaaaacgtagtgtaagtagtatgttgtcactgcatagttacttcatgagtcaattacagatatagatagatttttaatagtataaaacaaaagttttttgaattatacagtgtagcttattaattatccattgtaaaagttacaatagcaactatttagggcatttgcctcattccacatgttgtatggtaatgttattgcagcccaaagcactgatatttctctattattcctttgttttaaatttctattcttttttatttaaaatgggccacaaattatagtttctgtgttatactagccagtgtacagttgggactcattactgagtatagaattctacaacactgtaagacagataagatcaagagttctcaacaagagttggacacataagataaaagtaaagcctttataacaaaccaaaattcactgaattgcacacttaaaatagatcagttttggggtgtgcaaattatatatcaataaagttacttttttttcttttgttttgttttaagatagaaccaggagaggatttcacttccagccattattgatttgtgactcgtaattcttaggtcttctgtgaaatactgtggggtcaattactcatgcctcatttttatattttgaattgctccttttttccagatacattcccaactttaaaaatgcccattgagcttacattcttaaaaacaaacaggaaacaaacaaaaatctttctctatccctacttccttcttttctgacttctaagttttagacttaagaaaggaatagtctctgtattatttcaacatctttaacacctccctttactattgggttgagagtgactttgcagaattcaccagttactcttgaattgccagctataatgatttctgtacaattctcatttttctagaactctatcaagtaggcgacacacttaagaaactcttttcattaaagcagtttttgtttttggcttcagtgacctatttttaacatgttatatattttctctggccacacttttatactgttattttgttttttgtttatcttgtatatcccacctctcccagtcttaaattcttcccacttatgtcccctgattctcttggcattaactgtcacacctctataaaaatggcatcccaaaccctaactctagccttgacctctctctttactttgggtacatatattcaacttcctttttgatcaatataacatttctcactaaaccttaaagcgaaaatcatctgtctttctccagactctatctccaatatcaagtaatagcatatccatacatctagtcaaccatgctaggatagtcagggtatctaattactatgttttttttttttaattctctatatccaatcagttaccaagtcttatcaattctatcttgaaatttcttttatatatgaaacctttctgtgtgtatataataataagctcttcctaggacttaaaggaagggaaaggctaatgttacatatgctgtctgggaacacagcatttcctgaataccttactctttggtaacacctaggcgaccctcctggcacagagtttagcctaatgtaaaagaacaagtcttcagggtcagcacaggatgagtactatcacatatggcatattgcagtgaattagaaaaagattccttctgtaatatacatccttctttttaaaaaagtcacaatgtaaattttttaagaaaaatatattttactgccatctatgggaaaaagtctggaatgaatatacaaatctgcattgtctatgctctgatatgtcgtgttctaaggggtgcataaactgcatgagcacacatggtagctctgcgtaatgctgtgcttttcaaaccccggtccaactgtttagtagcttaaccttggtaatatactcaacaactttgagcttcagattcatcacctatggcatgattaataacagtctctttcagtcagtctttgggaagggtaaatatggaaatatgtataagtaataagcaacttcaaatttacctgtagatgtttccagtctactgcctcaaaagcacatcatgacaagataccagattatggaagtccttacgctaatgtaaaggggcaatgaaaacactgttggttttaacatttcactacaaatcattaaacatgtcttcaggaatatttatttgaggtcatttcaaaagaaccagaggaacagtcatcctatttttttaataactcaggatgtagcctggaatctaattgtacctgaatgttggacaaaactatgtgaaggcttattaccaaactataaaaaagtatcttggcttcaccatttccatgttatcatcatattttattgttctcctatttcagaggtcagcaaagcacaggccatggactatatccaacccctgtactgtttttgtaaataaagttttattggaacatagccacatgcattcatttatatacagtctaggctgctttcctgatacaagggcagaattgggtagttgtcacagagaccatatggtctggaaagaacaaagtatttatctggcctttatgcaaaatatttatgaacccctgattttttatccattttaaaataccaattcacttgactttccattttgctcaattctacaaatagacaaaaaatattatattaatctggagcatattgagtctcattttgcctttcaaagtatcttttatgaatgaacataaacctaattatagcatgctggcttaaacacgaacaatcccttaggttttatcttaaaaaacaaaacaaaactaaccaaaaaaaacctaagacaaagcaacttgttcatttttgccagatttttattggaactacatagaaaatatttcctataagaaattggctctcaacgactgattgttttgtcattaaaatataatagtggggaaaagtccatttagtagttttagaagagccatgttatttgatgatacagtgactgagttagttgcctgtttgaaactatttttggttgatagtcaggaaattccatgagtgcctacttcattcattaaatcaagtagttgaaacctttccttttcatatggaaaaatgactaaaaattaggcagcatattgttatggaaaaatatgaacagtcaggtagatgtagtcttactcaaatactagctgtataattttgggatagactttagtttccacatttctgaaagcaaaataaataatctttatttttttaaggatttttgataattatgttaaaatcttagtaaataacagtttcttaattaatagtatggtaaagattgagttcattaagtaaaatatgtcaaatttactcagaatattcttcaaaaagtctatttctcaaatttccccgtctgtttgtgtgaatttatttagcaatttgttttgtgtgctacttctcattcttaaaaacaagttaagaacttaaccttactcacctttttccacttaccttttaaaataattctaccaaggacacttataatttaaaagctagttgtctggtatcatttggatgtgtagatacagctaaaggaataattagttatggagtaagaaaataaacagcaaaccttaagagattaatttttttattgagctttccgaagtcctaaacatcagtggccagggattgaaccttaattataagtacagcctccaaaagcattgctgtcatttaagacattcttttaaatgtgtttctttagagttaagccatgaaagtgaagttttcctattattgactgtaaaacagttaagagatgctttggaatccaacatagaagttcctcaaagttaaatgaaaataagagcagaagttaaatctatttttaaaagaagaaattgaatataaaaagtgtcattgccattgatatcaaagtgcaggtataatcatagttcagcaggatatattttagctagattatgaaagcttttcacagatgagtgcagttcaaagcaatctgattctggtttctgtttctgccattgttatgaggactcttttacattggaagactaaatctccccaaacaggtgtcattctggagcaaattgaaagagtttgagcttggattatagtgaggattcctaagatcttctggaccacgtgtctttctcttgaaaagccttcagaccgaagtgtgttctctttttatatcctattctagaccatagtcctaccatgcctaaaagtgacctgctttggagatacggctgatcagtacaggtatatggaagaaattctctgtgaattttgtaattcacaaattttaagaagttgctacaattgtacaggatgatcatgggaagctatgtatctcagtttgtctacccaagatgggcatcctgggaggatgacaggtgaacttgtcacatacatatcccaattgggaaaaggaataaggaattatctgaatgattaggttttgaagtttaagacccctaggaattcaaaatattcgagaagaaaattctgacaatgatcaataatttatttagttaacaacactgtgggcagctacaatatggtttcagctacaatatggcagctacagtatttcaattgattcccatgctacctatcaaaataaaataaaatttgaaagtctttcttatatttgcatgtctgatattttcatagagagtgccattgtgtgagaataaaatgtcaaattctctattctcgggaggctgacatggagggatcacttgaggacaggagtttgaggccagcctgggcaacacagtgagattccatctaagaaaaaaaaaaaaaaaaacaccaatcctcatttcaaggttcatctcaaaaatccatgaatcaaaagaggaggcctttaaggagaggttaaggcattctattcaagcctctttttttttttcagaggttcagggtttgttgagtaggaaggtatgatgtggctcctggaatgatgctcataccaaagggtagaattttcatttttaaagaattttgtgcaaaaatgatggaaatcttttttttttttaatttctaagggtgatatgactcattaatgcatcaggctttcttttacactagacagcaatcacatactcactactaaggttacctctgttagcaagaggtatctcatctataagcagctaataatgggaaccaaatagatgaaataaatcagatgtgaaacaaatataagaccctcgaaatgtaagtgaccagcaaagagaatagtgcatcttgggacataagctatgactatattagaccttcaaagccatatttgcacagataggtaaagtgctaggaacaggtgaatgcacaaccgtacctgtgggacaaaaggcctcagatgagataaagagtgaagtcagaagaagagagattttatataagccaccagaagacacaatagcactgcactctcacacttgggtctctgtctctttggacatctgtcttgaccattccaatagaaaatttaaatcttggttcaggctgggccattgatcctggtcccagtcctctattgagtatgtgtcagagattcctgggtgaactttcctctcttttcctaagggttccatgggagacaaatatttcttctgcatgtattaggaacaaacttaaatgtggtacaaattttgttattttattatcttgtatgggctaatgggagggttagtcattgttaaatttctgcctcccattaaatttcatcattaatcaatttttttaaaccaatatctgggttgaaatgagtcaccaaggtgaagaactggaacataaaaacccaaaagcaacatgatcaagtgaatatagcagaataaaaggccctaaatttaattgtttctgtgtgtacactgtgtcttctcaattgttctctattatagtcagaatggatccttattgatttatttaacgcatgtttatattttggtttctgcatctgatctcatattttctcaggagaatataatgcttttcctttagaatacaatgttaattatcaaggtaactgagatttggaaatttaatgggctctttctgttctcttcctactattaattttttattagtcatcttgagagaataaatatttttagaataccatctgaatataattttgtcttgtcacatgagaaattgttaatttttgaagtttaattttgttacataatagtaatttgagtgaaaccatcccctattacctatctatcaatatgcacacatattttttaaaagttccaataatagtgttgtacatcataaagtgggacaaattcagcagtgatattaaagtattatagttttatttgaagtattaatttctaatagaagttgataatgctgagtaagatggtgttttggatatgaaccattaacaggctttgaaaaaataaaaaaaaggtcaaacccttttagcttaaatgtatttactgattttataaatgtaatttatgaatatgccaaaaccttatataatagtcaaaacaacaacttaaaacttcttagggattaaaatgcaactgatcttctatagaacaaattgaaaatttttgctaaaagtaagaacattttaatcttctagttaactaactataatttcataattactgatttgtagatatccactttggatcatttctagtgtagttactagatgaggtctgtctaacactgaaatttgctggagggacaattggaatgatgcatatttgaggaaaatttaggaaaattgggttacccaagtagatggaggtgtatggacttattttgttgataagagaaagtgatttttccagcttcataactgatcccctgattccagtattctctacctgaaaaataatgggctgcattttataatatcatagttgagtgaaagaatccacaatctatatggggtagccaaataaaaaaaatttaaaatgacgaattgtctagtttttccaaggtataaaatgatgacttaatcctaacagaagcaatagaggaagggtgtgcatgctgttgccagagacataaaggaaataaatatgacagtatttatgatagattagatgaaaggaataaagaaaagaggagagaaattggttttggggtttcttctatagcataagggaaattttcaaatgaatgtaagtaagagtataaactgttttgttagagaacaatatgagtttggtctctattttgcttttaaagtaccagtgggagctcagcttcatttattctataggacatagaaagtcgagtgaagaatagagtcaaagattgagtcctagctccattaaatatatttattaaagattttagagtgggtgatttctctgaaagaattagtataacaatagaagaacataaagctggcattttaaacataattatcagatgaacagttttgaataaaatatagctgtgtgagatcaaaaaatatatgtgagaagatgcaagctgaaagccagtcttgcctcctataactgactcaaaaatctcaaaagattttgtgagttttgaatttgttttttgttagtttgcttgaccttaaaatgttgacttctacaaagtgaataaagtagattaaaggctgatcatcagactcccttgataatgcaaattacatagaacacaactctagtaaacatcaatttcaatatgttattgacaatgtgacttctcttaccttaagcattttctttcatatggtattatcaccattccagtaacaatgtttcaggtaaaacatgatttaaaacaacttgtattttagaatcacaacactcctttactcgttgtgtgaaacacgtaaatcaggtaataaaaaaccaaatagatgaataaagaagggaaactcttcttatgctagaaattcattttgagagatgtcattcattaatgctgaggtaaatattataaaaatgaaagacactttttcttaacattagtaaataaaatatagatggaaattatatgtgtaacatagttacaaatttcttaccaattaatttctttatactgaccatcttcacttgtagattaaatttgtcaattttatgctaaattttcagctaacagtaaagaaaaatagatattctcttcaagattcccacagtgtagttaaaaatgtcagctatgtaaacaaattattacagcatagtgtaatcccctgttacagaagcccaaagggtgctattactcattttgactgggtggttcaggactagggaaaatatgaatctttatcaaacttctaaaagaaaatataatttctgaatttagacctgcatttgtctggagatgagtcttcatatggcgctatcaatatatttttagaaagtggggatttaaaatgtgaaacttgcacctgtggtctgctacttacttttctcacacagcagttcccccaatagtagtactttagttaaatgcattaagaaattgagtggaaaagctttggtaattgttttatttaaggtaatggaacttatatacaggcaatgcaatgagtcacttcagtttttcaagataaattgagatagttttaaagattatatcgagggttctctttctggcaggttataaatgaaaaactctaaaatgtgactgtaagaaacttgtttttaaatgttttgctgagcgggctagaaaagaaagtattccaagaggataaagatgaagtgaaagcagggaccctgagaggcaagcaagtgccaagcttggaatgtaagataaagcctggtttgcccaagttggagactgatagaaaagctccccagagagcaggatcccaaagggcaatactgtaagaacaggttcaacagggtcgtgttctatatgggaaataaacctatcactgggaatatacatcaaagaaatgtacttacccacaccttcccactgattggattggcacaaatctgcccttagaattcagaaatataaggtagctttcactcaggtttgggggcagaattcacctgcgtggtccaacaaacctcaactgatacttttgtgtggttacagattcatagtcatggggtggatgcaaaaggaatccttcgtagtgtgaacctaaattcaaggcatttcctagatacagttctaaggaaatgagtaaatcatctgaaaattataaaatgtaaaaaataaaatagacttaaagctaacaaaagcatgacaggagatctagacttacaaagatttcagatattggaagtatcagacacagaaaaaaactatttagtattatattaattttcttttgctgtctgtattgttccatttttgcatcactatgaagaaacacctacagatggggtaatttataaagaaaagaggtttaattggcccatggttctgtaggctgtacaggaagcatggtgccagcatctcctcagtttctggtgaggcctcagggagctttcactcatagtggaagacgaagtgggagcaggcacgtcacgtggcaaggaagggggtgagagagaagggggaggtactgtctcacctgtctgtgtgaagagaccaccaaacaggctttgtgtgagcaacaaggctgtttatttcacctgggtgcgggcgggctgagtccaaaaagaaagtcagcaaagggtggtggattatcattagttcttgtaggttttgggataggtggtggaattaggagcaatgttttgtgggcagtgggtggatctcacaaagtacattctcaagggtggggagaattacaaagaaccttcttaagggtgggggagattacaaagtacattgatcagttaggatggggcagaaacaaattacaatggtggaatgtcatcagttaaggctattttcacttcttttgtggatcttcagttgcttcaggccatctggatggcttagcttgggctcagaggcctgacagtaggatactcttttaaacaaccagatctcacattaactaactgagggaggttcacttattaccatggggatggtgctgtcatgtatgagggatctgcccccatgagccaatcaccttgacctggcctcacctacaacattggggattacatttcgacatgagattcagaagggacaaacacccaaactacatcactgccataacaaattatcacgcacattgtgtcttatgacaacagctctgtaaaaacatagttctgtaggtcagacgtccagtatggacattaccagactaaaatcgaggtattgttaggttatatttctctcttgagactctatgggaaaatcattctccgactcatttgggttattggcagaagtcagtttctgtggttataggactgagctccttattttcttgtgctgctctaggttgaaggttgcactcagcttctaaaggccaaagaatgcctttgtgtaccacctcttcatcttcaaagccagcaacagctgattaagtccttctcacatcacatctctctctagccctttcagtctaatctggcagtgtttctggtgatatgaaattctcaacaactctgtgagtgtcttgtgtatgtcacagggctttacttcattagataagaggcatgtccatggatctttccaaggtgatcccttcatttttggcttctgctgagatggctgaagggacttataaggtagaagatgtttacaaagtggttgctttgaatattattagtagaagtatgggcattagagactgtccaatcttcagaactggaaatccaagggaaactgaagcaggataaattaaaagaaaattatgcctaaacacataaaaataaaatgcaggacgtcaacaataaagaagaactggaagcagagaaacaagggaaagcatcagtgaaggaaaggcaattggactgataacttctaaattgcaacaatggaatccagaagatactagaatgtgggatctatctagaagattccatctctctgtcaataccttccatgtcactctgctcacttccatctttcagttatacattatttaaccggcctcattattgtatttattcccttgtcctttaaattcagtttagcacttctaatatctaataaatgagtataaatctgtgtcacatatttaattattcatttattcaaccaatatttgtcatcagctcactatgatgttcgttataggccaagatttactggaatactggggatatattaaaaaatctgcctctatatcaagttatttatttatatcaatttttccaatttagaagttgtaagtataaagtcatactgttcatcttatttataatataacctctcaattgtttatcacttaaaaacctttatctttataacttttatcttatataattttcgaacaattccatggtctctcctaaatgttacagttgactcaggacttggcagctatcatcaatcaacaataatttgtttagcaccaaatatgtgctcactactctgcttagcacttttgggcacacggggaaaagtgttacagcacagctgcatctttcagtgtcattagagactattcattatattgcatttggcagactctgctttttgttatttttataattgaattattttggatttttaataacttctagttcctcatcacttgtattagaataaattatagaatagatgttcaaagttgttgctttatttttctgagcatgactaatataagaaaatctcatgacttttcatttcatttcatcaaaacaagaattccttattaagtaaaagtaaatccaggcagtcacagggatttagtgcctgagattcaatgaagaataaaataaaataactgtgaattttttcataaagcaaacataagctttattttttcccagaattacacaatgacattcacctggaatgtaggaaaacattttgccaaattctagatgaatttcattgtgtgattcatctggaatttaacattttgctgaatttaataatttactaaattttgctggatgtataattttatctggaaaatatataatgtggcatctcttatgtagaggatagaatattagtgttaaacagaattggtttgaaccctggctttgcaaactactagctgtggttgcttaggcaagctgtgtatctcccctgagcctcatctcactattaaaaataaaaaaatactagaattcaaactcagtcttttttattttgaattatattaactccaaacttggcatgagcatatttgcagaaagtccaatgtctcctcccatcgtccaagattcctagagaattgctccatctaatgttatctgccctgcttccaaatgccaggctcagagaaaaccaggaagttcatccattgatttctgtcactatacacacagccgctatggaaaaatagttcccagcacattctaactggtgattttgcatgctactgaaacggattcctcaacacttgcgagcttcatgataccatctgtcatgtagaagcacctcagccagtgttcctacatgtccaccctgatgcagtagccaggacaggaaaggctgccagcttcagcccttctgcaggagcctctaaaccacagttctgagcctggccatgctctcctttgcctcatggtgacctatttggggctcctgatagcctttcctgccagcagcctcagtcaagaacagaaagacttcaaagaggttccggtagcattaaaatcacaaaaggatccttctccaacaaccccaaatgaccccttggaaaatttgctaacacctctgtgacccaatcttgaggaggcttgagtcagccataatttagcagatcataaaaggacctattattaccttcccccagggaaatagatacctcctaggtgactagaggcaagtaaagtgactgtttaaagttctttctaggtttaagttcactagtaaagcttctctttcttttatgttctgcctcatcacatatatcatacatcgtgctattgttaggattaatgagatgacatatgtaaagtacccgctacatagtagacactttatacatgttaattttctctcgtgttcgatattcttaatttttaatttagatcttcattgctatttttcattttcactatatcccacatgagattatagaatctatagagggagttatgtcttatatatctttcacatccacagattatttagtataattccttgcagttacatattaattgctatataattattatttcagtgaatactttgagattgattttttccatatatagataataaaatctgctttttaaatttctttgtgtgactttctgctatgaaagttattactctgagaagaagcttggcaaggaaaggagatgaatttctaatccaactatttgcattttgataactgaatcacccatcagtcaataacacttaaattgcttagaaattttcttgaacacttgaaataatgggttcccttctttctcagaaatggtgaggcaagaatacatttgtaagaggcatactgttgcaatgaaaacaacctaaagaaattgaaatttgaattctgaatctccactgatactgacaagggaacaggcaagtcatttagtgatccttatttggcaaaaaggggatgacaatgaaaagatcattataaggattacagaaaatacatgcatgctgtgctgtgataggaactctttaatttaaaaaatgcacacacatgttgaaaaagttggaaaataaaagaaataactcataatctcatatctcatggataagcttttgttaacattttgagatattttgagttcatatatacctaaattttaatatcctattttttacttcatgtttcattgtgttgaattttgaacttttccatgttgtaaattcttcaaaaatattattttaatgctatactttatataatgtggacatttctcatggttataccaaattttttctattgtttaacttaaaataattgtattatcatttttgtaaaatttccatatttctgtatatttccttggaaaatatgatgggaacacgtggaagattcttactttttagatttacacctttgatatctgctaacttaacatttcttcttccatctaatcttgaaatacctccacagacccatgacttgtataaatctattattttgctgatcttcccacatgtgtgctgcccagggctagtgttaatagcatgcactttgcctatattaaggaagtctagcagctgcatgaccctctgcttccttctagctgcaaattctagtacatggaaagacttgtgcaatacatgtgactcctgctcttaaggtccagacccaattggcctttgagatttgtcacatccagctgatgccccttgcttcctctaaaaggcaacacagatgaacttcaggagccagggaatctccccgacaacttccagcggtgggcagtgttatggataggaagccacatgcccaacttgacccagtgagctgttaccacctttatgatatgatcacttcattctaccagaagagctcttagaaaacttgacccctagattagagctttcaatgaacatctatggagaatttaaatgaataggcactaggaattttctctgcgcatcactatctcccttagaaaaatagactgctttgtcctcatctcactgcctgtatgtacctccttgccttctcactgctgtccagactttggaccctagcagcactgaaaataccagggatactgctgcccagtaaactgcaggcaagaagggtgtacagcacccctcattcaaaaccactttccaatcttaggggagaattttctgtccacatctcctgtcccaccgccaaccaacacaagaaaggctgcgatgtgaatctttttttgtccatacattcttctctccaagtctgtttctgaagcccctttaaaaattctttccatgttaaaaaatcccccaaaactaattctacctaattcacatcaatgaccttaattcaaactcaaggaagccccttgtaataattaaggtctgggcttttattctcagttagccaaggattgtcttcatagaatccctgcgttttagtctcagccacagtttgtaaaagagaggctttccggtagtctatgcctggggttaggaaagaacactttcctcaaattctttatttcatattctcacaacaattttgttattacttgtttccgttagcgttaataactaccctttttaagtgctctgtttcacaaatttaatatttgcacacattgatgcctatgatagatatttagttcatcaactttttttgttttatattttagcaaatgaaaagagactcacttttaacatggcattagttacctttgattttgcttaacccatgtcattgtcttatttccagagatggtttatcaccttgttcctgacaatacgtatacgtagagtaattgctcacctcaattaccaaaatatgtcccaaattctctgctatggtctaaaattcctgtggtcaaatttaccacttgaattgttctttgtaaccaaagttggatcattttctctactagaccagttaaaatacatgtgggcactgaatttttcttttgatgaagggatgttgattcagttatcagactagcttaggaataaatttgggtggacctaagaaatacatgtagactattcctttaaatattgtagtcatacacctatattttattactctaaaatctacaatgttcgtttacatctataatcatttttaaccctcacaaaaaactgtgaattatgtagcttgtgcacagagctaataaatagtagaaactacaagataacgtagatgtcactttgttaagatacgcaaaaatggtctccaaaaatatactacatgtcagaaagtatcctacccacatcttcccactgagcactggaaatgatggctgactgcatgatatttcaatgattgggagagatgtttatattgatgtaaataaaataagggctgaaactcctgaagatgtagtctgatcaatctactcatgtttcagagtacttgctatgtgctcagcactgtttagagttttatgggccattcaaaagaacacaatgttgttctatttatcaaatagctcataatctgtgtgaggaaatcaatttaacctgaagaattattagaaaaaataatcaagaattcatagaaaaaaattaatattagggtttggagcactgatcatgcaggaattccgaaaaggcaaagaacaataggggctggagtcctcagaggatgattccttgaggaaataacacatgagttgagctttggggagaaatgggacccagcagcacccaaatctcagctcctccacccactttttaattttgtttggaatgttacctaaactccttgaaccacacatgttgacagtggtaaaatgaggaggcaatgcttattttacttattgtgactattaagtaagatgttttatagaaaatacaagtgcttgataataacaaaaatctccatttcttttttacttttaaaatctattatttaaacttgtttactatttaatgacttttatttgtctttcttttcttctctggacatgtaaaaggaggtaatgaaaaacattcaagaagacagaaaatgaaaattattgtaaaccacagcactaaaataatagatacagaaagccttgaggacacagacttatctgtgggttagtggaaaaaataaattcttgattttcaaagactacctctcttctactttttatcttgatatataattatttgtcttatatttattattgaactatgaggtgttgacttttgtgggtctttttagttttaattgtttatttttatcctccaagacccttggcaaaattccttgcatatagttttttaggaaatgttattcatttgtgtattcattaagtaaatatttcttcagcagtgaaggaaaccaaaaatatttcacccgaaaatatatttctttggcctattttgagatgactattcagacgggttacagaccacaggaatagctctgaaaagcttccctttgtggggggagatttgcatttgtagggaaaatctacattagtgaaataaacagccaggctttctccggagtcctccttagcctcatctaaaaaagattaactcacagaaaaaaagagactcagagtctaacaatcttaaaggtctgatggaaaaacttaccacaggctagcgtctcatctttctgagggctgctacctgtgaggcttcatctgagtaacaagaccatcttgctggccacacctttcctcctttgccttctgtaacctgtcttgccatgctccaatcctttattttttctgtaacctcaggatggtatacaaacttcaactatctggctcttcttttgagtcccacactttatgcatagttccggtgtccatatgcacattaagagaaatttgtatgcttttttcccctgttagtctgtcttttgttacagaagtgtcccagctaagaacctatgagagttagggaaagaaattacacattttgtccccgtcagcacctacttgtggggaaaaaaaaaaaaaaatcaggttgtatatgtaatgtggaaccagatcatgaaacactttggactctgacatcaacattttaaacttataagaaaaacaataatgcccttatctctttctgtcactctaaattatgccttactctagcattcttcaaagagcataagccaagctgtgtcatcctttagtacttcttttatgtggcttcctcttcctggaatcactcccctgtctgccacctggaaaatatctactcttgtcccagcacttagatgaatgaaacattttctgaccttctccttccccaccccttcagggaggttattctagtttctcctttctgcttgctctgaatctagtacttatttttatcacagccttataacattattccatccattcgttcaaatctttttctattataatgtagtactattagaccgcaattacttttgcaccaacctaatacattagaaatgtaaatactagggaagtggtggtaagggggaactcatttgcataaatttaggtcatttctcttatacatacctagtaagtgttccacaattcaaggttttacccagatgtgcgtacaacctgaaaatcttcaggatgctggcaaaataagaaatttagtttaataaccctatcattgtacaatgaggaaaccaactgagataaataggatcattgagcagcactttgcatgaatattttttagttatgcctgtaagagacagcaacattatttttgtattgctgaagtgctttgagagtaatgccctggtgacagcataaacaaaatacaaaggccagtttgtttttatatataaatgggggattgttggtgaagagttgtgccagccagtacagagtggaatagtgttttattcctctcaagatagatagatggctgaattgcccaagttcctgctgttttatagcctgccccttgaatttaataatgaataactacttttttttttttgcatggttggtgaggaaatatataatttaaatgaaactgaacaaatcatatcatcactaaaaatatgttcacctgatattttacctaaatgatatattgccaaaaatattaaatatcctatttattaaacattatggggttttcaaagtaaattatgtctttattaaaatggaactgacaccttgttaatgcattacacttttaaaatgtacagaggtttacagcacagagagatggagaaaagttactataattctgaaaaaagagacgggaaagcttacttctagtagctcccattgggaaggagtgattgggaaaggcttctcaaacagaataaacttgaaaagtgagtctgccaattgaggaaggaagaattagaagataagatttgagtggaatcatggaggccattgcacactatgagagaattttatttttgtttgatagatataaaggagttgtgattattaattttatgtgtcaatttggctaggctatagtacttacttaaccaaacactaatttaggtattgttattatggtattttgtggatgtgggtaatatctgcaatcagttgattttacgtaaagtagatttccctccacaatgtgggaagatctcatccaatcatgtgaaggtcttaagagaaaaccctgaggattctcagataagagaaaattctgcttcaagactgtaggatcacctactgccaagttttgagcctttcagccagccttggggatttcttacttgccaaccctacacccacatcctctgaaccaattccttaaaataaatctctgtaaacatgtctacatgtatacacacacacacacacacacacacacacacacacacacacacacattttttttttttttttgaaacaaagtctcgctctgtcgccaggctggagtgcagtggtgcgattttggctcactgcgacacacacattttattaagcagaatctatacatttaacagaacctatacatatagattatatgtgtgtatatgtgaacctatatagaatacatatattcaaaatagatgtatttagaatatttaaaatatatgtattctatttataggcacatatatataggttctgttggttctgaaaaatacacacacacacacacatataatgcttattctattgtttctcttaaaaactaataaatggaatcaggagttataacaagttttaaacaaaactatacttattacctttctggcagaaattagattctgtaattttaagctcttattggtcattagtttatgccagatttatgctacatgcaatacagtaaacagaagcataaaacaatgccagttttcagggatttctgtaatcgttgctaacagtttttatcacttgtgtgtggtaggcaatgtgctaagtgttttttaaattttttacttaagtaatcaatgcaacattcctatgaggtggatatttttaacatagatattattatatttgtaatttgacagatgaattaattgaatttacagctagtaaatgtcatacccagtgccaaacctgggctataatgcatgaaatatgtattctgccaccaaaatgcacatctgctcatgtaatacaatttaactatgatcgatgaccagtgaacaatgtaaaaccatgcttttaaatattcataaagaaaaacataggtagctatatttcttgtagaaaagggtttctaagcacaggaggcttcatgggttgtggaaggaggctactggcttaaccactaagaatagagaaatagcatagaatgtgatgaccagctctaagaaacattaaagcaatcatggtatttcaaaacctccattaaccaacttcaagtcatactttaatagatttgcttcagacctttagactagggctcttcagaatacggctctgtgactagtaacatcagcctcaccactacccgagagcttcctagaaaagcaaacttggagacttcattccagatattatatatcaaaatctctaggagtggggcctagaaatctgttttaaacagctaagtgatctatgcttgggttaaagttcaaaaagtactgtactagaacaacagggctgacaaagaagagtgccctgatgctgaggtgagcttccccagggaaagcaaaatgaagacatcaagctggagtgaactagaattaataatggttaacgaatgttctgtcttaggcatcttgcaaggtgggaatctgggacagaaataacttcaggagagacagaacttaaggagagtcatggagaaaatgaaattctctcacttaagtgaaaatgagttcggacaaaagtcagaacggtaacaccacatagaccaaaaaggtcaggactgtgtgtgtctaggatcaaagcaaggttaacaatgaggacaaagcttggcaagccaaggagacaaaagtcctgggacaaaagaatcactattctcaagagaaactaaagatgtaagaattcagagccacaggtctgaagttgagtataaactaattatttggaagtaggcagcccacatctattagttcaaccctctcacagttgtcaattccccatcttattagcacctaataaaattatatcttgtgccactggtgcattcacctattgattcaaaaaatatttttggcaccccctatgtgcccaatacagtgataaatagcagagatatgagggtaagtgagacaaatgtgatcccagacatcaggaaagagatactgaataaataattacacaagtaagtatttaataacaattattctaagttctacctagaaaaagtatggatattgtgagtatcacaggacacctaacctatcctgcaaggaagactggtgggaatatgatctgggagtttttcagaggaagtaaattttaaataacaacctcagataaggtgttagctaagaaaagaactggagaaaagcatcccaggccaaaagagcagcttatgcagagacagagagtatgttaggatagagtgggagagtgcccagggtgactggaatgtagtgagtgggggaaaatagccaaagatgaggctagtgatgatacaggacctgccatggcctgttgaagacatagcatagcatcatatgtataataagaaaacatcaaacatttttaagctagtaaataatgatgacactgacattgagaatattcttctaggtgctctgatagagttttggtacagagaaatcttttaggagtttattgcaatcattcaagcaagggaaaatgatggcttggactaggttaatggcgatgaggagagaaagaatacaatggattcggtatatagttatgcagtacaaaacaaggtgctagtgtccatagaggaagaagaaaatataaactatgacatctaagtggcagatgggtggagactggtcccattaacgagaatagggagaactggaagatgatcccattttatgggaaatgtcaagagttcaattgtgattgcttgagtttgagatgcctgtatatatacccgagtgtaatataaaatacataagtgggttaatgagtctggagctcagaaaagaaatttggactggagatgtaagtttggatgcattatacatgatagatcatgttattagagtggatgaaaatatctagggagagaggatgaaatgagaaaaaaattcttatccttcaaactttaaagcatgataataaaaatgttgcactgggaaaggagactgcaaatgaatggacagagaagcaaaaagaaaaggaggagagcctgtgtctcagaagccaggtgagatgttgctactgaagagtcattgattgtgtgacacagccccagaggtttaatcaaatggagtgggacagacagattcactatcttttgttttcctatacttactgtactttcttagtcaatcttgcccaactaaagactttttttcagacaaacaaagctgcacaaattcattgcctatagacctgcagcacaaataatgcaaaggaagttctttaggtggatgatagccaagggtgttccccagagcaatggattacgaaggcccaaggtataaaagtctatattctaccactcagccattaaaaaaagaacaagatcatatcctttgcagggacaaggatggaactggaggccgttatccttagcagactaacacaggaacagaacaccaaatactgcatgttctcacttataagtgggagcttaatgatgggaacacatggacacatagaggagaacaacagacactggggcccaccagagggtggagggtgggaggaggaaaaaattcaggaaaaataattaatgagtactaggcttaatacctgggtgatgaggaaataatctgtacagcaaatccccatgacataggtttacctatttaacaaacctccacatgtactcctaaacttaaaagttttcaaaaagtccacattacatccatgctactctctagtcagaagcagaatacaatataagcataacattctaacttattttttaactttatgtatatatgtatatacataaagatcagtaaattgaattactgttcaagtctcttaggttatcggatcattactgaaggaaaacaaggcattgaaaagtttttggaaacatgagatttgataaatcatggaaaatatataggaaaataccagtcacaaataaatctcataatctatagcctaatattgcttgataatatatataataaaatatattacttataatcagatgtattatttgaagtttgtttaattaattgatatttttatacttgatacaatctattattgagtaattatttaataatctatatataataaaatccatcactacatagaatttgcactaaaattacctgtatgaccaagtcagagtatacaaagggtaaaattatgataaatactgaaattaaattaccttaaatgcctgatgagtttattttttcctctcagcattaagaagttggtaaaaattgatataaaaattagcaaacactttaaaatgtgtcccattttttggcagaacataacccttgtgtttctacacttggctctccttgtgagagataatattttctgaatcattgagacctgacaaaacaaaaggcttcagaaaatctggctaaattcatcagccagtcagtaagtaagcatttattataaaccaattttatgcaagctctgtactagatgtgtacaatacagaagcataaagcatggtgacagcttgcataaagtttatatattaatagtaactaacaactaggagcacttactatatacaagcactatgcttggtacgtttttttcatgttctttcatttaatcagtccttacaatattcccatgacataggcattattattagtagtagtattttcatttgagaaataaatacagtgaggtttaatgagcttaggtaacttggctatggacaaacaataactaagcgtacaatatgacattaaagtccaaagtgtgagaaatgaaagttcatgcttttaacaattaaatatactctctctcccactttacaactaattgggaaggtgatatagtttggttctgtgtccctacctaaatctcaccttgaattgtaatcctttttatccccacgtgtcaagggtgggaccaggtggaggtaattggatcatgggggtggttttcctcatgctgttctcatgacagtgagttctcacgacatctgatggttttataagtgtctggcatttcctctgcttgcaatcactccatcctgccaccctacgaagaaggtgcctacttctcccttgccttctgccatgattgttaagtttcctgaagcctccccagcaatgcagaactgtgagtcaattaaaattttttattttataaattacccagtcttgggtatttcttcgtagtagtgtgagaatggactaatgcagaaggtaaggaagatacatttgaaataatgaataatacaagttaggaggaaaaagtgctctttaattatccttattaaaaaataatattttctactgttaagcaatatttgtgaaattattaaattaaaaaatcagcaggcttcccagacaactgaggttttctcacttttgatagagaagaaaagtgacggcttaatcattgagagtacagacatagatcataccctggaaacaaaaagttagaaaggttaaaggcataaagcgttttcaatatatctggcagtcgtctccacatcagatgaacacatcagccttaacaactagaaaaataggagccagctaagaacattctcaaagagctgaggagaatctccctggagaaagcaaagtgaaaacaacagacttattagaagtaataacagctaatcagtgttctgtgttaggttgagcatgagcaggaatccataacagcagagaattcaagtaggttagggcataggtaggattgtggagataagaaaactttcccacataagaatgagtaagtttggacacaaagtcagagcagaatgtgggtaacagcaggtcaaactagagttttgttttttttttttttaagatagatttgacaagctaggaaggcaaaatcctggaagagacaagtagcacagatttttagagagaataataataataacaaatacccttagccaaaggtttaaagttcaaagtgaaccatttattcagcagcaagcatctcagttctagatggtcaactccatcacggtaaatggtaattcaaaatttaaaaatcagatcatctgacattagcgataacatacattgattcatttatccatgcactcagtaagtatcatttggtaacatctatgtgcctatcacagtgataaacaccaggcctctgataaatgaaagtcaaatgaaacaatatgttctttgctgtagtggaaattgcattatagtggaagagttaggtattaaataaataattataaaattgggttgttaattatagttttgatcagagtaatagagataaggtagaattttgtgagcataaattgaagaaggaagtttcctagtttgcaaagtagtaaagaagatacaacctcaaatatgagactgttagccaagtaaacatttggagaaacagcgctcctgacaaggagcgtaagtttcataatttggaaaagaatagggagattgccagtgtggctggaatgtggtgaaggagggggaaagagaacaagatgaggctagagggttggttaggggccaactggatgttttatgccatattgaagatttaaaatattaatcgtagtgggaaaacacattttgagtccagttggtatgatgacatccacatttttaaaagacactttgaggtattctgatacaatatttggtgtgaattagcaagcaggagtgtgaatacggggaaatcatttataaggctatttcaggagtctaagcaagagatagattatgagggctcgaacttggttattgacaatgaagatcaaaaaaaaaagtagatggaagatggatacaatatataattaggggatagaaaaaggaattgtagctgtaggcatcaaacatgagcagatggtgtaggatgatgccatttactagaaaaggaagaactgaaggaagaccagattttgggaaaatattgagagttcagttatctcagaatgaaataaccaagtagaaatattaagtggatgtgtctacagttaggaaaagatatcttggttggagacagagtttgagttcatcagtatatacatattctataaaagatgacatctataacaggaagacagaaggaaatccaagtttagaaaaagaaaaatgagttgtgtattgcctgaatttgagatgtttgtatgacacccaggtgtaaatattaagtatgaggtaacttcagtatggtcatgaaaaatggacttaaaggtagaaaaaatataaactttatttctcaacacaagttcatcaatgacaagacacttttgtaagcaatgataccagccatttagtccatctctaaagaactaagagtcctgggaatttaatcgtgccagtgcagtcttttttacattattaactgaagaaaaatgagtgccctttacagacttttaagattaggaaacaaaaataaatcagaaggagccaaatcaggaccgtaagatgtatgtctgatgatttcccatcaaaaccctccccaaattatgcttgtttgatgagaaggatgaacaaaaaaagcagtggcatggtgaaagactctatggtgaagatttcccagacacttttctgctaaagctttgcctatcttttcaaaacactctcataaaaagcagatattatcattcttggcactcctgaaagtcagtaagcaaaatgccttgagcatgccagaaactgttgccatgaactttgctcttggccagtctgttttgctttgactagaccacttccaccttgctttgattatctttgtctttgtcttcagtattttactagtaaagccatgtttcgaatcctgtcaaaattgtttggagaaatgctttagagtcttgatcccacttgtttaaaatttccattgaaagctctgctgttatctgcagctgacctgggtgcaatggtttgggtacctgagtggaaattttgctcaactttaatttttcagtcagaattgtgtaagctgaaccaattgatgtatctatcatgttggctactgtttcttctgttaattgtagatctcttcagttagggcatgaacaagatgaatgttttcctcacaaattgatgtggatgttgtgtcactgcaggctttatcttcaacattgtctcatcccttcttaaaatgagttattcatttgtaaactgcccgtttgtggggaggcattgtccctgtaaactttttgaagagcatcagtgatttcaccattcttccacccaagctttaccatgaatttaatgtttaattttgctttaattttagcagaattcaagttgctctgatagggtctcttttcaaactgatgttttatccttcttagtgtctcaaactagatcttgcttagacatgttttaacaagctagtacaactttattttgatgcaaaaataattgaaacccatgcttagattttcacaatatgcatttttgaagacccccttgtatgtaatttggctaagggtctgaatttcagaaaagaaattttggctagacatataagtttgaatttattatatatgatctttcaagttacaagagtagatgagaatatctagggagagaacatgaaggagaagaggagaggggaagagggaagaggagaggaatgatgagaaggatacaggaagggaggagaggagaaggaaggggaaggagaagataggggagataacttttggaccatagatctttgagggaatataaagtgcatccactttaaaggcattaagctgatcttaatacctgatcacttacacgacaacaagctatgattcacttacaattacctaccaagggttactgcatggtggaggtaaaggagtggttgagtgtgctcactaggctaatttatctagttccaaactttactgctactaattgctctagagactactgaatgcggtaatgtgactctcattaaatgaataaaataattccaagtgacttgcacttctagacttttttctggaagttacatagaacaaaagacagatcaggtaaaagcagtgattaggttgtgggctttgaaatttccatctattcctttgaatataacagtaataatattgaagtaggaaaggagtaacatttataaatgttaataaaattcaaaacaaatgttgacaagatatgtgtacataaacagttcacaagccacctgccattttacaaatgctagtcattttatttaataattccataaaattttatttcaggtactattgccatttcgcagttgttgttttgaaaacccttcaagagactgtatgtttgaaaagaaggttgggaaaccagtttaatattccactggtacaagagcagatggttgcctgaccccgtattagactgagggattgcagtcacatgcctctgttaataacaggatgggttgatggatagaggggagggtaagatttaagatgcatcaagagagcagggcttagggtaggaaaggcaaattttaatggattcaggttatagggtcttcagaattttatctcagggtaactggagcacagtggactggctatttttaccattttaagagctctttatatttttttaatgtataggccaaatttctctccagcatcacattcttttggcctaaagaaataattttaatattacttgtaaatcaggtgcattggaaatgcattatctcagtcttttttttcttaatctgaaaactgtctttattttgcctgcatttttgaaagattttcactgcgtatcagattatggattgacagttgtctttattgttactgtcgtttccttcttcaaagatatcactgctgtgtcttctggtgtacacagttactgacaaaaaagtctgactttttaatgtttgttccttggtgcacaatacaattttccatattctcactgcctttaacatatttttaatttttattttcgtcagtgtgactgtgatgtatctatgtgttgtatttgtttattctggtatttataatatttgaggttctctgagcttcttggatatgcggtttagtgtattttcttctttttggaacattttcaataactatcatctcaaaatttcttctacccccttttccctcttttcttctggacttttgcacgactgatatttaccatctgatattgttccagagtccttggaagctctgcactatgtttttctccccatcatttttccttttatgtgtcaatttgggtgatttctattaggctatccttaagttcattgaatgtttcctgagctgtatcaagtgtactggttggtctatcaaagaaattcttaatttctaatattatcttcttaaaaaaaagtctagtacttccatttgactgttacttaaagtttccatcttcctgcttaaattctcactttgttaaggaaggtttcccactgtgccctttatatctgttagcattttaatcgctgatattttaaattctctatctgatagtttcaatatctgagctatctgtgagtttggtttagttggttactttgcttttgaaaatagtttgctgtgtgtgtgtatgtgtgtgtatctcataaatttgaatgctaaacattgtgtatggaacagtagaggctgaggtcaatggtatttatacctgaaaatgagcagtccccttctattgggttgttagtgtgtggaaggagatctgaatttttagttttttcttaccctggctatcttcaatgggacacaggcttcaaatttctctagcgtggcctgatgcttagagagaaggctgggttgctgttgcttgtttgttttctttcctattttttaaatcaatgttgtaatctgctcccagctctccgctgactctatgtgccctttgcacagatgatatctctctccatgttctttactgcactccagaggtagaatgctgttgcttgatactcagtgctaggttatatcggagtgcaaggataacaggctctctattctgctctaatctcagccttaaagagctcctgtgtgtctatgcttcaagagtgcgggtttttcagcatttctgcccctcctccccatgaaggccaagctaccttatatatgcaactggtcttggcagagagtttcccgccaatcctttagcagtaagagatttcaacttgctatttggtattgctatagaagcctagatccagtcctcccccagagagaagtgtggttttatttgtttgtttgtttttaccattcccccagctgtaatgtgtctctttgttctgtggttatgagaccttacccacccgctaatgtcataaagtgtttcttttgtaagaaaggagagttcagggaagtgcatggcatcacatgtctattcctccacagttcccaatcatttcccacccaaatggaccaccagtgggggctctctggtctccttccctaacgccaatcttctttatgagcacttgaaaaatatccttggagcctgcaagtgattaaagcttttctttttgtcagatgtcctgagctatttcagattgacatggtagcccatatggcctctgcagatctttaaaattttagctcattaagtctcaatcacacacatattgtccctagtgtggcacttctttctcccatactccaccactaatgagacagtttgtgtgccctgcttttccttggaggaacttgtccctttttgacttatgggttacatgattaccttgtagtctgagctctctgacaaacaataaaatcattattttctagtttattcagttttttcatagttatggtagaagcaatattctttgcagctttctacatcctaaatgaaggctagttatagaacttttttgactatcagtcatattgatgtagagcagccacactataccaagcacaggaacggtacagaatagtgataattcatacaaaataatcactgattctatacctggagaggaccctaaaggatggatacttaccttgggctgggatcgagaagcataaaatccctggaaatgaaataacatatattccctcctctatagctcttcattcctttctatttcacctcctcacttctgacatatacttgcaagaaaagggggtgtccacatcatataaatggttccctcaattattattattataattattattatttttatacccctcctctttttatccccatccctacatggtgagtagttctctagtctagagagtatggaccagagacttgatcaccaacagagctaacatggtagacatttccaaagagctagcataaggagggcgaaaggtggctctagccttgtctaaaagctagtgctaccctcttcttacatttaagatttctgctgcaccaaaggccaaagcctctcattttcaaggactctggaatagtactgcaagtgctctaaatgtagagtgattagaagatcttagttaattaagacagatacaggttaggagtggacttcattagatccttctcagagcctgtcagaacctcaaaattattttctgttcttatgtttcttcaagtggaatctataattcttatcctactttgttaagccattgtactgtttaaattactgttgtgtatttttaggtaactaccttgtaaacctattcaaccataggaaaaaggcacatttggggttaattttaaatataattacctttaacattttcttttatctcttaatgtcttttaatattattgtcatccaggagggatgggaatttaaataggatggttcaaagcatatttatagctaacttgcatgcctgtgatgaagcaaatttaaccacaatgattttccaaattctttgtttacttagacagtataactgcctttgatagtttcttaattttcttccctcaactgtcaatggtaaaagtacagatcttttggaataagcattccctgggtgttcttttagattcagtcattgttcagttgaccaaagagaacttactatagctcaacttttgcctatccatactggaacattagttaaaattttgagttgactgtgttaaaatcaaaatttaaaaacactatgttttggggttagttacggttaattatctttaaatctctcaagtcattgaattgtgagctgagatgtgctggtaaatgtgtaacaactgactctcccagggaaaagagaaaaccctaatgtgcagcatttgctgattttggtcatataaatatttccaccatggttgattccaagctaccaacatgatgtcatcgaacatcatataattgggaagaagtactcaatagcacactattatacagaatttccaccatacagataaaataggtgtaaataatctctatagcattaataatattaaaatgtataggaatgatttagagtatttagcattttaaaaatataatttaaagcttatcatttaattattaatgatgactgtgatttttttaaacaaccagcttgcaaaattcctgaaattaaaataggctcttccatattgtgacaggctgatctcaacaaaccactggttctaagcctttgaggacaagagcttttaaattccaaccaccagattgggttttgactcacagcccacatcagtgaatatttgcgaaagaaagagctcaagtcaaggttagccaataaaaacaaacgaacaaataaacaaacaaacaaaaacctaggtattattctttgaattcatacatctgcatggtccaaactggtttttctttcacttccattcccttgtttttctctgtgcatgtaatttagattatttttcaaacataattattactggatcatatagtggtcactctagtcaagaattttgcatctgacgatttttcaccaagaaggcagtctagatcatgtgttattcacataaattaggaattttattacctactttaaatcaattatttctaattgaaatattgtgtatttctatataaagtaacactttgttcagaaagatccctacaaccattccctagaactaaaatattagttgtattttcaagatatttttatgacttcctctttaatttcataggacagatgtctgtgataaaatcttttccaggaaattacagctgctagtttcaagataaaactccttatgaagaagcaaagttgattgattaccttatgcaataactccacaaaatgaatgttttacaaaataacttgctggtacattaatatccttctctgggggttagtttggggcaggaaataaaatgtgtcccaaagtatgcatatcaaaaggaacttatacaaaatcatcttattaaatgaatcaacaaattttatatcttgaacctatagtcaagtaagaatggaaagaatatatatatataaaacatttattggccgggcacagtggctcacgcctgtaagcccagcactttgggaggccaaggcaggcggatcacgaggtcaggagttcaagatcagcctgaccagcatgacctgtctctactaaaaatataaaattagccaggtgtggtggtgcacgcctgtaatcccagctactcaggaggctgaggcaggagaattgcttgaacccggggggcagaggttgcagtgagccgagattgtgccactgcactccagcctgggcaacagagtgagactctgtctcacacacacacacacacacacacacacacacacacaaaagtcaaaactcatttgtaaatgactctatatatttggagaattttacaactctacagattgtttttaataaaaatcaggtgacactaatctctattgttagtcgtcaggatagtggctatctttggggctggtagaggatggatcagtgtgcattattagtgtgaacaatatatacttgtatgctgtaatcatggtatggttattttaaaaaatatatgcaaaagtttttagataagtacctttttaatgataatgaggctgaaagtccataaatgaagcctgtattttaaatcaagtattgtagcgaattttgtttggggcatttattcattcatgcattcctataataagccctcttttatattcttcagctttgttgaggtatacttgacaaataaaaattttatgtattaaaggtgtatatgagtcacaaagtgatgttttgatatctatatacaaattgctaaatgatttccacaataaagtttgttaacatagccatcatctcacatagctaccttttgtcctttttgtgctgacaatacttaagatctactttctaagagaatttcaagtgtataatatggcattattaactatagtcaccatgttttacgtgaggtctctagaacttattcatcttacaactgccacgtttgtaccctttgaccaacatctccccatttccaccacaccctaacatctagtacctaaccttctattctgtttctatgagattgattttttttttttttagatttcacatataagtgagattacatagtatttatctttctgtgtatgacacttcagttagcataatgttctccaggttcatcctagttgttgcaaatgacaggatttccttccttttaaaaattgagctggaatagtggctcatgcctataatttcagacctttgggaggctaagactgcaggattgcttgagggcaagagtttgaaaccagctaggcaacatagtaagacctcatatctaccaaatataaataaataaataaagtagctaggcatggtggtacatgactgctgaggcaggaagatcacttgaccccagaagtttgaggttacaatcagctacaaccatggcactgtactccagcctgggtgacagaatgaaagcctgtctctaaaaataaataacaaataaaaattgattaatatttaattgcgtgtacatcaaatttctttatccgttcattcatcaatggacacttaggttgtgttcattacttggttattgagaataatgctgcagtgaacatggaagtacagatatttcttcaagacagtgattaaattttctttggatatacaccctgaaatcggattgcttgataatatggtcattctgtttttaatttttttagtatcatccataatgtattacataaccctttgctggtattttatacaggcaacacaatatgccttttgaaaacactgagttgaggatatttgcatctatgtttatcagaattggcctgtaattttcttttcttgtagtgtgtttatctggctttggtataaggataaagctggcctcattaaaatgagtttgaaaatgttcacttctctataatttttcaagctgtttgagaaagattggtgtaaattcttttctaaatgtttggtagaattcaccagtaaagtcatccatttctgggctttttttgatagaagatttttgataactgattagattgccttacttgtatttgtctgtttagattttctatttcataattcaatcttgataggttgtatgcttctaggaatttattgatttcttctagattatccaatttgtttggatataattgttcatagtagcctcttagaatcctttgtgttttgtaatatcacctgttatatcctttttcatttctcattttatttgagtcttttctcctttttccttcgtctcactgaaggtttgttaactttatcttttcaaaaaaaaaaaaactcttagtgtcattgacattttctattgtttttccattttctatttcacttatttctgctctgattttgttattttgtttcttctactaattttagtcttagtttgttcttctttttctcattccttgagatgtaatgttaggttgtttatgtgagatctttcttttttttttaatgtagacatttattgccataactgtctccttagaactgcttttgctgcatcccttaaatttcggtatgttgtgttttcatttttgtttgtcttaagatattttcaaagttatcttttgatttctttgactcattggttattcaggagcatattgtttaatttccacatgtttgtgaattttccagtctttctgttattattgacttctagatttgattataaaagatacttaatatgatttcaagcttcttaaatttgctaagactgattttgtggcccaatgtttgatctatcctagagaatgctgtgtgtacacttgagaagaatatgtattctgctgctgttggatggaatgttctgtgtatgtcttgtgttcactttgtctataggttatttaagaaacctatagacaatgtttctgtttatgtctgctgttttcttactgattttctgtctggatgatttatccattgttgaaaatggggtattgaagcccctaatactattgtatttgtgttgatttctcccatcagttctgttaatatttgttttatatatttagctgctatagtattgggtgcatatatatttacaatggttatatcttgatgaattcactcttttatcatgatataatgacctttgtctcttacgacagtattttacttaaagtctattttgtaaaagaccattttgtatatttagggttccatttgcatggaatatcttcttacatcccttcactttgtatgtgcccttaaagctctagtgagtctcttgtaggtagcatctagttaggtcttatttttctgttcatttgtctgttttaatccattaagctactctgtatcttttgttgagagaatttaatccatttgcattcaaggtaattattttaggtaaggacttaatactgccagtttgttaattttttttttttttttggttgttttgaaaatcaattccttccttccttccatcctttttccttccttccatcctttctttctttctctttctttcctttctttctttctttctttcttccttccttccttccttccttccttcctttctttctctttctttttttctttctttctttccttctttctttctttctttttctttctgccttcccctcctttcttttcattttttgctgtctccatttttgacacaataatttcagttttttcttatttgcttctaaaaagaaaaaaaaaaaacaggattcatgtgcagaacatgcagatttgttacataagtatacatgtgtcatggtggtttgctacacctattgacccatcctctaagttccctcccctcaacccccaacccacaacaggccagggtatgtgttgttcccctctttgtgtccacgtgttctcaatgttcaactccttcttatgagtgagaacatgcagtgtttagttttctgttcctgggttagtttggtgagatcgatgccttccaacctcatccgtctccctgcaaaggacacgatctcattcctttttatgtctgcatagtattctatgttgtatatgtaccacattttctttattcagtctatcattggtgggcatttgggtgggttccaagtctttgctattgtaaatagtgctgcaataaacatacatttgcatgtgtctttataatagaatcatttatattcctttgggtatatacccagtaatgggattgctgggtcaaatggtatttctggttctagatccttgaggaatcaccatactgtcttccacaatggttgaactaatttacattcccaccaacagtgtaaaaatatttctatttctccacagcctcgccagcatctattatgtcctgacattttaataatggccattctgactggtgtgagatggtatctcattgtggttttgatttgcatttctctgaggatcagtggtgttcagctttttttcatatgtttgttggccgtgtaaatgtcttttttttgagaagtgtctgttcatatcatttgcccactttttgatggtgctgtttgtctttttcttgtaaatacgtttaagttccctataaattctggatattagacctttgtcagatgggtagattgcaaaaattttctcccattctgtagtttgcctcctcactctgatgatagcttcttttgctgtgcagaagctctttagtttaattagatcccatttgtcaattttggcttttgttgcaattacttttggagtttttgtcataaagtctttgcccatgcctatgtcctaaatggtattacctaggttttcttctagggtttttatggttttgtgttttacatttgagtctttaagccatcttgagttaatttttgtataagacgtaaggacggagtccagttccattttttctccatatggttagccagttttcccagccatttactgaataggagatcctttccccattgattatttttgtcaggtttgtcaaagatcagatggttgtagatgtgtgctgttatttctgaggtctctattctgctccattggtctatatgattgttttggtactagtatcatgctgttttggttactgtaggcttgtagtatagtttgaagtcaggtagcgtgatgccttcagctttgttcttttggcttaggaatgtcttggcaatgcaggctcttttttggttccatatgaactttaaagtagttttttttccagttctgtgaagaaagtcattggtagcttgatggggatggcattgaatctataaattaccttgggcatatggacattttcacgatattgattctgcctatccatgagcatggaatgttattccattcgtttgtgtcctcttttatttcgttgagcagcagtttgtagctgtcctcgaaaaggtccttcccatcccttgtaagttggattcctaggttgattttctttgaagcaattgtgaatgggagttcactcatgatttggctctctgttggtctgttatttgtgtctacccttgtgacacagtgaaagagaaacccagttactgtagccttgtagtatagtttgaagtcaggtggcatcatacctccagctctgttctttttgcttaggattgtcttggctatttgaggtcttcttagattccatatgaaatttaaaatagtatttttctaattctgtgaagaatgtcaatggtagtttgatgggaatagcattgaatctataaattattttggatagtatggccattttcacaatattgattcttcctatccatgaggatggaatatttttccatttgtttgtgttctctcatttgcttgagcagtggtttgtagttctccttgaagaggtccttcacatcccttgttagctgtattcctaggtattttattctttttgtagcaattgtgaatgggatttcattcataatttggctgtctgcttgcctattgtaggtgtaaaggaatgcttgtgatttttgcacattgattttgtatcctgagactttgctgaagttgtttattagtttaggaagtctttgggctgagatgatggggttttcaaactataaaatcatgtcatctacaaacagagacaacttgacttcctctattcctatttggacaccccttatttctttctgttacctgattgccctggccagaacttccaattctatgttgaataggaatggtgagaaagggcatccttgtcttgtaccagttttcaaagggaatgcttccagcttttgtccattctacatgacattgtctgtaggtttgtcataaatagctctaattattttgagatatgttccattaatacttagtttattgagagattttaacatgaagcgatgttgaattttatcaaaggcctttattgcatctattgagataatcttgtggtttttgtctttggttctgtttatgtgatggattatgtttattgatttgtgtatgttgaaccagccttgcatcccagggttaaagctgacttggtcatggtggatacgttttttggtgtgctgctggattcagctagccagtattttattgaaggtttttgcattgatgttcatcagggatactggcctgacattttctttttttgttgtgtctcttcctgcttttggtatcaggatgatgctggcttcataaaatgagttagggaggagtccctccttttcaattgtttggaatagtttcagaaggaatggtactagctcctccttgtatttctggtagaattcagctgtgaatccatctggtcctgggctttttttggttggtaggctattaattactgcctcaatttcagagcttgttattggtctattcagggattcaaattcttcctggtttagtcctgatacggtgtacatgtccaggaatttatccattttttctagattttccagtttatttgcatagaggtgtttttattattctctgacggtagtttgtatttctgtggggtcgatggtgatgtcccctttaccactttttattgtgtctatttgattcttctctctcttcttctctattaatctagcttgttatttatttatttttttcaaaaaaacatcccctgaattcattgatttttttgaagggtttttcgtgtctctgtttccttcacttcttctctgatcttatttatttcttgtcttctggcagcttttggattcttttgctcttgcctctctagctcttttaattgtaatattagagattgatttgagatccttttagctttctgatgtgggcatttagtgctataaatttccctcttaacactgccatagctgtgtcccagagattctggtacattgtctctttgttctcattggtttcaaataacttcttgatttctgccttaatttatttcattatttaccctggagtcattcaggagcaggttgttcaactcccatgaaattgtgtagttttgtgtgagtttcttaatcctgggttctaatttgattgcactgtggtttgcaagactgttcgttatgatttccattattttgcatttgctgaggagtgttttactttcaattatgtggtcgattttagaataagtgccatgtggcactgagaaaaatgtatattctgttgatttggagtagggagatccatagatgtctactaggtccccttgatccagagctgagttcaagtcctgaatatccttgttaattttctctctcattgatctgcctaatgctgacagtggggtgttaaagtctcacactattattgtgtggtagtctaagtctctttgtaggtctctaagaacttgttttatgaatcttagtgctcctctattgggtgcatatatattcagaatagttagctcttcttgttgaattgttccctttaccatcatgcaatacccttctttgtctttttagctctttgttggtttaaagccggttttgtcagagactaggattgcaacccctgcttttttttttttttttttttttttttgcttttcatttccttggtaaattttcctccatccctttcttttgagactgtgtgtgtctttgcatgtaagatgggtctcctgaatacagcacattgatgggtcttgactccttatccagtttgccagtctgtgtattttaattgaggcatttagcccatttacattttaggttaatattgttatgtgcgagtttgatcctatcatcatgatgctatttggctattttgcacactagttgatgtaatttctttgtagtgtcattggtctttatgttttggtgtgtttttgcagtggctggtactggtttttccttttagtatttaatgcttttttcaggagctcttgcagggcaggcctggtggtgacaaaatccctcagcatttgcttgtctggaaaggattttatttttcctttgcttctgaagcttagtttggctggatatgaaattctgggttgaaaattctttcctttaaggttgaatattggccccccatctcttctggcttgtagactttcttctgagaggtctgttgttattctaatgggcttccctttgtaggtgacctggcgtttctttctggttgcacttaacagtttttccttcattttgacgttggagaatctgatgattatgtgtcttagggttgatcttctcatggagtgtcatcttaatggcattctctgtatttcctgaatttgcatgttggactgtctttctaggttggggaagttctcctggataatatactgaagtgtgttttccagcttgattccatcctccccatctccttctggttgtccaatcaattgtaggttcagtttttttatgaagttccatatttcttggaggctttgttcattccttttcattctttttttctctattcttgtccgcatgttttatttcagtaaggtggtcttcaaactctgatatcctttcttccgctttgtcaattcttctgtttttacttgtgtatgcatcacgaagtactcgtgctgtgtttttcagctccatcatgtaatttatattcctctctaaactggatattctagttagtaatttctctaaccttttatcaaggttcttagcttctttgcattgggttagaacatgctcctttagctcatcatagttttttattacccatcttctgaagcctacttcagtcaattcatccatctgatcctccatccagttctgtgcccttgatggaaagatgctgcaattatttgggggagaggaggcactctggcctttttggttttcagcattttttcattaattctttttcatctttgtgagtttgtctagttttggtatttgaggctgctgacctttggatggggtttttctgggggcctttttgtttttgttgttgatgctatttttgtcactttgtccttgtttgttttctttcaatagtcaggtccctcttccatagggctgctgcagtttgccgggggttcgcttcaggccttattcatctgattcactcctgtgcctgcagatatgattcaaggaggctgaagagcagcaaagatgggtgcctgctccttcttctgggacctctgcccttgagggggactaagctgatgttagtaggatcgctcctgtatagggtgtgtctgacaaccccggttggagggtctcactcagttgggtggcacaggaagcaggacctgtttaaggaagcactttatcccttggtggaaagggtgtgttttgctggggggaagcccacttctctgggctgcccagagtcttcagaatgaccaggaggagaggctaagtctgctggtccccagagactgcggccacccctctcactaggggctcagatccagggagctctgaattctgtccctgagcctctggctggacttattggaaatcctgtaggaaagccccacccactgaggaaggatgcctcagggttagacctgaagaggcactctggccgtattccacagcaagtgtgctgtgctgtggggccaagtcttgggaccaagctatccagtcttcctggctccagcaagggaaaagcacagcctggagctatggaaataggtgccgcccttccccccgcccagggagcttagcatgttaggcattgtaggtcccagtgctggctgctgttcctccctcaaggagctcaaatggcttagacagcaggcagctgcagccagtgctggtcgcccctcccccctggagttcagtaagcttaagcagattccagctgagaggctgtaagaatctgcacgttctgggattgggacactaggctctggtggtgtgggttcacaagtaggatcttccgatccgtgggttgcacatttctgtggaaaaaggacagtttacccagctgggtatcgtgctcactcaccacctctcttggctcgggggagggggttccccttccttgtgtcgttctcaggttggctgccgcaccacactgttctttcttctctccgtgggtcatgccagccttctagtcaattttgatgagagaacctggataccttggttgccagtgaaggattcacatgcttattatgtttttataagaagcatggcactagcagctgcatctggtaaaggcctcagaatactttcagtcatggcagaaggcaaaggggaaccagcatgtgcagagatgacatggtaagagaggaagaaagagagagggtgaggaagtaccaggctctttttaacaaccagctcttgtgggaactaattcactcacctctgatggagggcattactctattcctgaggtatccatccccatgacccagacacctcccattaagttccacactgccacattggggatcaaatttcaatgtaaggttcagaggggacaaatattcaaaccatagcagtggctctgattctgaggtgtggacacatgtggagtggcagtgaagtcagagtccagaatacagttgtgtagagtgactataggacctggagtgtaggtaactctcagggactctgactctggtgtctgagacatgggcacttacagtggaatcatagagccagtggtctggaacatgggtacaagtggagtggtcatgattctagagtttggtggggtttgggaggtagcatcacaataataattcctttttagggggatcacagcatctccctctccaggttgttcacagtggcaatggctcttggtgacctcagtggtgaaagttaccagtgtcccttgcagagaagattcacgggaaaccatgttggcacctgatgcatggctaatactgatagcccccaccattctagacatctctagatatctcaggtgtgccattcttcccagtgatttattgtgtgattattctgggcattttgtttatttattgtttgttttgtttcattttgttgcatagattcttttgaacctttgagcaatcccaaggatgtttttcttgcctttgtagggaaaataaggctgatgtctccatctctgtcaacttgatgacgtcactccacattaaatcttcctaaaggaattacttactgtttgattcgtagttctcagaagctcaaaagttctaaaataaccaagagtgtacacatatttcttgaataaataatttgagacataatgagacaggtctaattgtcttgagactggaaatgtgtttaggctaaattatttttcaaatatttaaatgtgttactagagaagctaagtaggatgtaattttaaaagctcttccttaatatgtatccagagagacagattggcaggtatccaaagctatttggtgactctcatggggcagaacttgttgctgagatttcttgatttaaatatgagttgaatatgccttcctccaggagcatttagtcacttaaaaagaaaaactgcctattttaaagtaactaaaattaaatatgattaaatagagattattagaattacttgttatactttgataaacttaaaagactttatgtttttcaattatacttgtaaccattagtagtagtattagtggtctcattttacatggagattaaattgcaattagctcattttcatgaaacctgggaaatgatttggtatatggatatttgaaaactatttgaaacattaggggaaatcttgggcattttaatggaaccagaaatcctttaatgttacataaaccatgtacaagtatctcaaattttgaaacatgttaggatacctgttcactatagatatttatttttaatttttttctttaattgaatctctttcttaatgattggagagatgcttcaaatagaattggatgacattagaagtattttttttctcctggttaccatcttaaaagggaaatagaaactgaagaaaggggactccagctataaaaccaagggagctggctttattatattttcctcacttttaaaatatattattgatatttcaagcatttagatagtattcaaaaacaaaatcaaaatttgtgttccactaccagcttaataaatagtactatgtgcaattgaaatcttctgtgaatttctttctggtaataccctcctctgctccccagaagtaactatgatcctgaatttgatatttatatacttctcaatgttttttataatttccagtctagacaaaatataaatcttttttttttttttttttttttttgaggcagagtctcactctgtcacctaggctggagtgcaatggcatgatctcagctcactgcaacccccacctcccaggttcaagcaattctcctgcctcagcctcctgagtagctgggattacaggtgcccgacaccatgcccggctaatttttgtacctttagtagagatggggtttcaccatgttggccaggctggtctcaaactcctgacctcaggtgatccgctcgcctcgggctcccaaagtgctgggaaaaaatattattatactatcttgcttgtttttacatgttatgattggaattgtgatgtatgagttcttctgtacattttcttcctcaacattaagcttgtaggctctatgttgatacttgtagctctattgtattatttctgagtgaatttttaaaaatgctattaaagtgtgatataacgtaataaacatggctttttgtcatatggaactcaaattctgtcttattccttatatctatgtacctttaagaaagttatttaaatgatctcagccagctttaaaaaaaatctatagaataaggtaatagcatcttcttttttcttccaaattttattttagaaccaggggctacatggacaggtttattacaaaagtatactgcttgatactgaggtttggagtatgattgaatccatcacccaggtaatgagcatgatacctaacaggtagtttttctgactcctacccacttctccctgtccctcttatattctctggtgtttgttgttaccatctttatgtccacgtgtacccaatgtttagctcccacttataattgagaatatagcatattctttataaagtagtcttggtataatgatgtaatgggggtatatatttaaacacatatatgtatgtatgtatacacacaaacatatccacacatatatacaataatatattttagtaacataataacaaatattaattcttttccatattataattttcttttctatctctactttttaaaattagttgtgattactataaatactttttatataacagggactacttgttggtattctgggatataagaatgcaaggaaaaaaatttgagaaaaaacattctgttatgtctgtggttctcagcagcttgatgcagtgaaagaggcctgagctatgaagtcataaatcctggatgtgacttccagctcattggttcacggttgtatgacttgaccaaattacttaattttcttttagcctgatttttcattggcaaaatggaaatagatgctacttaactaataagggctttgtgatgatcaaattaaatcagtttagtaaagtactaaacatttttccaggcttactgtatatgtgtaatgcaaattagcaattgtatatgcaattgtatatgtgtaatgcaaatttaccatcaatttattaatatgtcaaatattaacagaagtcttttgtatatgtttacttatccacatttcagggctttattttccatcttcttttcactttacactttcaaaccctgagttatttcatggacttccatagcttaagcagttctggacactaacaaaccaatgtattcaactacagactcattatccaatagattattggaaattttatgtgcctaactcttcatcttcctagtttacctctcctttgttaaatctaaaattattttctcattatctcaccatattcttgtaatacttagtactactactctagtgtttaaatatctctaaaatattttcctcatcaccatatccttacatttgccttgtttagtgcctcatcacttctggtggattagaaatgatattttattaaatgtatcccttgcccctgcttatggcatccagtctatcattcccctacaaaatctggccatattactctcttggtgaaatcttgaaatatttatatttctgcagaatagcatcaaacatcttaacagcgttgaaattgtcctatataatcaatattttaacagtttttaaaaggtctatataaatcagattctatataattttgccgtatcacctgataaattgtccattgcatccaaagttctcatcatagagaaacttgagtttctcaaagcttatcatgtaatgtcctccctccctaaaaatgcatgtgttgttctctttcctggaaatgccttcaagccttttcttccaacactaagccttgagaggaaataaattaatgtttctaaagtccttactgtatcagaaactgtgttaagtaatgtaaagacatggtaatagttgaatttcctaataactctatgaggttgacaatatctcaattttagagatgaagaaattgaggcaggatttaaactctcattggctgactccaaaaactgtattgttaacaattgtgccctaaataatttatttaattcccacaaaaacctaaagaaagatagatatttaagttgatttttacgcgataaaactgatgctcttgtagtacaaatggtgtatcctagtcatatagttaaattcagcaaagcctaaatttaatatcaaatttgacaaacattaaagcccatattgtttccattataaacccctgtgtctttaaatatcaccccttccctcaatgaatcatttcccaatgctcccatgggtaaatgataatgccaatgtttcttctgctgatatgcctcgcatagtggaataaaataagaataattaacatttatctagcagttattttacatatagacacagttctatgtgatttagttaattatctaatttaaatatctcaatgagtatcatagcgaccgtgtgcattactctccaacagtgtggtggcctgttttccttatgcaagtgtgaacaccttggaggcaacaactgactgatacatatttgacttcctagcatctagtgcaattccttgtgtgtagaaggtacacaataaatatttttaattaaatgaatgggctatgttagagagtgtctatgatattggtaggacacagagagaaaagtagaaagcatgccttaaatcttagagaacaaataaaatcttctcccacagtacttatcccttgaactcaggaatgcagaatctttggtaggatgcattcttttcctaacttgtcatggcattttttttttatgttggagacaaattatgcattttccaaatgacagtagtcagttagacatcttaatagagataacagatttatacccaaattggctttgatttatacccaaattttgatttatcttattgaccccattcatattatagagttcactccttattttacatgcactataaaattcaaaatattggaaagcctcttgatctgcaaagacatcacatttgtctaaagtggccatctctgttttccatccatttggaaagatcgtttaagtgtttttctcaggcatagccagacttctgaaaaatggaaattggctctttattacgaccttgtctttgttttatgtgagagtacaattgtctacttttcctccatcatttccattcaatgcttacttgctgcatcttttctttgatttccccaggatttactatctccacagtgtcccttgtgccatatatttctctactttgctgggttctaattttcgtctgttctaggatgatgacaatgatgatgataatgatgaaatgctgatgatgatgtgtgtatgtgtgtctttgtgtgtttctcatctctgtctccatctttagacaattgaatcctgaaacttaaccaagcagatgcaaagttgcagtctttgtttcagagttggctatggagatttgtatgtgagaaacgatattggctttccttccactcactgaagaaagagggactaagctaatgctcttcccagccacctggttatgcactgttgaatcatgccattttaggaaactgaaatttctaattcttacatttgtaattatcgtaggttttgtcaataatttagatttcctaaattattgtactctatataaccttgtacctaataaatttcaaaatattcaaatttctatttataaataaaatgatctttttatatgaaattgattctatatatgattaaattgataaaacttctgtgatttttcaaaaagtctgaggcctttaaatcttctatttaaggaataaataatattactcatagaagagagaaatattataaaacaaagtgtatgtagtttacttgaagtttattagcttggtgacaatacctgcaaatatgaaaatagaagctacccggggcagaacaaaacattgtggcacatggaatacataatagacaaaggaattgtatggccaatttctcagacagccatttggaatgttttagcatctttatcagtcaagtgcaactgtcttctctatggctcagcagggattatacttcacatgcacttcaacatctctgaagtctgcacctattgtcatcagcacccctactaccttcaagggctgatatcaactgctattgatttgttgatgaaaatgaccatgatgacaccaccaagggtgaacacctccctacagcataattatcaattggcaaactttggtttaactctgacagttatcctgtactctaaccctgagtaatgaacttgaaggtttcactttgattttacaaatgatcaggtggaatgacatagaaatatgaattgtgtgtgtgtgtgcatgtatgtgagagagtgtataaaaagaggctttgggaagacatgactttagtcatctcagtgaccttaataacatcatgttcagtccacttttggtggaaaaataaggcttaattgatttttatatctaagacactttgaaaaatagacaagcattttatacatatatgtatttgctggtttacatgaatctcccatcctagtatttttgcaaatactgttacgacattttaaaatgctacctttgttttcccttgatgaatattagcaaaattaaatgtacattttgttttaaagcctgtttttttttttcaggcaatgaaaacaatgctgtgttcttagaagcttaaattctaagagcaagagctctcagaaccactgacacacccagagtaaaggtgcttatgttccaaaataattaatattgatgaacacttgtacccatattgatgatttttaagagaaactccttccacatttttgaaatgaaaaattaattatttgtaaattaaacttttctaaaaaaggttattcaaatgagtcctggtaaaaatctccatattttatagccacatattttctctttctttcatttatttatttattttcttaattttcatttagccttgttgatgttccagaaatgatagcgaaaagccaattccttatatctcacttataatgtaaaatatcagcctaaacttgcagaaagtatatcttttgaataaaagacagcagatgctgtagcatttctgccaaagaaagagtccagtataaacattctgcagtatgcaaatgtcatctcctctatgtgaatattttccccgagtggatgttgcagggttggaggcttctgcctatgatttaggttgtaattttatttgtggaaataaaccaatcgtggagctccaattgtcttggtggtgaggtgatcaatagcccattactggatagaacagcgactacaggaagagcattgaagattttaatgcatgaattatgcatgcagcgctcattctttagtctccgaacagaatgacagggtttgtgaagtcgcctcagatagtttcttgcattaagtgactgcagtgaaatgcttaatattttcaggcatagaagcagcattgactcgggccagccgaatttggaagatgtaaatctcccagctcacagcacggaatgctttatttgaaagtattgctatgtagacagccggcttttctgtcatctaacctgctctccccaggttggctgaaggatgggagcggctgtgcctgcctgtgaggtcacagcatgaagtccttttaacttgctttctgctgcaggagagaggcgtattgtggtataactgttgctgtatttattcaaatggacaatttgcaatagatattatacccaggacgacagataagtcaacacataaggtaagtccaaggttttttttataggttaggtaattgtaaactagaatatgctgagttaggataatggtgatgcgatattaataaggttgactcagaccttagtattgcaatgccagcatcaggactctcaattgttacgttaaacgagaggtgactttctatatttgatagtattggaccatagggtattttatcttgcatgcaaaagctttccaagaatgtactagagctcgaatgtgtagaagactgcaaactggggaggggcagcagtagaatgagctgaatcaataagtggaaattacctccttgtggggaagttttagcacggctgtggcatcgcgttggctcagattatttccttaatgtcaacattttcaaattctagtaaaagatgtgggtagacaccagaaatgctcaatccttctcccagaagcagaggaaagcaccgaggtactcaaactcaaatactgtgttgcatacaaattgagcagatggaattaaaacaatttggactagcatgtccttgagggaagaccttgctgtcaaacaaaccatttgacttctacctgtgctggtttggttttgtttttccctcttgttaagaatgccttactccaaaatgtatggatagatgacgtgttgtgacatttacccaaaaaagagttttatttcttgtttttttaaaaattacccctatacaattataggacccactacataagatccaaataaaatttacaaaaactctgtaaaactgaaaaacacagtactatacgagtatatttgtcagaagtcattgttaattaaagtttcttgcttaaatatcatggcaaatgattaattcctgaacatttctttaggatgagaaaacagaattaataaatataaagcaagagacactagataagtaaaattctttaaggctacttttcaatttatattattagtgaacatatattactagtgaatatatatactagtgaatttatattactagtgaatatatatgcacacacatacatatatactataattcatagtttataaaacataatatatgcactataatatataggtatatctacttcctcatgtatgtttattaatactgtttttaaaagtgtgtttgctaaatcatctatcaagaccaagaatagataaggacaagtatgttttgggaaaaaaaagtatcactttattttttttaaaaagaaagaaatttagagtaatgatgataataagagcacagcataaaatgctacattttatgcatttcaattctgctacaatgttgctatattatttggatttcctgttgtccaggtgttgtgcacagaactcccagcattacagaatggtttaaatcttcaaagctgatctagtttaggtataagaggaaactcacacctgaagtttttccttagggaggggaaaaaaggaaggagatattactacctatatatcttagaagtctcctgatgctgagtcatggtgttcagttctgctgaaatgcctcctggctgaggtggctgattaacagctaataaaatggaatctagaggaaaatgagaaagaatggaggggggcagaaacttaaagatatttattgcctaatgacacacactaaattctgagtaataagtagaatggcagtgctacttgttggatctggctgagttgacagtaggagaataaaagctcccgtgctgggtgacaagatcatagcagtagaattaatggcctaacaaggggagagtgtataaacaaagggattcaagaagcactgcccttgtacttatctaaacctctctgtcttctttctagtctcaacccaagccattagccaatctcatttaaaagacataatgttcagataaagaatagtttccagatcacgtaaggaaaatctagaataagatgtgctcagttcctgcttcccacggtggttataattaatttttataggctatcaattgggaggaaccaacaaaaaattgatgagaatttttaaatatcttgtttggtatatatgaggcaccaaaatgagtttagatagtgattattatggcaacatataatcgtattagatataattggaaatggagactgaatatattacaaaaatatatattaaaaaggaaacagggcaaatggaatgagagagtagtgaaacatcaaacataagattttgaaagaaaaatgtacttaaactgtagttgatatacattattagtgactcaaaatcaatgtataaaaaattctgaagtaacaggtttactaatataagggtttataatttctttaaaaataaattttaagggtgacttagagtgagaaataattgacaataatattttaaagtagaaaggtgtaatatttctttatagggaataaatactgatagagctaaaatatatttgtacttatgttgtaataaattgaagtagaaatctctctatatatattgagagagagggagaaagtatagtgtatatatatatatatatatatatatatatatatatatatatatactctttatctgtctacctaactatctagttttctacttagtaactactataagtgatctgtaactaccataatcctaagtggtagttacatatacatatacatatatatatatatatatatatatatacacacacacacacacactatatatgaaacatatatactataagttaatatatagtatagtatatatatttacagtatatatactataaatatatacaatacagtatatatactatacatatactatatatactatacatatatagtatactatatatactgtaaatatctatagtatatatactataaatatatactgtaaatgtatagtatatatatttacttatagtatatacatttacacatataattaaatgtatatactatatttacttaggattgtggtagttacagattacttatggatgattaggaggcctacaagtatttgaaaagaggtaatatacccattttcaacaaagcaagctaatatgaaaattgaggaaatcagagcttatgtttagacaacaagaaaatttcccatagggcacttcagtaaacagtcctgatgagttgcaagctttgtgaaattcacagaaaacttttgcaagtatgaatctacaacaaagagtgattgttgggagatatcatcttcttttctctcctattcgagaaaaatgattaaattggttccccctcaaaatgttttccctgagtaattaacatatgaaacatctttctttcagatatgctcttaagggttgactctgaggagtgcctcagtttaatatagctttatggatgcttcaccaatttattccctcttattgtaaatataccttttactccattttcattgttcatcaatctctttcttctcacaagacaactcagtgcaataaggaagcatttattgagaatcctcttgtttggttttgctaggtactctggttttgtagatgcaaaagatgaagggcctgtgctttcaatgggaacaaacaagtcaaatgcagggggaaaaagataaaacataggagcacccaaaaatatttggtaaaacgttctactgtcataggagaaatgaggaattatgcacaacattttttaaatggcacctggaggaagaatatgtataaaagtatggaggctaaaattaatagtatatattttaatgttggtactgaaacagagggattggatgggtggtgtagttgagaataaacaaggtggggcaggttattaggaacttagccaccagaataacatgtttagacttgacttaataggcagtgaacacccacagacattgtttaatctcactggaggcatttaatgataaagaagtatctgactcctgaatcagataaattctcagcatttctttttaatggctgctaattctaaattaaatagtcatgcaccacataaatattttttgattgcatatttgacagtggtcccatgagattataatggagcagaaaatttcctgttgcgtagtgatatggtagcccttgtaatgacatagagcaacacattaccttttttctatgtttagatacacaaatacttaccattgtgttatacttgcctacagtattcagtacggtaacatgctgttcatgtttgcagccgaggaacaataggctatgccatatagcctacgtatgaagtaggctagaccatctaggtttgcgttaagtacacttcgtgatgttcccacagtcaaaatcacctaactgctcatttctcagaatgtatcctcatagttaagtgatgcataactgtattgtattaaccatgtcttttattttctgaattctgatactttagctttgcagaccctggaaggaccacccttcctaggtgttagctgattactggagttagtatacaacttgcccctgagtacatttttcaaatgcaaaccaaccaatccagagccccactactacaaccaccttccttatctgggctctcacactctgggccactatccacttggctaatcaccccggggacacataccagacaagtgacaaatgaaatttttcaaactagccaatcctaagcacttacctgctcctgttcgttctggtgaaaaccacacagttccccctctctccctctgcctcctgaccagccccagttcttctccatgttgctccttgtggtgtgctgtgctctctgctctggtgatctgtgggtttaacaagttatcttttttttttgagatggagtttcattctgtcgcccaggctggagtccagtggcgcagtctcggctcacggcaacctcctggagtgcaatggtgcaatctcggctcactgcaacctccacctcccaagttcaagcgactcttctgcctcggcctcccgagtagctgggattacaggcatgtgcctccacatctggctaatttttgtattttttagtagagacagggtttcaccatgttggccaggctggtcttgaactcctggcctcagatgatctgcccaccccagcctcccaaagtgctgagattacaggcgtgaggcactgcacctggccaacaagttgtcttttcaatgacagttgtctccagatctgttgtctttaacaaacctaaataataaaacctacattaaaataaacatttaaaaattttctaaattttaatacaaactaacataaatagaaatattatattcccaggacatgaaataaattagccaagtcttttttcttaaaaaaaaaaatcattacctttttactaaactgttatcttattttgaatttaaggatcaattctgaatgaatctcctataaaaataagcttaactattttccaagttgtggttgataaagggagggtatatcctctagaaatgtgaatgggcaattagaagttttcagtcttatgtcaagatacataagtctaaagttttaaatattttcctgagattgctttaatttgtagtatgtcatatctactgcatggaaacaagcatttactttgtcaaacaactaaatcaatgctgagggaaaatgctatctttatacttgaatatagaaattttgaaactgtaactaccaaatgctagttttgtttacataatgtctttaatatctgatgaggaactacactacacatcctaacaaaaataaattctgttacattaagccacaaaattgaattgaattgcactctcttgagaacagtgtccaaggagagattgttaatcagtgaatgcaaaactttagaacaatgaaccaaatgcaattaagcagaagactaacaagaatcataccacacagaaaaccgtgctttgaagaatatgtatcacaagatcgtatcttttggtggtgcactccattattttaaaacaccatcactgaaagaagagaacagtaaacgattttaagaggtagaataattcaaatattaaatgcatgtttgatttttacggccattaactgccctttcacccgttctgctcctagattgcattataagttattactgtaatcgtaatagccctttgagaaataaacttttgaaaaactcaagtggcaaattgatggcttaggttgggaataggttagaaaagatactagtcatgatagcagatggaagggcagcaaggtaggtggctgggagggaatctggaggcggagctgtgccagaaagaacataggaatttaaacagatggaagatgatatatcagttggcagggagagccgctgggtgacaagcagacgaatctattgaagaactgggtggataggcagccaataagtgaattagatgaaccagtaataaaagaaatagatcagtatgagggcatccaagctccagaacaaatcgacaagaacaatagaaaacaactacaattgtccctttgcttgaacctgaggaaacgacttttattgtaatcttttaaagtgcttagaagtgatgatgaataaatgatgataaataagatgatgatcatcttctatagaaggaaaattttagtataaaatttaaagatgcttaccactaaataaatatattctataaaattattatgagcatacaatttattttatgtcctagttttgggtttcctataaattgagttctggccctggcttggttaatgtatgaggctacggggacctggctggaaaataatactgatgcatagtaaaagtggagaataagaactttaattcctttcaaaaaagagaatttaccagactatggcaaatgtgaatatgatattatctttataaaaatagcttatgttgtttttgtctattaaaaatgataatagcagtgtctcaatgaggataaagaagaccattacaagtcatttggtctctcttctgccttcagacttacctacccttaaatcaccatattcttaggcaattattcatacttgcaagcacttagtataattgtgtagtgcagttttgcactttttaaatgacagctgtcattatgggttgatagaaagtaccatacccaggaatatttgtaggaaggacttggcttaataggaccattctgattgaccttcagataattacatggtttcttagcagagaagatacttcaatttgccacattataagcttaaaattcacattctttttattcttccatctaacctataaacttatttttctggtactgtcaactatgtttctcaggccagtctattactttctattttactagccaaagcccatatgccattatgcctgaaactgtgttgttttactgccaatatgatcatttctaaaatatctgtattcccatcaatcccacacacagaatcagggatcatttatctcaagggttgtctgagttatatgaatattcttttcaagtgaattttttttagctgacactttaatctcttgaattaaacttctgagcccaggctagtagcagtgtcttccgaaattctaaatgctatttatacacacacacacacacacacacacacacacacacacacacaagttggagcaatttcctaaagaaccagatgaggcaaattctacacatatgccaggcactaggccagacactgagggatacaaggataaataagatatgaaccttttcatcagagtttatattttggtggatgaacaggtatatatatgtgtgtgtgtgtgtgtgtgtgtatatatgtatgcatatatatatacacatgtatgcatatatatgtatatgtatacaggtgtatatatacgtacatatacaggtatatatatacgtacatatacaggtatatatatacgtacatatacaggtatatacacatatatgataatatataatcgtatatatgtgtatatatagtatatatgtataaataatatatatgtatatattgtatatatgaatacataatcatatatgtatatattataatacatataatatgtatgtatatataacacatatatgtgtatatatatataaaatcagatactatggtacactttaatagatgcaatgatattatattcatgtaatatatgtgtatatcatcctccataattgtaaatctcttgaggttagggaacacactaatttattaattagtaaatatttattaagcctcttttatgtacaatggttatgcaaagggaagatttttccctgttgccatgggcaaaacagtctattgaaaaagggaaaagaaaggagcaaactttctgtgaaatatgatggtacacagtatgtacaataagtgcatataaattgggctctaaccaaaatcaggagaggacatcaaggataacttcctcaatgaagaaatcaaaggatacataggatagtttttaaactatttaagtatttgtataatggttaattcattgttgttataaaataatggtgttgactgtaaacttcagatgttcagactaaaaaagatacatgtatttaatgaacacaatttgaaaggaagccaactatgtgtttggtgttgagataattatttaagtattagctcacttaatcctctccagaacactatgatatcctcacttttaagttggatgttacgctattactaaaactcttcagctcaggattaggagattaaagtttctcttccatatcaccataattttgctaaattttcttggcactttgcagaaattttaaatgtcaatgcatttatatattcagtgatatttcggaacccctatattcattagattgttcatctccctttccttttaactaaaatatatataatggggccagtacaatgttgcatgttaatttttattcagatgctattgattaggagattggagtggggcctcaagatggctgactagaaagaagcctttcatgcccacctcctccattttaaaaaccaaaatagtgtatagacagtcacatattgaatatattacctgagagacggtggtggaattcaataaggaagtgacaaaaacaccaaaagcaggaaggagaagggagagagagacagtctgcctgcccagaatcagctggaagctgggagtgacttcccagcccagggattaggtgagcaagacacatccaatggcccacatcactatcatggaattatgcagtcctgactataggagaaccccttattattctcaacccctgaaactatcatagggagttgccaatagactgcagaaagaaggaactgctccagggagggagcttgcactgggtcccacaccctttctgagacctaagtggctacagcaaggtgccatttttaaacctagcttttgacaggctttctgttgtcctggggtgcagcagcgttgagtctgaggtgttagggaaacttgggctgtccctgatgggactgaggagcaagccgagaatgttcctacagccaaggctaagaagcaagtgaggtgtgggctgtagcggccactgccaggaagcaagcactgctaggacagagactgagacacaagcaggatgcaagttgacactgagacatggatgccagctgggtggacactcctgtagccagggctagggcctgagctaggctcaggctaccactggtagtggtggagtatgagacagacctgtgttttctaccagctatggccactgaggataaccccaccctctccaatggcagggtctcagtatcgctgctactgcttctccccggagcattgcacctggcacctgaggattaccctaccccacccacaatggttggtgcttgctttccccactcggggtactgagcaaaaggccacccagcccggcattgcatctgcaagacagagcacgtagcctgtggccttggggatggcccaacccaatttaccactctggaaccagagcactcctactagcatcctgaagttggctctaaactcccagccactaccacttcagctggcacttatctgcaagtgccatctgtgagcctggaaatgggcccgcctagcccattgctgctaccaccaacatcaacacacaccaactgagacccaaataatttttctgccattgctattgccatcctccatgccacaccagctacccaatgtccaagtatctgaacacccacttggcctactgctgccactactggaatctgagcaagacatctggagtttcaagagtcagccctccagtaactgcaaacaaaagtacctgtgtatatcacccagtggaacaaaaataggcaaactcaacccactgctgccagcactgtggcctgaacactggcccacctgatatcctagtacccagcataacttcaccacagcctccactaataaccataccctaacccaccaaaaaatgacaggcatcactaatgctgtatgtagcaaaagaaattatacagagacacacttagaatcaaagtcaaagtaccctacccgaacaactccatagaaatatccttaggaaaagttctcccctacacaagtaaattcaaaaataggaagaagcaacagttacaccatatgtgcagatatcaatgcaaggatacatgaagcatgaaaaaacaaggaaatgtgacaccgccagaggaacactgtaattctctagtaatagatcttaatcgaaacaaaatgcaacatttcaggcaaagaattcaaaatatttatttttcaaacactcagtgaaacacaagagaagtctgaaaatgatacaaagaaatcagaaaaaacaatccaggatatgaatgagaaatttaccaaagatatttttttccttaagaaaaaacaaatagaaattctggaactgaggtactttttgaaggaaaaacaaaatacatttgaaagtatcaaaactggaagctagatcaggcagaagaaataatctcagaatttgaagataggtcttttgaaataatgcagtcagacaaaaatatagaaaaaaaacttaaaaagaatgagcaaagccattttgacatttgagacaacataaaaccattggatagtcaagttactgatatctccaagggtgaagaaacaacaacaaaaagattagaaactgtttaacgaaatgatagatgaaaatttcccaaatctagcaaaagatttagacattcagataaaagaggcttagcaatccccaggttgataaaatacaaatgtgtctccatggcacattatagtatgactgtctaaagctatagataaaaagccaatcctaaaaacagcaagagaaaatatctagtcatctataaagggaaccccattagattaaaagcagatttgtcagttgaacacttacaggccagaagagaattggatgatctactcagtgctgaaaaaatgtcagtcaaaaatgctatatccagcaaaattatccttcattaatgacgtagaaataaagtctttcctagtcaagcaaatgctgagggaatccataaccactagaccagtcctacaagaaatgctcgtcctaaaccagaaagcaaaagaacaacattcaccagcatgaaaacaagtaaaagtgtaaaatcactggttaaaataataatacaaaggaggaagagataaaactcaaacagtgccactgcagaaatccaccaaacaacaaagagtatcaataagagaaaaagaaaaggacaaggaatatatacaacaaccagaaaacaacaatatgacaggaacaaagcctcacgtatcaataataatcttaaatataaatgaactaaattctccacttaaaagttatagactggctgaatagattagaaaacatgaaccaacttttgctactaataagaaactcaccttaccagtgaagacacatatagactgaaagtaaaggaatggaaaaagatattccacataaaaggaaaccaaaagcaagcaggaatagctacatttatatcaggtaaaatggactttaagtgaaaagcagtttaaaaaaagacaaaagtcattatataatcataaaggaatgaattcagtaagagaatataacaattctatatatacatgtactcaacactggagtacccagatttataaagaaaatattactagatctaaagagagagaggctataaagaataatagtgagagactttaacaccccactctcagcattaggcagattatctagacagaaaatcagcaaagaaacattggatttaaactagtctttagtccaaatggacataatagacatttacacaacattctatccagcgatggcagaatatacattcctatcataagcatgtggaaaattctccaggatagatcatatgtgagacagcaaaacaagtctcatcaattttttttaaaaattgaaattatatcaagtatcttctcagaccacaatggaataaaactagaaatcaataccaagaggaacactgaaaagtaaacaacaagctcctgcattaacattgagccaatgaagaaattaagatgaaaataaaaaggtttcgaaacaaatgaaaataaagacagagcataccaaaacctatagggtacagcaaaagcaatgcaaagagagaattttatagcaataaatgccaacatcaaaaaagcagaaaaattcacaatctaaaggaactagaaaaacaagaacaaaccaaattcaaaattagcagatgaaaaaaaataaaaatgagaccagaactaaatgaaatagagactaaataaacaatacaaaggatcagtaaaacaaaaagttggttattcaaaaatataaacaaaatggataaacctgcagctaaactaatcaagcagaaagacctaaataaacaaactaagaaataaaaaaggatatattacaacagataccacagaaatacagaagatcatcagagaactattatgaccaactatacactgaaaaactggaaatggataaattcctagaaacatacaacctaccaaggttaaatcaggaggtagaaaacctaaacagaccaataacaagtagcaagagtgaatcagtaataaaaagtctctcaacatagaaaaaccctgtatcagatggaatcacagttgaattcaatcatacatacaaagaagaactaataactaccttcctgaaaccattccaacaaattgaagatgagagtattctccctatctcattttatgaggccagcatcaacccgacaccaaaaccagacaagaacacaacaaaacaagaaatccctaatatgtctaaggaacatggacacaaaaatctgcaacaaaacactagcaaaataaatccaataacataacaaaaagataatacaccttgatcaagtggcatttataccaggtatgcaaggattgttcaacatatgcaattctataaaggtgatacattacattaatggaattggggacaaaaaccatatgatattccaatagatgcagaaaaaaaatttgacaaaatttaatatccctttatgacaacaactctcaacaaactaggtatagaaggaatgtacctcaacataataaaggccgtataggacaaacgcatagctaacctcatactcaaaggggaaacgcagaaagccttttccttaagaactagaagaagacaaggatgccagctgtcatcactcctattccacataggattgatacctaaatgtcctgacttgatcactgtgcattataaacatgtaataaaagtattcattgccccataaatttatacaaattttttttaaaaaaagaaataaataaaaagatatttttaattaggagaaagtcaaatataatttgaaaaataagccactcataaaccctaatctaagttaagttaaaaaggtcactttgcttgagtatggaaaatgtgactggcaaatacagaataaagtgccatttgaggaaatacgtacattttacaagatgtttgttgcatgtaccctgctgaaatatcagtgagtatcttgatgaacaagttttcaataaatttatattaattagcttgttattggttcctctaaaatatgtattgttaatagcaggtagaaggaataagttcagtgttcaataataaaataggaaattgtagttaacaataatttacggtatacttcaaaatagctagaagagaagaattgctatgttcccaacacgaaagaaaacataaatgtttgaggtgatgggtatcccaattatcctgatttgatcatcacacattgtatataggcatcaaattatcacatgtacccccataatatatataacttatgtatcaataatcattgtaaaagaaaaaataataatttttagtttccctgaggagatgctttagacacttttgcttccttcctatctctgtcaagcaaaactaaatattaagtagtagagtcttctgtgtaagattgaagattatggagggcaacaatctgctttgttcatctttgtattcctagtgtctagcacagtgccttgaacatagtagatgttcaataaatgtatgttgaataaaagagcacatgaattattaatatgaatacattattatttgtcacaccatccaattaatagacttttagggatttgttatgtttaatgtacatatccaatgtaagatgaattctgtagtagtcgatcttgttttttaatgacgaaaatgtgtctcaaactaacgtaggcaaaagggggattttatgcaatgatataataccacatacctgaaggctgtataagcaaatgctatgaaggatggagtcaaggtgtagctggacctaaagtataccttaactagagacatccagaatcaacactgtcagcttctctgaatacgggcttcatttccaatgaaaactaactcctttatgccttagaaaacatacctgatcctaagtctaggtattttcatatcttgcagcacttccaatccccctcctaccagtaagtatgtttttgtgatagtttttacaaatattatgttgtaaatggccagttcaggtgataaagcataaatattttgttgacatattgattggaaaattaatgggaaaacattaggttgaaaacttgaacagatattctgttcaataaaagttctttgaatattttaataaaaaagaaattgtggcttatgctgaagttaatgaatattagggataaaagtaattaaaatattttaaattattttaagtaatatttgccatcttttcagactccatggaaacaatattctgcttatctctccatatccccaacatttggcacattgcctggtgtattgtaaattgttggtttacatttgttattaatatattgataataaggtcttctcggctcacatatgaatggactacaattaggcagttgtgataagaaagtatgtacaaaactagcaaatgcatcccatattgtgacccactcatacttaaagggcaaattatataatacaaattgtttagagataaatgccctgcaagataagcaaggatctagaccaaaaagaatatgtctggttgggcctggtttgtatcatattcttaaaaatagcctgaaatagtacatcgtttctttggaattcattgaagatgttaaatacgtgggaaatccttgagaggagtagaactaagtagaaataataataaagattttgagagaagtggttatttctgccaaattagctagaagaacaagaacatggctaaatattttcacatagatatatttggatgagacttttgcaggagtgcgtgaatgccaatattgttaattttgtaataaatgccatattttattgaaaaaattctttggcacaatgattttttttttttttttgagacggagtctcactgtgtcgcccaggctggagtgcagtggcacgatctcagctcaccgcaacctccgcctccagggttcaagcgattcttctgcctcaggctcccgagtagctgggtctacaggcatgcgccaccatgcccagctaatttttgtatttttagtagagacggggtttcaccgtattggccaagctggtctcggactcctgaccccacgatacacccgcctcggcctcccaaagtgctgggattacaggcatgagccaccacgcctggccacaatgattttttgaagttattgaatgcaagcaaaatcacaaatattgtttttttgtgtgtgttctttactgaaagtagaatgtagccctcacctatgaaaatatgaatgcctttaagcaaagccttcccttaatttaaattgaacctaaaaaaatgcttcttgcagtagtgaaaaaaatatttttggtaatctaagagtgatattatttagaatttccctctctaatccttcaccaagaataaaatgaaatcttagaaacggaagaagtcttataaagattgtgactaaccctttagtttttacaggtagaaactgaatttctcatgattgattcttgctgtctaaggacctactatttatgcatacccatgcaatgaaaactaagtttaaaagcataaatagttaaaagtgtaataataattgaaaattgcagtaacgtttttcttaattgtataattattgattcaagtttaatgttctttatgtgaattacatttttagtttgagggaaaatattttttaatgaattgtttttgctttgctaagtgatctatttcaagaaacagtctttctccagaaaataaaggaaatttcaatgaaagaaaaagcactcttctgttattccaaacatgtatatttcttagatcttaaccacggaagagtaatgttgaaagaaaatcattcatgagcattgattaggaaattggtgcccattgagatatgctcagcatcaatataaacgtaatttttctttaaaagagctagttgtatgtcagttgacttgctgaaaatgcttcggttatattattaaaaacagaaatttcagtggcttttaacttaggaataaacaagagtaaaggtgagaaacttgaaatgcaagtttatcaatctccctttgtcatatagaaaattgattagaattgttagcccagtaaagtgcagatatataatagatactaaatgtagaaaaactaagaacataatattggctacaaattagacaatgcaagaagaatgaacacaggttaatttaacttgttagtctcaaatatatattatcacctgtttcacagcaaaattatactatttattgtgttttattgacagaacagagtaccaagtaaaagaagaactattagactattaaaaaataaaaaatgccatcacatctgaatttatgttaatgagatggtgttgaataaagctcctagatagcctcaagatggggctagtcaccagaaagaccaaataattagagagctggaaatttcatttccacccgccagcctctggagatgagaggagggctggagagtgagttatataaacttttcaccaatgagattcagggagcatcccacttggtgagcacactggggtatggggagcgtggtgcacccagagagggcacagaagctctgcaccactccccaacccccataacttgccctatgtatctcttctatttgttcccgaattgtagcctttataataaaccagtaaatgtaaagaaagtgtcaaaaacaataaaaaatgaatattagtggaatggaaattaaatattccccattaacagtaaaaaatgattaccgacagattgagttggggaatgtgaattacatagtgactttcgagtgtgatctaaaatgaattcagcaaacagatctatgggaaataatcagtttataggtgataaaaaattacttcagcaataacactgcggaggaagttagaaaaacagtaaactcatacagataattgatacaaaaaggacagagcaaattctccagtaattaataaataaatggcagggattggggtgagggtaaaaaaaaaatggctcacgcctgtaatcccagcactttggaaggctgaggcgggtggatcatgaggtcaggagaccatcctgcctaacacggtgaaaccccgtctctactaaaaatacaaaaaattagcagggcatggtggcgggcgcctgcagtcccagctattcgggaggctgaggcaggagaatggcgtgaatcccgggggcggagcctgcagtgagccgagattgcgccactgcactccagcctggacaacagcgaaactccgtctcagaaaagaataagaactcaaatgcttccatgaagtcctggcagcattttcattgctcccatgtgtcgtcactccacatagcagtagaaaagcttcaccagagtcaagtctccaccacaacaatgctcctgctcattcatctcatcaaactaaggagactttgggagagtttcaatcagaaatgtataggcatcctcattacagtctttttctttctaatttaaatttttgttgttgttgctgctgaggcagagtctctctttgtcacccaggctggagtgcagtggcacattctcagctcaccaaaacctccatctcctgggttcaactgattctcctgcctcaggctcccgagtagctgagagtacagaaacatgctaccatgcccagttatttttttttattatttttatttttttctgagatggagtctcactctgtcgcccaggctggagtgcagtggtgcgatctcggctcactgcatcctccgcctcccaggttcaaatgattctcctgcctccacctcctgagtagctggggttacgggcgtgtgccaccacgcccggctaaattttgtatttttagtagagacggggtttccctatattggccaggctggtctcgaactcctgacttcgtgatccacccacctcggcctcccaaagtgctgggatgacaggcgtgagcgactgtgcctggccctccttatagtcttgatttggctacttctgcttcctttttgttttctaatcttaagcaatctttaaagggcacccatttttcttcaattaataacgtaaaaaagactgcatttacctggttaacttccagggatccttagttttttagggatggactaaatggctggtctcatggcttattaaagtatcttaaacttgatgaataaagtttatattttttatttttatcttttaattatatttttccacaaactttttgaagtccccttgtatttcaattgcaatttctgtagcaaagtacttcaaatcagccaaaactttttttttgttttaacgtttatatttcaggggaaaaaaactgaattcactaatggttgctcttaatttgtgttactttcaaatgttgtgttcactatttatgcaaattaaaactgtaaactgaaattttaattttattagtttcatggaaaagtttagaaagcagtggatttataatgtgaatagcaattacaattatattttactagttatatcccaggcacattcttgaataagaagttgaattacagcctgaaggagtgggctgtccctctcctgttggggatcctccactgggaatcagtggcccccaaccgttttggcaccagggacaggtttcatgcaaaacagtttttccacggatggggtgaggatggttttgggatgaaactgttccacctcagatcataaggcattagattctcataagaagcgcacaatctagatcctttgcatcacttgcacgggcagttcacaatagagtttgcgctcctgtgagaatctaatgctgccactgatctgacaggagctcaggcagcaatgcttgcctgcactctgctcacctcctgctgtgcggcccccttcctaacaggccacagacccataccactcggcagcctggggtttcgggacccctgttctagagtttctaaactctacaaatattttttctaggaatagtcagctttatgccttgacagaatggattctccaggctgtgatttgacatcagaattcatataaggattcatgtataaagaacgcatctgatactcttctctacttccctttaaattactatttcccccaatttcatttatattaagtcaaaattcctatagtgtttaatgttagcaaaaatggtactgtgctctaggctagattattaattcctttcatattgttacctcatttattattgtgttgaaagctttattgactatgtaagctgtcacaatttttttggaagtattagtgtttatataatgaaaaattaagtaggtgaataatgtatgagttagcatctagcccctcacttgttttgaatgagtcaagagattcagatactattttgaaagttataataaacagtaatatgaccacattcagttctcttttaaaacgatatagatgtaataaaatgaaggaaggatatttcgaaaatgctcttttgattttttttcaagtcctttcaaggatgcatgtcacatgtctggttcctagcaaaggtacttggtctttaggtcttctcaaagttgtaagtcctactgaagttgtactgtactgagttatacatgatggttttatattatagttcagacactctagggcaccaggtgtgtttttttttttttttttccagtaacagtagggactggttataaaggagaaaaatcacttctttccctatggattaattgccctcttaaataaaataatcaaatacagtataagaatataatgtaatcatatttgtgatagatccaaattactaaggtaatgaactatcaaaagaaaacattcctgtggagttaaaaggatcaataaatattagtgtggttgtaccatcaaacactggactaagaaccgaagaacctgaatttagtcccttgagattttagacaaatggcttaatctctctaagcttcaggctactgatcattaaaatggggattagtaatacctggcttcaccaattgtcaaactgctcatgaagtacaagtgaaatattccctgaactgcttataatctttacacttatttaaaaaaggtgtaaagaccaagaaggtaaatttaacattagcaacaacaagaaaacctacatacttgattaataagggtgattttatttgattaatatatatgtaaagttagtcattcagggaaagtaaaacataaacaaatgtaataaatacattaatgactgactccaaaagaagcatattatagcttggaaatcatagtgaatctctcaaccaattcctgcaaaactgactcataattatgccccaatcgagtctaccctctgattcccctaatagcaatcatggagcttggttgtaattgattaggagaaacaaaggtaactgtgctagccattatattagggtctctaatttattctcaaactatctgaagaatttctattaaggggactgagtctacataaaatatggaatgctaacaacactttcttaattacctttgtagtaattgctaatgtataataatatattaaacaaataatagtgatttgtattattaaaataaggattttcaatttctcagcatgccatatgcagccaaagccaaacaaattcaaataaggaaaagactctttttttaaagcctgtgagacacagaatactattttagtgagatacatatatggtacatacagtatatatatagtacatacagtatatatgcatctcaccaaatatatatatctcactgtattctgtgaaacatagaatactattttagtgagatctatatatatatatgtgggtactatacatatatgtagttaagaatcaattccaatcaactctttagaaaatgatattgatgtatatttgtaaatgcttgtatctttagcattataatctatgcttgttgagtcaattctatttaatttgaaattgtgatttttacacaggcacccaacaatttgctaatttttcctgaactctccttccatggacatgccctgtaaacctacctatattgctcattatgaaattaacttatgacaaatctttgttcattttacatttttctaaagactgttagcttgcattcatttggcttgaagtttctatagactaggccacagttattttttctttctcttgatttttcagatatgaatttgaattgattcattacttttcagccattatgttagatgcattccaaacagtgccctgcagggctatccagaaggagttttggtaaaaggagtgagtagttattgaaagctctattcctttatatgttataaaacaaaatggatttgctaaagccttccatctgttcctttatcattctttgcattaaaaaaaaaagcttttagaagatgcagacccagtctgaatcttttattgttcccatttcaactgacataaacaaaattattcagcgatgatattaaaatatgagctagtctttataagttgcatgactagatgaataagtataaatagtttttgtattcttcagctgtctatgagattatggttggtgtagatttgtaccaagtgatctgaggggtttctttaattgttagtgggagttgtggataaggatatttactcatttttgcattattactgtactaaatctaagccaattataaatgatcagtccccattttattctttttcattttgaaatttaaaataccattttcttggcataaatggtgtttgtttggcattttgaggtttacaaaaaccatttgattggcacgaaacgatttatttccatccaattgtcttgaatagggaattactttcatctagataactttcagattttagggcatgaaatggaagtattcctgctgggattctgattgggactgtatttactgtgcagtgaaccttcatttgctacaaatcaaggacttttccaaagcctttgagtagacttctgatagtggtagtaattgggactctggattaaaggtggtaacagagtttccatgtgctctgagatcaaataacattttagtaaaattagagcttagaaataggtgtgactctcgtctctagtttgtatatactcttttcacttttctctttccctctcattgtcctggcatttttccagtgcactggggatgaaagccctagtttagaaaaaagtatatacgtgcacactcacatgtgcacacacatgtatttgctttaaatcatatttcacaaaggagtaggtaatccgcatgaaatatgcagtcaaaaaggaagtcttatccatattttgagactctgctgggacatctatctttcagccattctcagcctctctggggttagtcttgctagagaattatatgctcatttttgttaaaacaacaaaactacatttgtaaagttgttattcatacttttttctccccttattgttaccagccaggtccaggtccattctgaccatgcacagtaaattaatcactgtgacgtgggttttgcagaagagaaatttattcacacagacatccagcaaggaggcaggagcacacctctcaaatctgcctccccaaagataaggcttagcgatatttatgagttagggaagtggggtggtctaaggcatggggaaaggtgattcgcagtggggaaaaatgaagtaatgggtttattctgtgcaagtatagtcaggattgatggcatttcataggacatatgtacagaaaatggcagcattagcataatctgagggtcaagttttgggccctctgaggtgaaaaggacatctttccggtgcctgtacaggctccaagttgaaggctaggtggtctcaactggcttgaactggacaggagctggcccaagttcttgaaaaacaaataaatcaaccattaccatggtgaccaatggatgttgtctgtaaagtaaccagtgaaggttaagtttcagcattcagcagagaggccttcagctacagtggctttcagcttcatggaaaaaagaaaaagaataataataataacaaaaagcaagtcagtgaaagcaaacagggctgtcagacccgatcaaattaacccctcggtttccttatagttactcagccatacttaaggttggtatgaaagccatttttcttcttattttatagatgaggaaacgttcagagaagttggcttttgggttgatcagcaatgcttggttttaaacttggctggctctctctgggaccagtgctctttcaggtacctggtatgactgtggcttggctttcaagctctttaccagatttcctacatatcattcatttacccaaaaatgtttattagtattttaagaatcttgtgtgctgccttttttttttagtgccatattctctcaattctaaatggcacatttttcccactactaaaattaatgtcccaatggcattttttttcaaaatctgagaataaattgattcaacagctgatgtcatagaaatgaggaagaacaatatttgcgttccatcactatgcctagaaaacctattacatgtcttgaattccctcttctcctacctctgaaaaaaatgtttgcttttgtgtgaaaactttatgtatctcagttactattatttctattcttacaatcttcctttattaattttcatgattctaaatttattttttaagtcactcagttttttcaagaaataatccttattgcatagttttttttttatcctgagagaatttgatctagtatctactagtttttcaaatgatcttgctaaatagttactgaggtttttcaataatggctggacttattggaatgtattttctccattgcgttaacataaacattatcctgtcttcaaacttacttatattccatgacatcttgtcagtatttttcagccctggtatgaaaaacaatatgtaagaaattaagttttataatttcttgctgactttttctgtctttgccttaactgctggaggttttgttaccagatatgacaggacctgagcagagtgaaatcaaggttgaaaaaaaattgaatgtctgaaccattgaccctaagagcaagagggaaggaagaagtggaaagcattccaaaatattatgttcaaaggactatggagctcaaaacctcagcataaagaattgaagtgaaatcaatggctccattattagtggattaactaaagtattgaacaggagaccaagactggatttttgttgaatgaaccttgcccacatgagaaaagttagtgaaagactcaactgaacgctcaatccaaggcatcctttgtatttgatctgtgacatcaaaactgtttccaacatgtgatggtcatgtttacattgtcttagtctggcttcattaactcattcaccatttatttattcaacacccactatctgtaagacactgtgataaacaagtgatatacaagataaacaagagatatacaagataaacaagagatatacaatccttttttttccccctatagactgtagtctattgggaaacttgggcaataaaataggtaattacaatgaaggctatagctttgatatcaggagttagtctagctccctctctagctctatccgtctcctttcccaagcccctctgcccttactttttgtttaaacagctctgatcatatcaagttattttgaataactttaaaaaatgcaggaagatatacagtccactgaccatatgcctcagtagtgaaaaaatgtgtttatgtatacctgcctcggaatgaagcttcctgtacctccaaatttataataattttccaaatattttctcagcttttttcaacacttcttttacagcatcctagatcaaaatgattgattttagagatttttattaaatattctttaactcattcctactgtatgctaggtactatgctatctctcaaggatataatgataagtaaatagacaggctgacatgctatctatacttaggaagtttacagtctagtggtaaatacacatattaaattaaaaatatgcaaatgacaagtcagcttgtcatacatgttaacagggaaattgcaagagcatagaatttcctcatgggataaaagtgagtgggagagaatttagatgaatgtgaaaagactgactcttggtgaaagtttgatttattttgaatcctgaagaataaagatttattcaagacacaacatgggggaataattagttattcccacattctcatatttagtttcatctcatctcatatttctagatttaaaagtttggtcatggttttttaaagatgtgaattaccttaagtctctaagtcaagactctgtgtctctaaacttggatcagaaactagctggagaaataagaaaagaaaaaaaagactgtcatgcaaatgtctaaccatttaaaatatgaggatttaaggagccaaaggcagatcagcaagtgaaagcttttcacttccgttaacatttctcattctaaattggaagttatgtgctatgacaacataagaagaggatttctaactcagagtaggagagccaaggaacatattctaaagcaactgatttcagaattgagacctaagtgataattaggagctaatcagaagagcagatggcggaaggagaaaaagtggaggaagatagcccagaggagtcagggagtcaagaaagaagaggaatttgagaacgagcccagaggcaagagggctgaaaagtcctgtagttcagtactcggagggtgctggtataggggaacagtggcaatgtgtcactggggaggtgatagggaaggcaatgagagacccttagattgtattaagaagacaagtgacttgattgaatttttgtctgcaagaaagctctggctactgttgtgaaaacatttttgagtgaggcatgactgtgaagcagaaagaatactagagggtagtgcagtaaccttggatagaaatactaatgacctagtctagtggttaccaaactttgttcctcaaacactcccaaaataattttgtaaaattgtatatcatctcatatacttgtgaattgacataaacattcatcataagtttaaaccgttgcaaaatgtaattttcagcatattgtaaattttgccattttaaattgtctgttgtattactcttaatagtatccattagagtctgaataataccgagattcaatgctcgtcattatctatttaaaaatatttgatatatctcttgcacaactctaaaaattttgtgccatttttttctttttaatttctattttcattctcatggatttcactcttttattatatatcatatgctcaaaagtatttaattatctaataatgcattttagttataaaatggttataatttaattttaaacatttcctataaggttttaagtgttaattatttttctagaatgagttgtcaataaaatttttattattgaacacttgaataaatctatataactacatttcaaattctgaaaaaattgttactgacaaaagaagtacaactttattggcaatgtatagcttaatgtaacagacgggcttttaaaattttaatccctctacctttgggagaatgttacttattgccaaaattagacagagtttaatattaattctgttttgaatttgatctattgtcaaaaattatctttaataaacttaattttgttgaatgcaaagaaatggaaattgcttgacttacgaaataatttagttgctagccattcactttctcaatagccataccagtatttctcaacatttatatcagttatctttttgtttggtgctcccaaagagtttacatgctcaatcaatgcacattaaattttgggtgggtgagaagtatgtctttcttctgtaaaataagaggaaggtaactaggaaagagggagctggaaagtagagcctgcacttgtgtctgaagatagagctgaagataaatgtatcttaagttaattatctaaaatctttttccaagtacaacttggaaggatttgtatgccctcaggaatatatatacaccagtttaaagaccactcagatagattgaggcagtgacaatgacagtagaaaaaagtggaaagacattagaaagaaagagaaatataaggtgaaaaactcaataaatttctgtattgtgttagattggtagcatgtataaaagttctagaagtcaacaagagtgggctacattttaaatattcctctggagagtagaaaatcgctgagtagggaaatagaatgatttgcctggtatctggagataatgagtttatagggctgacctgcaaggctgtacaattttctctgcagtcatcagccacaagggtgaagatgcagagaaagcacaaagttgagggctttgcgtgctaatttcagaaagtcgattttgagggatagtgaattattatgaatgaaaattgataaatttcaatttctctgggcaagataaactaaaagtggactcaaacagaggaatgtatgtgtagtagtaaggaagatttgccaaagtatgtcaggcagggaaaagaacttgaggaaaaagtccagcagcaggaggtctgggatgtcctgcaaggttgactttgaggtaatccatacacaaaaataacttgagaatgcatagttccgagaaacaacccctgcagatcaaagcaaagaaagctgccataaaaataatcagaatgacattcaggagacaaagttctggaacattctagactctctctctccaatgttttacaaacatatacttaaagcaactatacaatatataacacactggacattatattatttgaaactattgacatacatattaataagagtttagatgtcaacgtataatatgcaaaggggtacataactttttaagggggttttgtaggcaaaaactttgaagaccactgaaatgaagtactgagaactagaagcagaaatttagagataatgatgtttgtctagatgctggggaatatgtgatgctgaaggttggtgctggtagacttagagtcaattttaataacaaatctacacaacttttccaaagaattgtatgactatgagtattccaaaggtgttcaccaaataagccattctaagaatttggtagggctgttgaaaatagcaaaggcagtatgggcaggtaatacctcttttagtggaaaagaatttgataaattcatcttcattactacattctagcttgcagaggtttgtgggcagtggagatgtcttaggaactttgatgaaagttgacagagaaagcagcctggggttagaaacatttatacctttaaatcattcacaagaaatgaatgacctgaaagcaggtgggttctcagaaaatagacagaactatggtgctgctccagtagagaaatgaagttgcttcccgtggaaaaagtcaagtcagaaccttgatgccttccagcaaaatagtattaaattgatgaattaaatttttctaaatgtgtttttgcatactcatacaaaagaaaatctcggaaaagtcagtcattgtcaccttccaggtacaaaaagctgagctctgcatacacagcccttcatatttccagagatagcccaggccctaaacaggatttggccagcttccttgactctctgtatgaatctgcaagttcctttgtgttttgtttttcttgtctctggtagtggtggtggtgggatattactttttaattctgtgtacacattgccacaaatttagcaactgttaaaacatacttggttatctcaatttctttgggttaggagcatgggcacagcttagctggatcctcggttcagaatctcacaaggttgaagtcaagtttggctgggctgtgttcccttctggagcttggtgttctctttcagttgttagcagaattcagtgccttgtagttacaggactaaggtcctgatttcttgctgtcagctctgagaggtcactccctattctttgcccttctcactgcaccttcatttggcctctcccaacatagcagctcacttcttcaaggccagcaggagacccctttctcttctggaagggcccaagccctcttttaaggactttcacttgattaagaccagcccattcagaataatttctctttcaattaagtgagaaccaacttatctgagaccctaattaagattaacaaacaatatgaaaaaaagctgaacatcacagattattagagaaatgcaaatcaaaaccacaatgagataccatctcacgccagtcagaagggcaattactaaaaaagtcaagaaacaacagatgctggagaggctatggagatgttggtgggaatgtaaattaattcaaccattgtggaagatggtgtggtgattcctcaaagatctagaaccagaaataccatttgacccagcaatcccattattgcatatatacccaaaggattattaatctttctattacagaaatacatgcacacgtatgttcattgcagcactattcacaatagcaaagacagggaatcaacccaaatcctcaacagtgatagactggataaagaaaatgtggtatatatacaccatggaatactatgcagccataagaaggaacaagatcatgtcctttgcggggacatggatagagctgtaagccattgttttcagcaaactaatgcaagaacggaaaaccaaacactgaatgttgttacttagaagtgagggctgaacaatgagaacacacggacatagggaggggaacaacacacactggggcctgtcagagggtggggttgggggagggagagcatcaggaaaaatagctaatgcattctgggcttaatacctaggtgatgggttgataggtgcagcaaaccaccatggcacatgttgacctatgtaacagacctgcacgtcctacacatgtaccccagaacttaaaataaatataaaaaatttaaaacagatataaagaggagatgatggtgaaaggggatgaaaaggttaaagaatatggagaatagacccataagtaggtaaaataaatgactaatagactaatagttccagaaggcgagaacagaattgagagatgaggagaggggtaaactatggactttagttaataaatatcaatattggctcatcaattgtaacaaaagcctcacactaatgtaagatgtaggatataaaagataagataatagcggaaactgtgtgggcagatgaagggggtatatgggaacctatctgatctttttatcacaatttttctgtaaacctaaaactgctcccaaaaagttattaaaataaataagtaaacaaattgtgcaatggaaaaaaaaacaacgacaaaaagattttctttttttgcacttttgccacacagtattttttcacttttgtgtaacctaatacagagagtaatatcccatcatattgacagcttccacccacattcaagggaagaatcaacaggagcattatgctgggggtcagggcaagaattttgagatcttacaattctgtttaccacaggagtgaagggtacagaattatagtgatatttgattatctatatcctgtcactttattataaaattacttgattcaagttttaataaatttttaccaatgctaatgttttcaatttggcttgcttaaataattcaccatccaaaacttttctactttcaacatttaaaactgaagactgctttttatagctgatgtcagtaaaaaatctattaatataattattaatcatacttttccaaaacttttccaactatactgttttccttgaaatagaacacccattatcttacatattacatttgaagtcttcacctgttacaaaccctataagacttttacattttttctaattctttacataatattgatcagaaatcggatttttaaactcattaggctcaattcaacagacaaaattcatctttataaacatatattgcatactttattagctagtcagtttgccaggatataaaactgaaaaagattattctgttctcaaatagtttgtgaaaaatttcctgatgatacattaggataatttttaatattttgtctggatgtcttctaaggtctggtgcaatatgtgtgatgtcttctttaataacacttatccagttttgattctctggacaccaactgggtgttcaacaattcaattcaattgtgcctttaatttattggagttagtgcagaccccacaggttaatggctcagtcttacaagattgccccccacttcagatgccagttgcaagcctcaagcttcctgtatttctgatcaacgggctacaaattgcaggctcccacgacatcttacacaggtttaataaattgctgtaatgtctcatagaactcaaaagaatgctacttactattaccagtttattatgatggatgcaactcaaaaacagccaaagggaggagatatgtagggcaagtatgggacaaggggcaggagcttccatactctctctaggcatgccactctcccagtaactccatgtgttcgccaacatggaagctctgcaaaccccagcatttagggattttaatggaaagttattacttacacatgattcattggccattggcagaaagtttgaggtggggctgagagttccaaacttctaatcaaggcttggtatttctggcaaccagctccctcatcctgaagctatctaggggcccacaaagagtcaccttattactacaaaagatacttccatcatctttaacactcaggaaattccaaaagctttaggagctccgtgccaggaacaggggacaaagaccaaatatctatgttaccactcagggtaatgtaactaccaattcagaaattatcactgtacaacataatttaaattactttggaaagaaacacatggctactttaaagttaattgaagcctatttgctaacttaaagaacatatcacattttcttgacatttgccccaactgagttggcttgtccatgttaagtttttttctctttctgcagacttaagtgttttggctgcatttgtctcagcccatttataaaacattagatgaaatgttttatctaatgctcctagcactaatccttagggaactctgattaaaagttttctatttagaaaaaaatacatactcatgtttaaatttgcctgtttaaaaaaaaagtagaaatgtctctcaagtacctagtgaaacatttttaaagttttttaatggaatcttgtttcataaattaagaaaataagtgtaagtaatttctactagttttctttctctttgatttttttttctcttagccagagattatttaggaatgtatcttccccttgaaatactgctggattgctccccagtgcaccattttattgtagaagtgagattcactcactctataataatccttaagaaccgttctgtgcctatttatatttaccaatttctttaaaagaaccctcttcaaaaaagttattttcagtttactcattaattttttattggtttcctttgagtttacaatatgtatctttacttaatcacttttgaataatattatgccactttctatatagtacaaccacctttacaacagtgtacttccagttctttctgccgtcactgttactgttgtcatacatggcatttttacttatgtcttaaacctcacaacatattgttactatttttgttctagatagtgaattttcttttacagcaattacaaattaggaaaaagtgggagggttgcttgaggccaggagtttgagggctaggagtttgagaccagcctgggcagccgagtgaggcccctgtctttacaaaaataaagaaaaaaaaaaatagctgggctgcacctagcttctcagaagtctgacgtggaacaatcacttgtgcccaggagtttgaggttgcagtgacctatgattgtaccactgcattccagtctgggtgacagagtgagaccttgtctcttaatacacacacacacacacacacacacacacgaaatatttttcttatttaccctatttttacttttctgatcctcttcacttctttctgtagatccaggttgtgttcagtgtcatactctttctgctgtgcagcccagtttctaacaggtcacggactggtaccagtctactgcctttcacatttcttaaaatgtgggtttccctttatggggtttacagaggttactgatttctcctgtagtctgacaaaaataaaatgttacatgtgtttcctctccttttggagaggtttggctttttttgttacccaggttactcggtggctttacaacttcaggtctctgatacactcaaggaaagttatgaatatcatctggcttttttcacattgttacacagaggcgagattctttgaagctttcagcatccaatgcagaagcagaagtccactcacaattcactccttcagtgattgtatgctgtattgtcaatgtaaaggtcatgaaaaaaatctccttgttatttcatgaatttaacactcttttctgaactgggtaaagactccttctttcactgaatttgccttaataccaagctacatctgtaatctttataaatactgaatacatgcttattgaaagttacagagcaaactggtttttctccccatttcatcctaactgtatacataatattttgaaatctaccattactataaactagaagcatttttatatttattaaatatttacatcttttctctaccttattaaatgaagatgtattaaagaaagcatgttttaactttagtcatttaaaatatagctatcacatatttgctgttttataggcattgaggaagatgttcatgagagcactgtcctaatgacaaaaattgggttcagggaccttgatattttatgaatttaaaatgataatcttagaattattgccaaatagaactgcaggaagtatattatgttcaatgctggactgttagaggttctgaattaatgtttatgaatataagattcatccatgatacttaagaaagctaaaattgttgggattttccttctatatactgttatttcagttaaaatataattgatgaatagataatttataattctaattctaaaatactgtaattctgtattagacagaataggctaagataaaataggcaacaattgtattaacaaatatccataaaaccttaagtatttgacatagtaaaggtttattggctattcacatcacagctaaatgcactaatatcctatctcttaatttatgtatagcaaataacctctaaggattccctgtagtaggagtccccagcccctgggcagtagactggtaccagtccgtgacctgttagaaactgggttgcacagcaggaggtgagcagcagatgtgcaaatattaccacctgagctccaccccctgtcaatagtagcattagattctcataggagctggaaccctattataaactgtgtatgtgagggatctagactgtgagtttcttatgagaatctaatgcctgatgatctgtggaacagtttcatcctgaaatcattccttctcatctgtggaaaaattgtcttccacaaaactgggacctggtgccaaagagattggggattgctgctgtatagaacaacaaagggctggaggattaggtgggatctggaccgaccttccttccttccttcctccctccctccctccctccctccctctcttctccttctcctccttctccttctccttctgcttcccttcccttcccttctctctgctttccttttttttttttttttttttgacagagttttgctcttgttgcccaggctggagtgcaatggtgcgatcttggctcactgcaacctctgcctcccaggttcaagtgattctccttcagcctctgagtacctggggttacaggagcccgccaccacgcccagctaattttttgtatttttagtagagacagggggtttcaccatgttggttaggctggtctcgaactcctgacctcaggtgatctacctgccttggcctctcaaagtgctgggattacaggcgtgaaccaccatgcccagacctatttttctttttcttttaataactttattgagatattattcacataccctacaattcacccatttaaagtgtacaattcactgatttatagttgtgcaatcattaatctaatttcagaacatttttattccttaaaagaaactctataagtgttggcttcattctgcccccatcccctcctcttacccctgagcaatcactaatctactttctatctttatgatttacctattctggacacttcatgtgaatgaaattgcactatatgatttcataccttttgtgaattttctttcacttagcataatgttttcaaggttcattgatattgtatcatgtaaaactacttcattcctttttattactgtataatattccattgtataaatataccaccttttctgtatccgttcattagctgatggacatttgagttgtttatgctttttggctattatgaataatgcagcaatgactatctgtaagttttgtgtagatatatgtttttatttctctcatgcatacaattaagggtggaattgctggggcatatggtaactctattcttaaatttggaggcaaagttaccaccaaactgttttccaaagtaacagcactatttttacatttccaccagcatgaataaaggttcctttttctccacattctcaccaaaatttcttcttgccttttttattaaagccatcatagtgggtgtgaagtaatagtttattgtgggtttgatttgcattttcataatgagtaatgatagcaatgatttggatgtcttttcatgcgatcattgtccatctgtgtatcttctttggagaaacacctcttcaaatcctttgtttatttatctaattgggatttttgtctttttaagtattgagttataagagttcttttataattctggatacaagtcacttattagatatatgtcttgcaaatattttgtgctattctgtgagtagtctcttcactttcttgatgatatactttgatgcccaaaagttttcaaccttaatgaagtctaattctatttttgcttttgttgctgatgctttttgtatcctatgtaagaaattttggcctaactcgtggtcaaagatttactcctatgctttcttccaagaaacatacaattttagctcttacatttagatttatgacttattctgaatcatttttttggtatggtgtgaagtaggggtccaaacttattttttttgtatttgaatatttagttgtttcagtaccatatactcattgaactgtcttcacattcttttcaaaatctattgaccataagggtaaaggcttatttccatactctgaattctgtcctattgatctatatgtctattattaccaagactacattgtcttgattattgttactttgtagtgaatttgaaatttagaactgtgaattctccactttgtgcttcttctcagtactcttttggatattctgggtcccttggattttcatattaattttaagattggcttgtcaaaatttgcaaaaaagtcaggtgaaattttgaaagggattacattcaatctgtagaatactcttgggaatattgacatgtaaaatatattaagtcttctgaacaacgaacataagatgattttccattaatttaggccttttgtttcttaaacaatgttttgtagttttcagtgtaaatttcttgcacttctttcatcaaattctttcctaagtatgttattcgtcttggtgctattgtaaatttaattatttttaaattgtatttttagattgttcattgcaagtatatagaatatgattattttttgcatatttatcatctaccctgaaaccttgctgaattcatttattagccataatttttttagtggattccttagaattttctaaatacaagattatgtcatctgccaataaaaatagttttattcttttttcccaacctgggtttattttatttctatttcttatctatttgctctgtccagaactttcagtaaaatgttcagtagaagtggtgaaagagacatctttgtcttattcctgatcatatgggaaaagtattcagcaattcatctttaacataatgttagcagtggattttgtgttgatgctctttatcaagttgggaaagtttccttctattcctagtttagtaagcatttttattataaaaagtgttggagtttgtcaaatgctttttctacatctatgcagggtgatcatatggtttttgttctttattctattaatatgatgtattgcatcaattgatttttggattttaaactaacattgtgttattgggaaaaatctcacttggctatgatgtataatcctttttacctatctagccagattcagtttgctaatattttgttgataatttttacatttgtggatctcactcacctgtttatttttttatatattttacattgataactagatgtcttagataataacatcatagcaactctggatactgatttctccaccttgctattgttattgttgtttagtttttggtcatttgtgtatttgttttgtgatccagctgaaataactttgtgaagtctttctgtgcaggatgtttttaagggccaggcctaaaagttacatacatcacttttgccccaatcccaaatgccagaatttggacatgtggtccacacctaactgcaagagaagctgggagatgtagacaagcacagtgttatttggtgagcaccagaagtctctaccatcattcaaacttctagttatcaaatatctcttttccacatttaatgtaccttgttgtccaaggagttcaatcgtaaatcactgaattccaagttgaagaaccctcaagtcaggaaatgcatccacttggtctagtgacatagaaactaaaaagacaaggtctccccacaccccatctgcatccatacatgcccctaacctaaatggtggggcaggggaaagaaaaatatatctaccattaataaaatggaaggctggatgacacacaatgatcactaatctttctatgagatattggtcaaaggacacaacatgtcagctaagtaagaggaataatttcaacagcatgggactatagttaataacaatgtattgtatttgaaaatctctaagagtccatgttaagtgttttcactacaaaaaacaataagtatgtgaggtaacgcatatattaattagctcagttgaaccattccacagtgtatacatatttcaaaatgtgttgtatatggcaagtatatataaattttatttgtcaatttaaaaataacttgtctgcagaaatactagaatcctttaggacagataatttttgaagtttttctgctctgacagtgagggaagtctcctgagactcattcatgctctgctctccaagcatgaatttttctctttacttttctctttactttgaatgaattttttctctttactttgttaaacgtttactaatataaaatggagtcacactggttcctttctgtaaagggagagaagatgggctttctgagtttattattattattattattattattattttgttgatatctttggtggtacttttatatttgtgctactgtggttagaaacaccactggattacatcttagctttgaacctaattttgggacctgttgtaatttctggttttagctttactactggagaaattatttgctttgagaagttaaaagtgttattgagtcccaacttactaagatcttttagattttattatttcttgagataatagcttctatttcttttctttatttttatttctaatgtatttcctttctctctgggcataagatcttcaccaccataaataaaaataattatcccaatggaagttttttatttattagaactaggaggccgtttgaatgctaagttttctctatacaaagatcattaagattttaatttggatgaaaatttgtaatttgtaagtaaaatttcaaagcaaagcttctaatccagtctgttaaacgggattacagaggattacatccttggtagatgggagcagagattcaggttgagtcagtacttatgtggttcaacctgaatctgaacccagaatgccagaggaacagtcgctataataatttctataaagtctacaaaagggtaattaaggatgctgaaaactgacctcagcagtagcattcctttactcttcacttccacggacctaactcccctgctctctgcgttagcctcccggaactactttcacctccttaaaaattgccctctttgctcctcttgatgcttctgcacctgctccctctgggtgataggttgccattgatcctgtggctgattgtactgcatcccagcctgaacacctatccctgacaatttcatggtctttgtctctacgtgcagtcaattataaattctgtgtggattgagaccaactgtgttttctcttcccagcagctgtaacctcacatgtcccccgccactggtactgtgctagaaagcaataatagatgctttaaaaagagttgtcatatgaataaaatctcacccacttctcagttttgcttgagttacggaccttgaagttagttatttgctatttagaaattttgatactacactgtcattattcatttcagatttttttcagaaatattaaagtcaatatttctgtgaaaattgaaaaaaaattttatgattaaatttctattaattttgaataaaatgctacattaaggaatgaatgttttgatagtttataaaacacaaaataatactataataatttaagtgatatacaataataatttaagtaatattctttaaggtttgatctaaggacacaaatatatgcattaaatattgaaaaaaaataaggatgacaggatactagatccatcatttcattcctctttttttgttttttgagacagggtctttgtcacccaggctggagtgcagtggagctatcacagcccactacagccttgccctccctgggatcaagtgatcctcccaactcagtcgccagagtaagtttggactacaggtgtatgccaccatgcctggctaacttttgtattttttgtagagacaagtgtctcactatgttgcccaggctgatcttgaactcctgtgctcaagcagtctgcccacttcagcctcccaaagtgctgggattacacctgtgagccaccgtgtccagtcttcattccttttttatatacatatattattatagtcaattcatcagaatgaactatagttcataggaaaatattttgtatatagtttcttgataaacaatgcttgttattatgctaaacctattgcaaaatctatagtggtttttcatatcatgttgctttcatggtttgcaaaccaaacacaaatgaactattagaaccactaattattttgtctgttagtgaagatattggaatggaaattattttgagtttcaaaggtaaatgatatactctgaagacaattattatttttctcatttaaaatgtacattgatatggtttggctttgtccacaccaaaatctcatcttgaattgtaactcccataattcccacgtgttgtgggaggaacctggtgggaagtgattgaatcatgggggtgggtctttctcatgctgttctcatgatagtgagtgggtctcacaagatctgatggtttcaaaagtgggagtttccctgcacaagccctcttgtctgctgccatgtgagatgtgccttcaccttccaccatgattgtgaggcctctcagccacgtggaactctaagtccaataaatctcttttttttttttctaaattgcctagtcttgggtatgtctttatcagcagcataaaaattgaccaatacatacaggttccattagaattattcaaagaataaagcaaaaatattaacataaaatgactgagttactggaaaatgggactactcatggcagaatctgttgtaacaaaagacttctttgtcaaaattgtcatttcatttgggatctctttttcaattctcaaggcaaaaataagataatttatatgtatagtttaatttgcagtctagggagacttggtatataactctagccataatgtttatttcaacttccatttttttgacataaggcactcaatcagacagataatagattttcatttccaaacctaacatttctggcagtcctgggcagcactttctggagggaaatcaataaatcaaattttaatcagtatttattgagcacctgctaacatagatgctatggtagggaaaggttatgggtgaaggaatgacagaggtttatgagatattgttgctgatctaaagaaatttttatgcagaatagatgcacataagacacatgcacgcacacacacacataccaacccaaacacaccgtcacacacaaataaataaaaagcttattatcgttgagcttggccagttcataaatggttggtctgagtggaaagactaatgagaactacagcatccttggtttgcagatgtttccatcttgtgttatatagagttagcaaacaagtatctaagaataaaagtgagtgaatagatgcagttcctccttgaagcatacctgaattttgtgctctgtctacctggaggagagagatgagtgaggattctgccaggacagataaacataaaccactgtctcacaaccttttattccctggaataatcctaactaatatttctcttgctaccataaaagacaattctttgttgggagtcagttatgtaactagtgagaaatccctaagtagtgacttggatctgttacagagaaaaaaaaaaaaaaaaaaaaaaaaaaaacagaagaagcagctagaggatgataaacacagggtatggtattctgtgctatgttcaggaagcaggctggagctgagatagattgaatactatgggacttacataatacctaattgcaataagttttcattgtatgactctagggagaggagaagtatggcttaccctttaaaagatcattctaagcaattttatagagagtagactacagggaggtcagttgggaggcctggactacagtagtagtggaaatatggggcaaagtggttggatttgggatattctgaagctagactctaaacatcttgctaatagattggatatcaatggagagaagaaggacaatcagtaatctctgttttgtgcttgatcaactgagcgaatgttagtttcattctctgaaatgatccccaaagagacagaggaagaggtaaaatgttttgtataaaatgttaaggttatattttgcattttacatttccaaaatagaattaatttggctaaaaatgatcatgttcaatggagtgagtcagaccaacttgcataattctaagataatttgaatactcatctgttatttttcttttggctggaggttattgttggtggtggtagtttgacagaaaaaatgcagattttttggccaactatgagaaggaaaaacttgacacagaaaaaatctggtttattgagtgatttctagaaatggaaggtatttctattttcctaaaatgtgaatttatatttgttttttgtccaccactgaatgagattggatagtctttgagaggaaatgataaaaaactatttttacttttatggggcccctttcttgaagttacctcggaagtcatctactgtgaatcttgattttatagtaggagaaaattgagctattataaataccaaatgaattttaaaaagatcttacatatttaatcagtcagcacagaccttgagcttaagagatttcggtagggtttttccgttgctttgtttgtgtgtgtgtgtgtgtgtgtgtgtgtgtgtgtgtgtgtgtgtgtgtgttttccctatcatgatacagaaaatcacaatcattatttacaaaattaaaaacttttagtgtatagttatgtcaagtgtaacaaatcaatatcaagtatcaaaatcattaaatgaatttgtgtggactcaaataaaggcttccacaatataaatgaaatgctctgcttaccctgccttgagtatttctaactatatagttatcttgagagggcttagcgaaatgcctctgatattcaaatggcctttgaaatactgattatactgtttacaataatagtttgtattgcatgtactaagcattttttctttctttttttttttttttttttgagatggagtctggctgtcacccaggctggagtgtagtggcgctatcttggctcactgcaacctcagcctcttgggttcaagcaattctcctgcctcagcctcctgagtagctgagattacaggtgcacaccaccacgcccagataatttgtgtagagatggggtttcaccatattggtcaggctggtctcgaactcctgaccttgtgatccacccacctcggcctcccaaaatgccgggattacagtcgtgaaccaccgtgtccagctgtactaagcatttttatagtcattttcttgttgcatatttacagcaaccttatgaatctggtactattattaccccattttaaaaaatgcataaacttaggttgagaggaaagataattgcctcaaaccataagaaggtaagcagcccatccaggacttaaaccccagtcaggctgacaccaaccccatgctgctgtctactctcctctgcaattttagtagttagtaacccaataaaagtatcacaatcatgtgactaaattcttacagaaagtggaacatattataatgaagacagagaggcattaggtaagaaacagaaaatgcctaagtaaaaattctaaaaagtgctataagatatacaaattattttaacctttttacacacaaattgcaagaattatcattagtatatattcctgaaaattttagcaatttgatttcctgtcatattatacattatatgtaatgaaatatggtgtattataaaatgtataagacataagcttaactcatgcctcaaaggatagttataatcctccttattgaacacaactttgacagagctttcttgggttaagcttttgattataacacatgtattttaaaacataatatagattctccatattggtttgattgctaaaatattttttaaaccaaaacatgtaaaatttgagcaatttttctttgcttcttccaaatgttcctgttaaagttttagtgtgttaggccaaaggatatttataatgatatgaaaagccttaacatatgtttttgcagtccatgatatttgcccaaggatcttccttttagaatacaatacaattttaagatgtaccaatatgttttaaaggccatatctgtaaaaacccaaaacataattcaattctaaatttctccactctttcatcctctacatttttttttgtcagtttattactctgtagactaaaaatctgtaatggttcctcattgcccccaaactaaatatgtaacaatagctatcaactattggaatatctgctgtgtactgggccctttagtacattacctctcatccttccaatcacctgctacatatagagacaggaaaactggagcacagggagctgaccttgaaacccatgtctatttgatttgaaaatcttgtattctttccactagaaatgatggtacctcctatttagtaaatgcctaccatgttctaggcactatactcaggagtttgggttcaaatcccagctctaccattcccaacccatgtattcttgggatcattacttaaactttctttgcctcagttttcctatctataaaattaggtaaataataataataagagtaccttatagggttattgggaggataaaatgaataatctatataaagaatttagtatacaacctagtaaatacaaatacgtattagttatcattatttttattaggaaatacttcagatatacaaaaacctataatgataataaatatcaaagtcacaacgaaatttaaaggatagaacattataaacacaattggagcacatgttattttgtagctcagtatttatccttcttgtgcatgcttttgttctttcattatagatgtgtatattattttacagatgtctaaattataaagcaatatatagaaacattttcaaattttttaatggatgagaccaactgcattttttctgtaacctgctttttatgataaatatgacgcttgcaaaatccatcataattgacaaatgaggctctagttcatttattttcactgctatgcactatttatgaatgaaactgcagtgaaactagaataagtctattgtaggaatgaaactacagttcattcatccacgctattattgatgtatatttaggtgtgttttaaaacttatactatttcataaactgctatagcataataaatgatgataaaaataatataaaacactttctaatgcttacttctcaggcaatgatttacatatgttgaatcatttaatctcataaaatctcataggaagaactattattatctacaatgtacagatgaagaaagtgggtcaacttgacacatctggtacatggtgttcctggaaataaaaataaggtaatcaggccaagatgtagctgtcttgaccacatgtgcctttgggcacacgtatatacaagagtgctctaggactagttctccatcttgtctgcacattaggatcatctggacacttaaatataatgactcatgcctaaacctctttccagataaattgactcaaaatagctggggatcaagtctagacataaatattgtttaatctgatttttaattaaacttcttgttctgagataattgtaaatttgcatgttgttgtaatactatttaccatttacccagtttgccccagggataccatcttgcaaaaccatagtaaaacatcacatccaggattgacattaatacagtcaagatcctgaacatttctgtcaccacaatgatccctcctgttgcccatttgtatccacacccatttccctcctgctcatcccctccttaacccctcacaatcagtaattggttccatatttctgtaattttgtcatttcaggaatgttataacattctatataaatggaaagtcaattccaaaaggttgcatactatataatggaattccattatataggattatattataggattctattacacagtgtgggatcccattatataggatttcattatatatacccttttgggattgaccttttttaatctatcaaaattctctgcagattcatctaggttgttgcatgtataaatatttcacttcttttatagcttatagtagatcatggtatgtaagtaccacagttggtttaaacattcacctgttgaaggatatctggattgttttcaggtttttttggctattaaatataagcttctatgaatatttatttacaagtttttgtttgaatgtatgtttgcatttctctggaataaacaccaaggaatgcaattactaggccatatcacatcctgacttattcttgtcttttaagtaaattgtgttaactggccaacacctctctctttgatcacacttaaaggtcaaaaagtcagtgtctatctcaaggtaacattattttttatctccaataatgattttaccaccaatatttttaattttgatatgaatattatttctaagaaattggagatcacaaaatagctacaggttaaatattgctgacatcatttagtaaaagccaaaaaaaaaaaacccagaaaacagtttaaggttttctaatctacagagcaccctacaaggaaattaatatctgtatgcaaccatctcactagctttgtttaccagacacggcatgtgagaaagaaaacacttcaagtgtttaaacatttctaaaatcaaattcaaaaaagcatacttttctaatgagatgttcattgacttgaaaccaaagtaacaagaatgctttgaagaaaatatacccaacaatttgtatagtaaagtgaatatagtgttccatttaaacctcatagaaccccatgaaaaaattaaccaagtaagattggatgatatccacatcctagaggcatgtttcttatttattggaaatttgactaaaccatcaatatgaccacctttattctcagatatttttaggatactagagccaatgaatataatgttctattaaggagaatatgtttaaataatcacagaaattaaatatcttattccattattatttaaaaagttgtatgtgtctatttttataccaaaacatttcctattaaacatatatgtatatataataacttttcttattagctttgttttttcctaccttctgcaaccagaaatttctctgcttccttgagacagaaacataattgtgtatctgttggacaaatactattttccttttttaacaaaactttttgatagaagagctttatgttggcatcattttaatgaattcaatacattcattaaagaagtggtaagcctaataatatatttgcttctgtgcattatttttctctaaattttgggctacttgtctttgtatactgtttcaaaacctaggcactcaagtgtgtcattttccattgcaattaatcacttggttttgagctgctctaagaactgaatttcgccaaaataattgtgagtatgaactttcctgtttgtgagcttcttgaacaagttggcatattttcccttcgacaactgtcaccatctgacaatttgctattatagctagactaacattaagatttaagtatctaactctgggctcagtgaaggtcaggcatatttagacagttttccacagaaaagtttgaagttaataccctgagtttccttgaattgcatttaataacttccaggttaaaaccccaaatggtagaatcaaataaacagactcatggcataggtcctgagagatgagcaactggagaaagaggttcagatgagattatttcctctgaaagtactagttcctattgtcatggaggaaagaagatctagatgaatattcatataacccagttttctgcattgcacattacagaaagtctacagagaactctctgggagagtgagtcagaaaccaaaatcaatctgggacaatatatcatttattttcatactggaatgactttcaaatcgtctacttttattgttgttaatgacacaagtttctcctatgtaacagtctctgaatcaaactaagaaaaggcataaatatactgatgaggtttatataacccatgtctaaataatcagaacaaatcactaatggcatttaaaatattccaaaatgcttgttacttcaacttgttctctctataccatttcatatgcctgtttttctgatacttacttcttttgttgccttatccaatcacaatcaggattaaagcttgggaaattgagaagtgacccaaatttattataggcaattatttttccacttctgcctatctgtccctgtaaactttcccctcatcatctgatgcctaatatattgaagtccccatcctgctatcttcacctcttccttccccaccaaagaaacagttttttccttttttttttttttttttttttttttgagatagagttttgctcttgttgcccaggctggagtgcaatggcacgatcttggctcatagcaacctctacttcctgggttgaagcgattctcctgcctcagcctcccgagtagctgggattacaggcatgcaccaccaagcccggctaatgttgtatttttagtagagacaaagtttctccatgtttgtcaggctggtctcgaactcctgacctcaggtgatcgccggcctcagcctcccaaagtggtgggattacaggcgtgagccactgcacccagccaagaaacaattaaaaaaaaaaaaagaaccctgttctctgatcattcacagtaagttataaatagctcataaaattactaaacatatacaaaaacaaatcacattttacaaagagggcaaaatggtctagacttaacatatagaaagcaagtcaattttttctccaactacaaatgactgacatgttcaattagttttaccatttttaaaaaaatcggagtccattatccagaactcacatgaggaaaagtttagacaaaaatggtaaacccaaatcacctacgcaagatctttatgaatgggtgtgatagtccattatgtgtaatgttactgaactagtagctgcaaaacttttgtctattttccattttctgatccctcttaggaagtaataacacatttttgtaattcaatagctatcgccatgattcccgaaataggggcctactagagtattttacattttttgagtgacacccaacttctttatctttcagatctcaatattttgttttatgaaagaatcaaagtaagaaacctaagatatgaaaaaacacttatttccaaaggaagagatcatcctagttgttcgaaggcttacatgcttaatgcactttctatttgttaatgagacttgttcacattatatagctttcaattagttgttttgaattaatttttcatagtccatataaaattataatattacaaaaataaaatcaacacgactgaggagtctgaagggcagcgaggtcacatatcccagccttggtttattcagagattgattaacaggctgtgccttggagttggctcatgtgcaagaactaaatcaatgtcatggtttttcatgttgaaattttaaggcaccatgatgactttaattatatatattaaatttatcaaatattataaacagcacactttactgtttctttatagaacattggttggcagctcttttcgaaaaccagtcacccatcagaattttatttactacttctccaaaggattttccaatattcttcctacagttaagtaaaggccatttctctggcatgtgttttctaaagtcccttagcttactcaaatattctaagaaaacaacaaagatcctgcttctctaagcaataccagacataaaattccccaaagagaaataaattgagcattttatgctgaaccaagaatgttctccttctctctccttttttatatgttatgcaaaatgagccaaatgatggggattaggaatgagaaaaagaaaattaagaaaggagtgagacaaaaatcaagggtctagtattatatcacctaaaaataagatatgtgtcaggcagcaaggagggagattacagaaactaactgaaggctgaaataaaaatatgcatagatttgttcttgatttcctatgtataggaggaaattatggtcctctgtgagaagacaggttatgaagttcacagagacacgtaaattctttgttacaatcaatcctacttgtgttatgacttttgccttttgtgaaactttatgtccttgttttttttctctgttgggcatttagaaatttgtatcaagataaagaaaaaataggtaactcattaaaagcaagaaattcgtagtgattattgcatgctacatgaaaataaacagcattgtcttatcaaacaagctgaataaagattgtgaaaaatgtctgtagtaatacctttgctccaagaattttagtgctaactgctgcaaggaatacaaaatggtgtaatacagagtgtactctcaaggaacaaatttatttgaggtgacgcaaagtcataaataatgtaaatattatataataaaaagtaaaaagcagattagcaataaggaaaaggcagattatatagtggatacatactatgagtgtattcatttattcaacaactatttcctgattgtcagtaaacctaaaatcagctagattttagagatccaaagattattgtgaattggacaatttaggaaatctgagtaagaggatttccttttagtaagtttttatgtacgtttgaaggggatgtaggagaatattctttcctaagtggatgtaaatacgtttgctgagtaaatggttataaagaaaataataaagtcatcaagttttcaggatataatgataaatacctttgtctgtaatgccaagtacaaatacatttctgcttaaatgatatagaagtgagaatgctagaaaggagagattttaatcattattcaaaatatttgctattggtgctatgtgcaaaaagaaactttactcttaagcaagtagatgatgtagtaaaagattgtgcgtcacttagtactcctttgacaataagtgtcagagaacccagctaaagctgaccaagaaaagaacaggtttgtattgatacatacgactgaaaagttcagaagtaaatatggctgtacgaatactctggaacacagatgatttaatcaggaacttgtttttatccttctcttgactctattttcttctcaggctccatgacactttttttttcagttttaggcttatatcctcaaagcattcagtccggtagaaaagagagggaaactttggtttgcttctgagtaaagttactgtgttctatgcttggaacttctaaggtcagaagcttatctcttagccaatcactggggctaaaacgatggaattacacagatttacccgtagtagactacaaacctatctttcacctcctgtgaatagaagaattcagtaatttagtgttataactggataagcatagaatctatgtgctcccacatacatccacatagaatgagaatggaggaagtttatttcccagagaataattgttgtactggaaacaagtgcaatgcagaagttttgtaaacccacccaaatatttactccagggtgttgtataatagcactatgctgaaagggttggatgaaagaacacttggagagagaatgaacacgtactatggctataaattgtgtgaatttgagctatatacataaactggaatggaaagggtgatattcatgtgcaaaattttttgaagaatgacctggtagagcttggtgattgtctattagtttatccaatagtagatgttttcatagttacacatattagggctatactatggccagaggttcctaaacttttgcaagttacagcactcttaatttttcggttatttttgcatggcaccccttcaccaaaataaatgattaagaaatacatttaataaatattgactactccagtaggcccctattttgggtatcacagctatagctattgacttacaaaaatgtgttattacttcctaagaaggatcagaaaatggaaaatagataagggctttgcagctattagttcagtaacattacatataaaagactaccacacccattcatgcagatctcgagtaggtgatttgggtttaccgttttgtctaaatttttcctcatgtgagttctggataatggactctgatttaaaaaatgataaaactgatttcacatatcagtcatgtgtagttggagaagaaattgacttgctttctatatgttaattctagaccattttgccctctttgtaaaatgtgatttgtttttgtatatgtttagtgatttaatatgctatttataatttactgtgagtgatcagagaacagcgtttttaaaaaattggtttctttggtggggaaggaagagatgaagataggaggatgggggctttaataggcatcagatgttgaggggaaggagtacagggactgataggcagaagtagaaaaagaattttctgtaataaatttgggtcacttctcagtttcccaagcattaatcttgattatgattggataaggcaacaaaagaagtatcaggaaaataggtaggcatatggaatgatatagagagaacaagttgaactaacaagcattttggaatactttaaatgccattagtgatttgttctgattatttagacatgggttaaatatacctcatcagtatatttatgccttttcttagtttgattcagagactgttacatagaagaaacatgtgtcattaacaaaaataaaagtagatgatttgaaagtcattccagtatgaaaataaatgatatattgtcccagattgattttggtttctgactcactctcccagagagttctctgtaaactttctgtaacatgaaacacagaaaactgagttatatgaatatttatctagataatctttcctctaagacaataggaactagtactttcagaggaaataatctcatctggacctctttctcctgttgcccatctctcaggatctatgccatgcctaatcatatgatagagctgaaaatagtagtccatcttcactaagcccacctggtgtaccttctaagcttaacatgagtatcaatattcatgcatacatagtctcctattgtaatgctttgaatttaacatatttcatatttagtataagtaaaatagtttataatagcaaagaccttttaaaattattttttttcttacttgctttgcacatatgaagctttgatttttacattttagcttctttgtggttttattatctgaactgtacatttgactcatttgagcaaatctccttacaagctagaatatttaagatgcatctgatcgtctttcagtaattattccagaatatttattcatcactgactctatgtcttgcacaatatatatgcttttaattaggccatgtgttacaatcacctgaagatttcctcaagcctaaattttaatcaagcctgactccaaacagaataactagagttttgaaccaggggaggggtatgtttttagattcccaggtgatcctaatttgcattcatggttgagaatgatctaattcaagcaatgcttttttaagttaaatgtattcttcagctatttgttgactatttctggtattgagaaaaatgaggatgatatagtcatggtgtctgttctttttcagtccacattcttgtcaattaaaaatattatgaaagtcatacaactgtgacagagaaatgcaaatgtatttctccaaacttaaagcataagcgtcataatatttcaaaggaaacaagaaaattctagtgatttttgaattgatattccttttctccctttccagctgcctgctacctagttcacatggtttagtcacaggataagagaaaagttttcaagcattttctacagatgtgaatgtttgatataaaaaaaagacactctggtttaaagaatgttgctaggaaacacagtttgaagatgaactcccctacagagctgtcttccatcctgtaataagaaagtgtggtggtagcatgtcctcatttaaaagcaaaaaaataatctattaactgtgtatccagagggaacttgttacaggcttatttaaaacttatttggaaatagttttggtttattatatgcaccacaacttccaggaattcttttgttttttaattggtgcaaggataaagttgtgagcatataatattttgtccaaataatcactataagagaaatgcacttaaatacaataatgaactcatgttaatttttgctttaatagtaatttctattaaagtaatatatcctttatcataggaaaatgtggatatacaaaaaatatgctaagataataaggactgcccataatgccacctaagagaaataatcatgctttggtgttatttatgttttatttcttctaaatactcaaggcatgttggctaattgttgttataggtttgttctgacacactgccatttagcaagtaaaacagtttaatccacttatatttattataatttcttatgtaccttgatgtatttctaaaatcttattttatgttcttttaattacccatttttttctttttccttattttctgccttctatttgattagtttatgtaccatgtattattgaggtcataatatctaatatttagccctgcattttcatataatccagtataagcttttcctgattctgattattataaagcatttgaaagtgtaattttaaggcttccctaatatttttatcatattgctctattatatgtaaacacatcaaattatttaatcagaatagatttctctatgaggaatcactgtatcaaagtatctgaatacttttaagatacttgatgcatattactaaattatttcctgaaaatgttgtcttagttactacttcttgtagcagtataggaaaatattaatcattgcatccacataaacatcgagtattgttaattttaatgctgtgcaaattttatcaaataaaatatatatacagcattaagttgcattttttattcatatgtcatacatgtatgttcattcatgtaagtttagcatgttctttattcattagtctattagtattataatagtctttcatatattaactgctgtgagttccttatagctatgtctgtaatctttttgaagttttttcccaatttacattttgcccttaaaattcattcataacttttatatatacaacttaaattttttcctttgtattttcttatattcagggagttggtgtatttatttcctttttaagtttctgtaagttaatttgatttttatattttgacttttaattcatctgagtttttgttgatatatgaagtgagattagaatgcttattgatttttttctagctatttagttgcctcagtgccctttattgagtcgtatttcatatctttacctgttagcactttcacaaatagaggatgcaagcaatataaatgtaagcctggtttaaatcttaattccaccacttactagtaccagaaacaccacaatcctgggcaaattgcttaacctacatgactcaggtgtttcatccctaaaatggacacaaagaagaacctatatgaaggtttttgtgaggggtgagataatacatgtaaggtgtctggcacacaataaatgctcagaaaatgttagttcttatagaatctgtttgttctgtaaagaacaccattttttatgaagtttttattatgattttcaattggtgggattatagttattttattagccttgagaaacaatttggtagagtacttaagcacatggactctagagctaaactgcttggttgtgaatcccaacatgcctactagttaactgtgtgaccttagctacttcacatctttgtgtctcaatttctctatctgtaaaattgagatattcatagcatttaccatagagattttctgtgagaactccaatgagaattaaatgtatttacagtggttagtagtaagtgctatgtatgcattagctataatttgttccaaaatagtcttaatgtccttttcaaacatttttcttctctaataaatttgagacttattctttcaagtgtagagaaatcccatttgtgctttgattgaaagtatgtcattttggaaaactttaagaatattgagtcttgttatcaggagctggtatagttttccaatttgtcaatgcttcttttaagtctatcaataaatatttatagcttttcatttcttgtactgattattaaaagtatttctaggtcatcaatcgtgtgtttgttaatactgcaggctgaggcttcacctttcttatttctaagtagacattgttagtacaaaagaaaactatagtttagtttatatttatcttctgcttagtcactttgctgaactcttaatgttcatattttatttaaatccattttctttgatatcctggtctataatcataccgtatgcaaaataatagttctgcatcctcttttttgattgttgtaaatacaatttttgcttcattttgaactatatttgcctaagctccaaaacagtgctaaattctgtgtttccagtatggtagaagacactgggataaaaaacagaccagacagcgatgggccctgtcttcacagtgttttaaatctattcccatggacttaacataatattgatctatcaaatcctgtgtgttggtttgcattatttaggggagatgttatataaccttcattagattattaaaagggcttatggctgtaaaagttaagagtcttttatcgtagattctggatattagccctttgtcagaggagtaggttgcaaaaattttctcccatcttgtaggttgcctgttcactctgatggtagtttcttttgctgtgcagaagctctttagtttaattagatcccatttgtcaattttggcttctgttgccattgcttttggtgttttagacatgaagtcattgcccatgcctatgtcctgaatggtattgcctaggttttcttctagggtttctatggctttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttctcaggcttgccaaagatcagatagttgtagatatgtggcattaattctgagggctctgttctgttccattgatctatatctctgttttggtaccagtaccatgctgttttggttactgtagccttgtagtgtagtttgaagtcaggtagcgtgatgcctctggctttgttcttttggcttaggattgacttggcaatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcatgtcccttgtaagttggattcctagaatttacaagaaaaaaacaaaaaaccccatcaaaaagtgggcgaaggatgtgaacagacacttctcaaaagaagacatttatgcagccaaaaaacacatgaaaaaatgctcgtcgtcactggccatcagagatatgcaaatcaaaaccacaatgagataccatctcacaccatttagaatggcgatcattaaaaagtcaggaaacaacaggtgctggagaggatgtggagaaataggaacacttttacactgttggtgggactgtaaactagttcaacccttgtggaagtcagtgtggcaattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaacgatagactggattaagaaaatgtggcgcgtatacaccatggaatactatgcagccataaaaaatgatgagttcatgtcctttgtggggacatggatgaaactggaaatcatcattctcagcaaactatcgcaaggacaaaaaaccaaacactgcatgttctcactcataggtgggaattgaacaatgagaacacgtggacacaggaaggggaacatcacactctggggactgttgtggggtggggggagggaggagggatagcattaggagatatacctaatgctaaatgacgagttaatgggtgcagtacaccaacatggcacatgtatacatatgtaacaaacctgcacattgtgcacatgtaccctgaaacttaaagtataataataataataaagagtcttttatcctaatttatagtgataaatcagtcttattaataacccgattaatttttgtgatgatttatatgttcttattcactgttacggactttttaaaatttcaaaataactgtgatagtgttacccatttccttatacgtgtactttatatatatttctaattacccatattctcaaaaaacaataactaatttttcatagagaaatgttaaaatatgtcgaaaataaaaagactttaggtacattaatttacatttttaagagtcttattttgagtgttcaaaagtagtactggaaacataattcagtctgtaatcatggcttggtcacctatggtttctgtaaacataaatataaatacagatatggtttacaatcttaacttgttttagactcccgattacaacgtaaagaaatgtgattaacaacaacaacaaaaaaaggaagtatatagaatttggttttcttttgccaggaattaatctttttgtggactgcagaaatactggggaaagatagctgattggtaggaaagacagcaaggtgtttactgggcctgatagagagactacgggcccattttatcagtttaataaacagagttaagagtctaacaagctgggtggctttccacaaacaaaacaagtttgagagttgcagcaaaaggaagagatcctttcccctgatttagcatctaggagacaaccattcaaaggagggatactcatgtaaagaacacagccttgcttcccctcctgccactcggttcactccacagcgtcttgccagtgggcgttcaggcctgtgccagggatgcgctccatggagccagtcagcagaaatctcttgaaagtattttgactgaagctgtaaaaagttgaaccatttgaaaattccttcccaggttattctctgtaagggttaaacctgctgccttgggaaattcacttcctatctgtatacctgtatttatagtgggagggagattctttaataggttggtgagaagtagctgggcctataattaaaatcactgctctttattaactagattttagccataatgttgagtggaaaaaacaaagatgggggatgtgataagtgattagaaagaaaacaaaacaaaattgttaagagtcaaatatagtggtccagtttgaatggaattgaaggaaagaaaaggggcaattggaatgtcattgcttctcttttcagtctcttcaatttatccctttacatattctgtacaaatactaagcaatttttttagataagtggcatagttataactctcaaaacaatttgctaatttatacgttcaggaatttaaaaactgtttactaagcatttcccatgtgataggtgttgtggtaggttctcgggtttttgaagccccaaatcaatgggagagtcagacactgagaattatttaatcataaaatgtaatactcatccttaaagaagggcagaaatggtataaatctcaatgtattattatgagtattaaaaaaagataattcacataaagaactggcagtgatcgtggcagtttacctatcatatgtactccagtgatgagaagaatcatgaagacgagcattatgctgaggatgaagatgttaggggacaggtactgccatttattatcattggcaagctgcttgacttctctaaacctcatttctcgatgtgttagttggagtcaataatagttacctacacgtaattttgaagattaaaggtatttgtgaaccaccggtatttgaaacagtgggtgttctataattgagttatttcctttactagactcctatccatgcgatattaatctctaatactatatggatattatcaataaaaaagaaatacagatacatgagtggtatattctgagaataacattagatatggactatctctaaggtcatttttaaacagagcgaatatcacctttcctgtgactccccactgtactttatttctccttataattttgttattttttaatagactttaagagttttaggtttacagcaaagttgagcagaaataacagcgagttctcatataccccttgtctcctcacacatagcctcccccactgtcaacatcccgcaccaaagtggtacagttgttaaaatcgatgaacccgcactgatacattattatcaactgaagtccttagtttacattagggttactcttgctgttgtacatcctatggatttgcatgaatttataatgatagtatcatacagaatagtttcactgccctaaaaatcttctgtgccactgcattccagctctgtgatctccctattcatttctccctccttgctaacccctaggaaacactgattattttactgtctctgtggtgttgccttttccagaatgtcatatagttgaaatcatacagtatatagtcttttcatattgaattctttcacttagtaatatgcatttaagtttccttaatatattctcctggcttgacagctcatttctttttagtgctaaataatactccatggcctcgttgtaccacaggttatttattgattcctctactaaaggatgggtttcaatttttggcaattattaattaaggtgctataaacatccttgtgccagtttttgtactgacatacattttcaacttctttgtgtaaatactaaggagtgtgattgctggatcatatggtaagaatatgtttaactctgttagaaactgccaaactgtcttcccaagtggctgaaccattttgcatttctaccagtagtaaacgagagttcctgttcttccacatcaaatgctagtgaggatatggaacagcaggaaccaacaacatttggtgttagatttttgccatttgaattggtatgtagtgatatctttttatcattttaatgtgcaatttcctgatgatatatgatgttgagcatctcttcatatattgatttgccatttgtttatcttctttggtgagatgtctcttcaggaattttgaccgttttctagttgagttgtttgtattcctatttttaagttttaagaatttttgcatattttggataacactcctttatcagatgttttcacaaatatttgtccctgcctatggcttgtcttctccttctcttgaccgtgtcttttgcagagcaggaattttaaattttaatgaagtcctgctttgcaattctggttttcatggattctgcctttattgctatatcaaagaagtttggattctgcccctattgctataccaaagaagttatttccatacctactttctcctaggttaccttgtaggagttttatagttttgcattttaaatttaggtccctgactcattttgagttagtttttgtgaagagtgtaaggtacgtagctaaattttttttgttgttgcgcatggatgtccagttattttaacacaatttgttgaaatgactgtttcttaattaaattgcctttgtttctttgtcaaaagtcagttgattatctttatatgattctatatttgaactctctattctgttccattgatctatgtatctgtatttttcaccagtaccacagtatcttggtgaccatagctttatagtctttatggctttaagtcttgaggttggacagtgtccgtcctccagctttgctctttttcttcaatattttgttgactattctgcttctctatgtaaaccttagaatcactgtcaatgtaaacaaaataacttgctgcagctttgattggaattgtattgaatctgtagatcaagctgggcagaactgatatcttgacaattttgaatttccctcactatgtttttatctttgtgttttacctaaatatttgttcaaggaaagaataatttgaacttttccatactagagccctgtctaaaacgtttaccctctttgctatccttagttttggtcaaataactagttggctgtgaaggctgagcaaagatctaccactaagaatttgtattgtgagcctgtctgaaggtgaatgatgtatagactggatgcgaatagcaaaaagtgataagaaagacatagctacagtggaaatgagcttctctcagggtctaaaatctgttactctgcatactccttaaagtgttgctctcaatggattttgtttgtttgtttgtttcgtaaaataatatgtgtattccagatgaatccaggaagtttctcattctaagaaaaacactaaatcccagccacattagaatttttccatgagaggctgtattaggttactgactcctattaaaataaaaatattaattacagaaaacaaaatggaatcattcccaaagaaggagacacaacaagaagagatgaaaaatcatagccaaacaatcattatcactggcatatcggaaatagtacctgacttagttaagatattgtgcttcgacaggaatgctaatcatgtttcaggacataacttgtccaaaaactatatactcacagcttccggaagggaagtccacttctgcaagggcaagagatttgaaacctgaaactttgtaatttttttgctgacagggttggagggtgatttgctaacatctcattatacaatgtatgttaagagaaatgtaaaggtcaaaacatggtgctttttgtttctgctggagtgctcagtcagagagattcagttcagcacaatatcaatcattacaaattcttccccgaaattcaagacacattaatcaaaacaaatggaactcaagaaaaatgaaaactggggggggtgaataaacaaatacatgattgagttgaaaacataaaaatatttattaaaataccaaaaatattaaatagaaacattctgatgtaatgatttctgatacagttcaaacttaaataaagaatgtatggtcacataaaatgtaagtaagtatatcacctttcacctaaagttttccagttaaatgcaaaaccttcctctttaccctaactaggtagataattatatcactctgcatagtcatgttaggagtttaattttcaagctaaatcaaaatcacttaaaatgtcaatgatagtttaaaatttaagaatagaaatttggacatatcaaactcaaaattgatgctttattgaaaaaaactaaatgtctttaaattgctataacaaactttatatgttcaaaattagttaacaaaaataaaagaggacaaatttctgcattcttcaacctccaaatttctaatatctttattctaagaaactgcagctattgtagtgatattccttcaatcctgaaaacactcaggaagcaattttttttaaatgttttaccttggcaggaactttagatcacaagtcaaaggtatctcttctaaacttgtaaagaaagtaaacaatctaccaagagaacaaacagctcccaatagatacagctcttactgcttcctccccttattttgtttcttttagttagagagccatgacaaaggaaaaacaaaataatttcagatttatatttctgttgcttcttttttcttccttccattttgttcattgcataaaacaaattgattaggaggttctcttgctgggcttcaaatatcattaatatgtagatgacttccaagtagctatcccccactcctgtctgacttctaaattctggtcttatttattcaaatgtttacctagtatctccacttgaatgtctaatgggaaactcaaatataatacgttcaaaactaaattattggtcaactcactttcccatcaaaactcaagttcccctttgttgaatagcaacatccttacactctaatagccaccccaaaaggcaaacactcatccctgaattcctcccttttcctcattgtctgttccaatatctctacaggtactaagcagtcaatgtttatctttcactggttcataccctccttgaagccaagaaccatatttcttggatctgttaaatccctaggacctttaaagattttaaaacaaataaaattacctatataacagcttcttcatttgctaagcaaatgattacttttacatacctacattgcaagtgatactggcacttcactgcattgaagaagtcactagatcttgaaagataagctctattgtatccttcctcccaattgttaaaacccacagcagatatacatgaagagtgaatgttgatttaaactgtgaactttagttaataataatgtattaatattagctcatcaattgtaacaaatcgactacagtaacgcaaaatgttaatggagaaactatacaggagagaagggatatatggaaactctctgtactttctgttcaattttctttaagtctaaaactgttctgaaaataacatataaaatatgtcacagaaaaaatatttctctcattttatgccattgtattctcaagacatctagagacccattttttctccagtccccaatgccttgtcttttaatacctaactttttatttaatattttatctattagctgagtatatttcatttcccttcccacaagtgaaaatagataatatataatgctggcttcatgaagacttatgaagaaatcaattctatgaaataaaaatatttctgaatgagtttattacaactgagtggggaatttgagtgtcatttctagagaatttggtccatataaattcagtcttggcagctagccattaggggtttttgaactggcatatttgagaagtgttctaacttctcagtggaataaagaagaggggaaagaacattatagaatgattcttttctttaataaatttccatataaaagggttttgaaagtctggcctcaaggtaattccagaaatagatttcaaagactgcgactcaagtttctgtgttatagtaagcttaagttttataaagtgtcaaattgatgatcagttatatggaagcctctatttataatagtatagtccatttttatactacttttaatttgcaaaggtgctttcatatattatcttatttggtattcatagtcatcctgggaaaattgtagaacagatgctaactcctaaatagataaccacaatttcacaaagtaaagaaaaagaaatgcatggaagtatcctcagtccaattttatcagtccattttctattgcttcaaaacacctgcaactaggtaagttataaagacaagaaatttatttcctacagttatggaggctgagaagtccaaggttgaggggccatatctggtgagagcctccttgctggtggggactccgtagagtcctgtggcagcagcaacacagggcgtcatgtggtgaagggactgcgtgtgctcgggtgtttgctcaggtctctcttcctcttcttgtagagccaccaggcctactcccatgataacccatgaatccattaatccatgaatggattaaaattcaatcacctctttaaggtctcctctttaaatactgtcatgttagggaatgtttccaacacatgaaatctgggggacacaagaaaaccatagcaccaatgttaaccatttaatagtaattcttgtgcttcaagattttttttttttttttttttgagacggagtctggctctgtcgcccaggctggagtgcagtggcgcgatcttggctcactgcaagctccgcctcccgggttcacgccattctcctgcctcagcctcccgagtagctgggactacaggcggctgccaccatgcccagctaatttttttttttttgtatttttttagtagagacggggtttcaccgtgttagccaagatggtctcgatctcctgacttcgtgatccgcccgcctcgacctcccaaagtgctgggattacaggcgtgagccaccgtgcccggccgcttcaagatttcttaatgaaggtagttgcatcgatgttcataggtgcttttcttttaattatcagctctattctaagacacctaaatcttctgaacacacacacacttacatgctgacacacacatgctgacacatgcttacacttatgcacatgtatttattaatcacacactgtgcaaagtatttaagccccaataggaatataaagatatgtataaggtatgtttttttttccctctctctcagaaacttatagtatagttaggggtaaagagaaatgatcacaggtatcttacatacattttttatataattctcagaagtatgtattatattactattcccattgtacaaacactgaaatgacttgcctaaatccactgagccatgtgcatcacttctgactagactcacagtctgtacccttgtctcctagcctcactgccttttgataatataaacatctaaaatgctatgaacataggctcagatttcctaggacagttttatagttggttattgtgttctatttattgtccattaagacatatcagaaacaccaaatttcgacaaagaaaatacttctccaaaatactttctttcctcaaccttttaagttgtcctcaaatatattttttctaattcagtttcccaatattcaactggaagtggccttgcatttaaaaagtaagcaagaatataataataagataccagcaggtgagacaaaggaccacttgaagatttttgacaagggagaagacctcagaggaggaggttgtctgaggagacactttcctataaagataaaatttaatctggatcctgaaatagagttgaaattcttattttctcatttacaaactgaagctaataatagtagctacatcatttgtttagatgaaaattgagttaatacttaggcttttaaaacagagcctgacttagaagttggaagatggagtacatatatcttaactactaagctaaatgtttttatcttttaatttctattgcctagcataatgcctaacacataaaagtatttaatagataattgttgaatgaatgatgaaatgatagtgtatcattggtaaattttgagtcagagagtatagtaagagaattatagtttttggaggtcaaattgacatttgtattgttcactaagcttcagagatttggatatatgttctttacaataataaatgcttagactgtttcctcttggtggaagggatcaaaaggtagatccatcaagttttctctaaagcttctgcctaactaggtgctaagcttttgaagtttgagaatttgcttctactgttattactaactggggcttgtatgaagcatttcacatagcaggtactcaggaagtattgattgattgataagacttggatttgatacaaggaaatagttgcttacattcagggagaataattaaagataccagaaactatagaatcactttcctttagataccagtttttgtataatatacatctctttctgtaatttcatatgaccggaggcatgtattgacccttgccctactgacaaattaattaatatttgatataaattcgaataaaaaggaacaaagctctctgtatagcccaagaccgtgttgtggatataagtctgaaacctcaatggtttgggggcaccaggttaaggtagccccgtaatttccccagtatctgttctggtaatgaaacctttaaaaggagccagaagagcagagccttcataaaccaaagcacttaggattaaatattatgatgatattttcttgtagaactattcaacaactctctgtgaaagaaacaaaagttcaacacatggcatttaaggtgccatgattttaacacacttctctttctcaaatattttcacgagtatatgccctagccatgcttattcttcaagggtctctgaatttgacctttattattctcctttctctattgctacttcctcctggatctgcttgccaagtatggaacaataatttgtttttagtaatttctcaataaacatattcaacagattttaatggagtatctttgatgtgttaggcatcatgttatatgatgtggggggtatagaaaaaggaatgagataatctgctgttgaggagcttgtaatttagaaattccctccctgaataaatctctttgatttaccagtacttatgctactgctacaatatgtctggacatggtagatacttaagaaatatgtatgcaataaattaataaataattttaaattaccattcatcttcccttataggattactttgttatatattcttcaaagaaaatgtaatgcatttcttggtcttcgaacgggttttgaataaaaacagatgtctgcatggttaaattgcacaatcattgagattaacttatatatgtttcaaatataaatacttgaacagttttaattgaattgaagtgaatttaacataaaattctcttatgttctttctagaaatgagggcctaaataattttggtatgaatcacttatcagtttaagtactgatacaatgacctgtattcaatgactcttttacctaaaaaacagaatgtcaatgattacatcatgctcccaggaggactgtaccttccatgttgacgtctcttaatctgaacagcagctaataggagttatgagatcatcagtctcattctcccttcaggggtggtctcgtgtcagaagacactcagaagttttgtgtacctttagatttgtgaagtggaataaatgcctgatattttaacaaagatattcagatactgtgcagcatgcagcagcctcgagcatcataatcctatgcagcagcattaggtagaacgacttagagtggaacctcagaaagcacagtggcagcagtgatgaagccttcttattagatgtgggcatctccacagtggagtaaggccatacaaagggattattacagcacaggaagtctttaaaactctcagggtacattgagtgagctcttggatctggcactatttctttacaggtcttatccttttatgcttatatgtgagagcaaaagagaaaggagtttgaacattctatcctgctgacataggatttttttctgctgtattaaattcaaaattctactttggatctagatatgattcacaggtatcacaaagcatatttcttttgtagtagtctaccaatctcagatcggtttgaattgcagttgagcaacaatggtagttaaaacacattcaatcaggtcattatcgtccaataagacagtctcacataaaagtcagaaaccttctagttattagtcaaagcaatacatcagaatgccttgtttattatgatatggcaaaatgaatcagatgtagacatagaggatatttattcatcatgtagaccaaatgccacacaaaatataccatagacataattttaagagacagactattaaatatcatgcatcttctaatttttagagatgtgttggctgaacgtgtggccctggaacacatttgcatgcacatagatacctatacattgttctctgtgagcaacgaaaatattccaaccttcacttaacatacttactacgacaatccttgaactttagtatgcctacaaatttcccggaaaacttgattaaaatgaaaatattaagactattcttcaagagttgctcagaaatcgatcttaacaatcacgtgccaagtgctgttaatgtaggtggcccttggaccacagtttgggaaacactgacttattgttatgaaaaatatgttaattattaaatatgcaaaatactggttttttaaataatctaaagcaaagacagatactaagtatcttttaaaaaaattaagtaataaacgataagggatttaaatctgtacggaatagaaacccttgctctgtgctctgttactagctatttgtattagagcaatccatgtaatccctttaagtcagtccatctctagaaatggctgctgaggagaaaaaaatcttaaggctttgacagatatggatgttaattaagtgctgacaggacggcatgcattttacagaacaactgactgcttacatttttgtataattggatttataattaaattaattgctcatttatttttgaaatgatgtaatgcaagcagaggaatgtaaaaatagtgaaactttatttgtgatatttatagcatatatttttactgggataatttaagcccatggtgtcacacaggactataattgctacagccacacgtattccctggaatttcaggaaaccatcatttttaggtggtagcaaaaataggaaggcccacatagatttttgtcctacattttgggagtgtgtgtgtgtatggttaggtgccttgtaaagtttgagaaaatgcagaaaagccctgctgattccaaactatcttgcctgtggaactgataaggtaccaactccacacagttattttgcttagaattacaaaatttgacatgctaatggaaaatggagatagtaataatgaacaaatcaagtgatattatttcttgcttatcagcaatgctgagaattactgattcaatcaatgaacaaaagaggcactgttttagcaagcaagatttagaactcacaaatgtatttacgagattccactcaacctctttcctatcagtatattaataagaatcagtttattactcaagggcaaagctatattttaggtttggcaaataattgctgcttaaaatattaaatgaatattaaaggaaagataaaacatggtagataggtttcagtaggagttgcaaaggatgaggggatgtgaaactgacaaccgctctgttgtcgatgatttacatgaagaatctgtgtagaagagattgaagggagccaggcaattaatgggagtactgaaggtgacacagtaacctcagatacataaatgcagtaggaagtaacaagcatatctgcttaaaatcttataagccactaacttgtacattttcgtatctgatcctgaccaaatctctcacatttctagagctgtactgagttaatagggatcgtgtagattgcccaaaaatgcatagctagtaatacagccagggtttgaatccttttattctagacacatttaaattctctatgttttagtagttttttaaaaagatatttaaaatccgttcttgatctagatcataaaaaggattttttatattcaaaaattagcatatttttaataacgctaagtcagtgttttccaaaatgtggtccagggtccacttaacaccatttggggtgcacttgttaattagacagattcctgagtaaatcgcaagataataaggatttctatggaaatagctcaagcatctgattttaatcaagcttcctaagtaatttgtaggcatactaaagttcaagaattattgtagtaagtgtgccaagtgaaggttggaatgtttgatactctggggatgttacatttcatgagatgttttagaatgtgttgtattgctcctctttcatgtatacggcacacacattcaagtgacaggctgtttgaggggctaaggctgttgccatctgaagaccaatgcagctctatctgctcattgaacaacatattttattctgacaatggaaggatactgtttgtaatcatttgcagaaaagggggtattctccttgtgtgtgtactgtattccttggcttagaacagtatggtcttcagaaatttttatgaaatgtatttgaccactgcaataagctgcttaaacattgttaatgacttcatagaaaatggttagacttttgtttatagagtgtaaagaaatcagtgtgaggctgatctaaaacataccattagtcagttaaagggggtttcatcacctatatttaaattgtatttaataatccaaaaattaactggagagagataatatttatatgaaagtgcttaattgactttgtatttcattgtatagtatccccttttaaaggggtagcaattttaaaattcaaaactagttttatttccagaaaatttcatgtattcgtttcatgcatttcacttttatgtacatatgctgcaaagctttacatccacacacacatatccatatacatgcattacctaaacctcacaataacactcttagtaggaacttggatcttcattttaaagactgacacctcagaagatgaagggacttgagcagcagaggaagaatttcagatcgagtctgagaggaaattgtccctcagttttgaattgtagagtaggagatattggtgtctttttgtctggaataatatgtgcttaacttgaataagcttctgataatctcttggaaatagaactttgtagtgaatgttgttcaacatcaaattttaggttaaatatttttttaaaaaatgaactttcacgaggttgaaatagaggtacaatttatggataaaggcacatttttttgtacctgatgtgccaaaaaattttttttgtaaaagtgatatgaccatttgctgatatatatgaatatttcttcaatattcttgagatgttctctgtcaatgtaaatgattgtctaatcatcagtgcgatgaaaagctagtttcatttgtcatgatggaacacactttcattacatagcagtactaaattctttgtaaataatagttgctaatatattgttgaagcattttataataatttatttggactatccagcaccagaataaaacatgacaagagctagatggaggtctgtccagcagaaaaatgcatatctagatataggacagatttctcaaatgagaaaaccctagtgttgtctaaaggaaagagggagcaggaagaagaatgacaagtagaggaagagagaaggagaaagaaagacgaagatgtgtcatactgccttgccttactatattgagaagtgctgttgttttaaaatatgtgtaagagatttagtaaaggatgctggagaacagaaggtgaattctcctggaaattaacagagtgccagtccatgtcagggatccatcagtcatggagacccacagagctgcatgaggttgtgagatgcagcagcagcagcagcagtacctggcataaggcctggctgggtgtacaagaggtcacagggctctgaaggctgacacgttcagggagctggccagcacagcatggcctcaggaacaggaatgcacccccagttcctgcttctggtccttctgttatttcagttgttgagaagaaacaagtctgctcctgtgactggcacatgtttgtcagagttgcttttttttttttttttgcctctgtcacttcattttttgcaacactttcaggtccatggaggtcagggggctagctgtgaattactaagtggtgtggcctcaagagagaagtagtaggggcagtttcttccacattagtaggatgggctcagcttgctgccttctctactgtgctgctgaaggatgtgatcagagagtcacaaatgatgggataactggtgacacaatagaacagatcaccagcagaaaaataaatgtgtgaacaacatatgaaagatacttttatacccgaatggcaagaaatctatatcataaaataaattacatgctgctgggggatgtctcactgtcctaatgaaagacaaaacattttgaagtgaaggaaaagatagcatggaataacacagagaggctcaaaataatgaaaataacttttcattctgattagagtgtacatattcagaactggaaaacagacttccagtaatgcccaataaaccacatatttcaaaatgcttttaaatattgatacttaaaatatccttttctggagtatatttataaactgcaggaatccctaacaaggatcaaagccccagtaatagacattttctttccttctttctttctcgtctcttctcttctttttgagatggagtctcgctctgtcgcctaggctggagtgcagtggcgcgatctcggctcactgcaagctccgcctcctgggttcacgccattctcctgcctcagcctcccgagtagctgggactacaggcgcctgccaccacgcacagctaattttttgtatttttagtagagatggggtttcactgtgttagccaggatggtctcaatctcctgacctcgtgatccgtccaccttggcctcccaaagtgctggattacaggcgtgagccaccccgcccagccctcttctctttttccttctccttcttcttctttttccttccttccttcctttccttccttccttctttccttccttccttcttccctccctctttcattctttctttttttttcttttttctttctttctttctcagagtttcactctgtcacccaggctggagtacagtggcatgatctccactcactacaacctccagctcctgggttcaagcaattctcctgcttcagcctcccaagtagctgggattacaggtgcatgccaccatgctcagctaattttttgtatttttactagtgatagggtttcattatgttggccaggctggtctcgaactcctgaccttaggtgatccacccacctcggcctcccaaattgctgggattacaggtgtgagccactggacccagaccctattcttattttaggaaattaaagttcattttggataggattatagttatgtacatggtccattcatttcatcatttattcaataactccatatcaagtgacttctgtgtgtcaggcattagcgccacaacaatgaacaagatatgtatcccctgccctggttggcttacagcctaatggaataataaatggttactgaatactttcagtcaacattttgcatgcacaactttatgcaaaccttgcaattgtgctatgaattagatattctttccatattaaaaggtgaagacaattaggttcagaggctgagtaatttgcccaaagttgcaagctaaagaatggttgagccaaaattcggcaagatatggctaactttccctgtacacatttatgcattttggcacatgttcccatatactgtggtcattattgagaaggaactgttaaattacattctagccctagaaaagttgtctgtattttattttcaatttactgagatatcttgctgtatgtggacacaactaatctttttttaggcctatcccacttctttccagattatctatacagttcatgggtaaatagaccaaaatatcactgatgtactctatcaaaatgaaaaataagaagcaaactttcacagaaattgctcttaattcttcacctttatttatctgtttctttttctctctggtcagtgctgctttcttgcccctcaatagcaacactgcagtagcatctcttgctcttaaatgtgaatatctgtgggaaacatttagaattctcaaattataacagtttattattacacaaattaagatttcactctgtcactcaggctggagtacagttaggattacacaaattaggatttgtgtaataataataaaattaaaaataaaaataataatatgtcatctaagttaatttttacaaagtcaattgcttgattggcattaaagttttggcatttttatgtgtttgctttttctaactttctcttcattaaaatataacttgtcttattttgtatgtgtaactcaatgagaaaaattagaaactatcaggacaaaaaaagtgatcaaattcacatttttgtgacaaagtttagataggcataaccagtgtgtacacatttcaaaaattttcacttaagtctatatgtagataacgatgtcatgcacaatcaaaataaaaagctaaaaatctttccacagatcatgtaattgattttcctgtcctctaaaagaattgttggccgggtgcaatggctcacgcctgtaatcccagcactttgggaggccgaggcgggcggatcacgaggtcaggagatcgagaccatcctaacacggtgaaaccccgtctctactaaaaatacaaaaaattagccgggcgtggtggtgggtgcctgtagtcccagctactcgggaggctgaggcaggagaatggcgtgaacccaggaggtggagcttgcagtgagccgagactgcaccactgcactccagactgggcgacagagagagactacgtctcaaaagaaaaaaaaattgcttttcattcttcacctctattaaactgtttattttcctctctgcccaattctgcctaggaaaataaattaataaaaatttaaaatttcaggcttatatatattaaaaaggaaaaatatgtttatcctggcccatatattaccatggtccaggtaaaaattttgtccagcctctgccaaatgctaggattcttgcaaatcagggagtatatgtgttctcaaaatccattaaaaaataaatagactcctatatttttctctgacataatagtatggtgcaagcaatcagtaggattttaatgttgctgttttaaatatgttcgactatatttatacgttgaacactacaacatgtgttttccttttaaaattgtttttcatgctttttttttgttttgttttttttgagatggagtttcgctcttgttgcccaggctggagtgcagtggtgtgaagatctcggctcactgcaacctccacctcccaggttcaagtgattctcctgcctcagcctcctgagtagctgggatacaggcatgcgccactaagccaggctagttttatatttttagtagagatgggggtttcaccatgttggtcaggctggtctcgaactcctgacctcaggtgatctacgagcttcagcctcccaaagggctgggattacaggtgtgagccactgtgcccagcccatgctctatcttaatttatgttttcattcaattctatgtcatgagatttcagttatgctattatatattcttttaaaacaatgatttaatgtcttttcaagatgaaacccctattgtgtcattattgatgagtgctctaatgccctaggccatatcattcttaaggtgatccagtaagcagtggttgaggcaggaagtcaccaaatgactcaaatctaagaatgcaacactcctgtataaggccctgcctaccgcaggaaggcccattcccaccgtgctgtgtttaccatggtttcagtgaaaatgattaacactttttcacgtttaatagcatacaggtccacacaactatgtcattgcactggcttgttcacatatctgtgtactctttttctgtgaacttcttaagagcaagcaaactgtgcctttcttttttgagtcttcatagctacatgcttagtcacagtggtggattttaccacggagatgatgaaacttaagtagcagggcccttcacctgcatgaggctattccagggtcctgggtgaaactttagcagtgtaatcacatggtcgtacatgattgcaaaatttttaaaagcaagatattttaattagactgctacatggttttgtattttcgtttatattagtaattttattttcttcttgtcctgaaagaaggctctccaaatggacaattttggccccacaaaaccttgattgtcccctgttgacatgcaaggaacacttatttgcttttttcttgaataagtgaaagaagtaaaagggatgaggaggaatgaatattttattaattaatatattgtaacatttaaaattagcatgtctggcaaaaattttccttaagccactaacagaaaatgctaacatcatcacccttgtgtaatgtctgtgagtttacaagctcttatacaaatgtaacttcaattgaatctttgaaccaggccttccgttaaatgtaaccttcaattaaagtgaatgatatcaaaatgtttacaactgtgctatttgtagaaaagacttattatactcaatggttacagaggaaaagaaacctaaacacatgattgagtgacactcatgattgcattgtgtcaatactaggatgtcagctgaagccttctgatactgactccagtctttgcattacacggtgtttacaaatatatttaaataaatgaaaacttattctacaaacgaaaagcataaagtcacataggttaataatgttttcctcaaatgatgaacatttccaatttccttccctttctttcttctcctctcctcctctccccttccttcccctctccttccttctaattctttccttcttcttcttttctttcttgatgcaggtgtttaaaattatccaactgccatagagctaaattcttttttggaaaattgaaccgaacttctactgaatacaagatgaaaatgtggttgctggtcagtcatcttgtgataatatctattactacctgtttagcaggtaagaaatatcctttgtatattctacatatattatgtcaacataattgatatgcgtgtttattaaatgtattgtatgaagtaaaaattcttattttctcgacatctgggtcagataagtagataaatatgtatcaagggtgaccctatttcctttttaatttcaattaagatttcacaaaacattgtcaatcttgggtaatagtgtgctggtgaatgtttaaaatctagatctctggggagatccctggagtgtagcatttgtctattactggggagtaaattatcctaccatggccagtttcaacctgacatcatttaatgtggaactggaaagatgtgcaaccgctcaccagtctgtagtattttcaccaccctgatataagtaaccacaatggcaaagagaatataaaatatagtaaataaaagagagaaaacaatgggttttaagcatttattccctttgttcttagtataatttattcatttgtaaattaatacaatttttaatactggccatgtttaacaactgattcacaaaatttctgaaaattaataatcacttcttaagagctataagcagatgcaacacactactgaatcttacacaactcttttgccaatttgatcaatataatttaaaaaatggattaaagtaatctacagtgtgtgtagggacataagactaataaaacaattttgagagtacattcattttaggacaaagaaatattatatttctgtctttcaaaggcaagtgtgaagcattcagacctatttcctacaatgagaagcacatcatatctttatctgaaaaactgatataattacccaactagtacttattgagctaggtcatttagtacttattgagctaggtcattattatgaaagtattagaaaaattgaattctaacaaccaatttttctaatactttcatgataatgacctaacccagtagatacttgttgagtgactgttttgttcaagacataaatggtcctcatccttttgtatataaatccccattgatcactttaatgattaatctgacgggcatcattattaagaacataaaaaaatattattttattttggggaataatttttattatgctcactccaaaactcagaaaagatcatttcattagtacttaaggattttaatgacattgataaatatatattttataaccagggtaattatgcacacacacccacatacatagatgtaattacatgcataatatatttacatatatataatgtaaatataataaagaaaaaatttggtaaagtcattgtgaagtcttatttttgtgaataaaataaaataaaaattatcttattattactgaaaattcatacgaattctattgactgcaaacttcggtgctgcaactatcaatgtaaagataagaaataagtatctgcacagatgtgaagatacttcaacctttatagtaaagggccactactctcattccattgtctagcatctcagctatttaagtaatgtttgaaaccacaattcaaataattgcttcaggatcaaaattgttttttctttcatttttagagtttacatggtatagaagatatggtcatggaggtaagttgaccaaagagtagaccttgtaaacatcttttctctattgaatcatattttatctctgctttaaactattaactctctaaactttaaggcaaatggttaatgttagatcactatgaaattttgtaaggtggtctttctgagattataagcaaactgtttgttgaatgagtggatacatcataaacaaatatcctattagaggattgtagcaaatggaaaatattcaatttggctggctttttttcctgcatgctttgtaacaatgctatgcgactaaatttggaagcaatattttaaaatttgtaagccttgaacttatttttgaaagcctcttgctttgttgcaagggagataactaaagttagtgaaattggaatcttaagattcagttcaattaaaagtccacaggtattgcaaaatttattgtttaataatccttccagtttagagcctacttcaactaccaaacagatattgcagaaataaagtcagcatggtatactggaaaaaatacagagtctagagtaagaccagcctgaatttgcattttcagctcagtacttactagatgattttattatcttgcataaattatataacttctatgagtctcaactttccaatatgtaaaaatcacagaattgttgtgaggactaaaaaatgaattgcaatgataacttctagcataatgactggcaagtaggtgcttaatgagtgtagcaacactagtaacttacaaaagccattgcatgatggtaggagaatgaaaaatcatgaagaatcactgaacaaccagtgctagaacttgcatgccaaatcaaggttacccattgtattagtctgttttcacgctgttgataaagacatatcccagactgggaagaaaaagaagtttaattggacatacagttccacttggctggggaggcctcagaattacggcaggaggcgaaaggcactttttaatttatttatttatttatttttgagatggagtctcgctctgtcacccaggctggagtgcagcggcgcgatctcggctcactgcaagctccacctccgggattcacgccattctcctgcctcagcctcccgagtagctgggactacaggcacccgcaaccacgcccggctaattttttgtatttttagtagagacggggtttcaccatattagccaggatggtctcaatctcctgacctcgtgatccgcccgccttagcctcccaaagagctaggattacaggcgtgagccaccgtgcccggccgcaaaaggcacttcttacatggccgcagcaaaagaaaaatggggaagaagcaacagcggaaacccctgataaacccatcaggtcttgtgagacttattcactaagtattttttaaaaatagcctatggctgctttttccaattccttgacccatattctccttttaatctgctgcaatcagtgtttcccacgagcactcaacaaaaactgcctcattcatgtctctaatgtcacacattgtaagtccagtggtcaactctcaggcttcctacttaaccggctggcagcagtgctgcagttccaggtatcacacagagacataacaatgtcttgtaggcaaatagagcatgcttgttttttttcttgtatctatctacctttaaaaacaaggagacctttcccagaaaccttacactacatgtccagagttgggtcacacattcaccaacaagcccatcgctagcaagagtaatggcatcactccctgtcaacctttacgtctgagtcatgtgagggataggttgatccttgaactaagctgagctttgtcatgaaagtaaagggcagaagaggagctgattagtcaaccaacaatgtctgcgaattactcaggtgaattgaaattgagaattttctcacaaatgaaaaagttatatccaatatgtcatccagcatatataatagtttttaatgattattttacagcaacattagtagctagtgttcaaatatatgtattaaaacaaaaacattttaaatttgaaaaacaaagtacataaaagattataacaaaatcatcaaaaccaacttcactcaatgtctttaagaatatttttcttcttaatttttttttagattttgtgaaagcaatattgtattctattgagataagagagcaaatatgaataagttgcacataatctgtaatgtttagatatttaattaataactaaatcatttgacagcaaatattttagatgcttttttccacttgtagtctgcatttactttactttcagaaagaaaaaaaaaaacctgcagctattgtaggaccaacttacacccaggctaatctaaaatgaaaataagtatctttcattcctttgtaattcattgagaaaaagtatcttaaaaatgaaataaaatagcagtataatatatattttgtaagaattgggatatgaaataatatataatttatactttgtacatttagagttatgatatgactgtataatatccaaagctaatatttaaaaaaaaaaactatcttcattgcttagctgtagggaggacaggtagaacatttcatatatctttacagtacttgcaccaagatttcctgtatattttttcaactagactcacatcagtcagtaagaattattttcagtacatatttctatctctaaatatgattgacattttatagcagtcagtgacctgtctctattttgatctatggtcccacatagccccattaatcaaaatagactagagttagactgaaacaggccaagttctggaagtaggcccaccagcccagtcatgctatatattaggatgtagtaagacgtgaggtaggtgtcagaagatgcccagccaggtatgtaaaacagaatctagatgcttcagaggtgggtcacaggacaaggaagtagttcctctagagagatgtgacaggctccccttgggcaggtaaagccaagcaaggagaatttagttcacttaactttcatactaacctgactatattctttattctaataactgtatttctgcaagtttttgaggccaactccttactttgtatgtttagttataaaaaagtactgcaatgttacctattacccatgaccctaaaaaactggggcaccagagtgtttaaaggctaagcccatcttctgttatcagcaggaaatggttggcagtggagataggaagctgtaatatgtggaagaaggatgctttgtgacaatttaaatattatctcatttagagagtttcaagagagcttacaccactccccacccaataatcactgtaacactgtaaatgtaaaaatttccattttagtcttttgaaattttgatgccattacctttttctaacagatttttcctaggactcttcttacaacatgcttatgtaaaattgtgtttactaactaacagattgaggtgacatataatagactgggaagtggagtttgtctcaaaaagtatataaaatgaatacaaatatctctgaagtacaaatcataattttactttcaattcctggaagtaaaatagaatagcaatattatagtggatactctccacatagtggtaggtgaagtaatcccatttgagattatataagtgactaattatattaatggcgaaagtgagaatgaaagaacagtagcttttgcctctcatttacattagtaaatatgactgcaaatattcttacattatttatttctatcttagtctttttgatcacatttaagaaatgtacttatgtctgtaatagatttatgataatcacattatctggtaggaaataaatgtatttgcattaaaagcagatcaaaatagtgatatgaaatgttaaagcttcaattagcttgagaggtcatctataactttgtgctccttttaagaagaatctatctagtaaaaaaaaggaatgtattaaaaaataattttagtttttaaaaacacaatctctatctgtggtttgtttcttatgccttttaacctcataatacttccaaagcatcaaaatttgtcatctaagtgtttccatggctgtagaaaaaaatcaatagatgacagtattttctgtaggctgagaacataatgcttacattactggatcctttgctgagctttgtattgaaatatccctcaaaattcttctccctgcatctgagcaccctagttgagctagcgtggtcggaaactaaggtacagcctgcgagggagacatgaggatcatattcaagaggttcatgctgaacctggcaatgcaatacagatgcttgttttgagtaatgtttctttcaagggcccaaatatgttcctaaaataaaatatatacagtaatttctaaaccgtcaaacaaaatacattatgtgactcaggcttgaaaagtttagaaagcaagaagaatatagttatgaaataaaatccttaatagaaaaatgaatgtgacgtgaagtgtgtcctattctgctttttgttctaggaaagagcaaagggaaatatcttaactgcaatattctctcaatgtgaaaaataatttcagtattttcttggagattcgcttcttattttaatccttgaaagcttgcattgtctgttcctataaaggtcaaatataagtgggagtattgggaaatatatacatataatttgtgaaaagtattgtaactgagaagaaaaagtagcataaggcaccaatgttatccagtttggcctataaaattcactccaaaattgtatatcccctttgagggtttgctcattccttatatataggaataaccctatatacacactcagtataactttataggcatggcctcatcattattagtatgtgacattctataattttcaatgaaaattttccttgctagcacctttttctttttttaaaaatacatattattaagataaaaaagctacttaaaacatattctcagttttctgaaagctgaccaacttttatctcaaaagcataatataccttaaatgaaaggatacattatcaaaagaaatacttaagactactcatttcattaaaatatgaaaatctactaatctttacatagaaatatgttcatgtgaatttgtctttattgtatttgaaggcgccaagcagtactttcagtaatcaaagcaattctgaatgaccataactcaccttacttcaaagagataaaaaagcttcttttaaggaagcaaatgaaattataaattaaatttagaattctggacgatgaccctccatataatgacacttctagaagccactttagaagcagacactagacaggccagggctgtctgtttctacattggaagtacaattgtgtaactggtctttattaatgtaagcctgtacctctttgagatgagttcatattttaggaagtcatatttaatcactactatattccccattattaaatgagactgatatttagtttctaaaaaatctttccaatgtgctgcttgtagaatgcaagtcagagaaggttcaaaggaaaactcttaaccctgaagacctgagattctcttaacgatgtctttcactgagcagatcttttgattttaagaaaatccaacttaatcctttttttttctttgatagatcatgcttttggtgttgtgtctaaaaacttactgaagtacccaaagtcagatcaaggacagctaacacctatagtgtatcaaattgttgctcccaacatgaccatctgaaatttctatgctaccactgttgtaagaagtggaaactcaagatccaatccagtgcagattagtggccttatgtttaaagtgtatgcatacttgcaacacaaattcatttctccttaaatctccttacatgtatagccttctccattggtaataacatttacatcatcactaggcttgtcgcataaatatcgaagtacttagaagatctttatgaactttacactcccctaagcaatatttatttttagttttctaaatatttatgaacttagacttaaaataaattgttttaaaataattcacactaaagtcattatttatcaaggattatagtgggaatagaaattatcttaccttcaagaagagaatctagatatattgatttctctacttgtctttttaagcatttttatatgcattgagaagaaacaacaagatcttcaaaatggcaggtgaactaaattgctccagtcagaaaccctgtgcaattgggagagactcaaggaatagcttatgaaattgtccaactgagaagaaaaatagcgtatgatttttatcagagataagcacaaggtcatttctttcagaaatcagaaaatccagaccttccataaaaaatgaaagtcttcagtaatcaggattcaggattcatttctcattttttccctgctgtgctgttacaacctgaagagccagaaaatatcaggcatcttcagtaaaagtattagaagtgaagcagaaaacattatattcatttatggcttttacagcctcaagaaggatatggaactagagacaacctacaacacaactttcaaaattattagcagagagcatctctgtgactacctcatatttgtaatcttaataataattgtggtaggcacatggagtccttaggacatatgctcatgttcctttcttttctgaatgtacgagccctgtaaaacaaattgcttgcctaagacaataactagaaaagttcatggcaggagctaagtctcagttcctctcattcttctgattctgatccagctatttcctatctgaaataggatggtggttatggaatatgtctgaggtctataaactattgaataaaagtttcagcaaatttcaaccaagaatgaggcagctccctttgaaacattttgggttaacttttttattaaataaattaattcttcataccagtggtgggggcgggggggggggcagaactaacttgaggattttagtaaccatctatatgtacaataaaaatgtactgagtgtcccaaacaacacagtgctaacagcaccagagccaaaggagtgaaaacttggcttttggtttttagaagcttcatgattagttgaatagcttatatacataagaaacataaacaaaattttgaagagattggcaaattcatgagagtgtttttaaaattagcatttattcattgctgattataagctaggtacattgccatctttcatgaattgtctcaaaataattctgataataaccttttcaggtagattttattatccccattttataaagagtgatattgagctttggagagattaaataatttgtccaaaggcacactgataatgttactgaaacaagatttaaatgacataatgaaactatttgttcaaaaggaagctcgaacagcactctcatcttcaagtttagtgtcagagaagacaaaatatttgtgtgccattgtctttacctctctcttaaaaaacaactggaggagtgaaccatcgcttagattgggcagagacattccagtgacctgtaagaatattcgttctttctagccacacagatgattattaattcatttgaggcatatggctttgcactgtgctctctaaatgctgccgcagtggtggcatgtgaatgattttcttctcctcatcctgctatgaagtgtcactcttccctgccagggagaatagaccatgaggaataactgcttctcaacacggctgtttgtgataaattttaaaccagttgttcagatccaatatccgtgtaatttattgattgattgttctagatggtgctgagtgccaacgctagtcacatgtttagaaaaaaatcaacaaaaactggctcagaaaagagactgattttctcaacatcaagaagctctcctttgcattcagactcttgttcaaaaatcattaggctccttttgttttccagacaacccaggagaatgatgtacacagatgaaagacgtagccacctgttctcaagcatttgcaatctagcagaacagaaagttgtaccaagaatcatagcaagtgtattaagtaccataacctttatggggagctacaggaactcaaaagaggaccaataaaagccaggagagatgagaggttttggcttcctgttggaactaactatggctaggtcaccaaaggatcatgcaaattttgataggacaagaaaagtagaatgatgattctaggaaaaccgaaagcatatgcggaggctcaggggcatgaaagcacagcttgtttggggaagtggaaagtagttaagtttggcaacacatggtacatttggaaaaatgacaggagatgcacagaaaataattttaaatgaagaacctgatgtttggctcagtattatggaggcaaatatctttgttttgaattaaaatggagattctgtttctgatttttttcaagtaattttttttcaatgttctcaaattttctttgacttataaagcagtacaatgtaaaacaatttcatatttcttgtagtttctgaggaagacaaaggatttggaccaatttttgaagagcagccaatcaataccatttatccagaggaatcactggaaggaaaagtctcactcaactgtagggcacgagccagccctttcccggtttacaagtaatgtacctcgcttctcttttcagagtggagtgtcagagtaatgatcacagatcagcatctatgaacttgtacagatgtaatatagtgctttctgcaaattccatggacattaacaaaaatattggcatacaaactattaaaaaagttgcctaatgctcaaatagcagattttcttaaatatatgcaaataattctcttactattttttgcacagataatgttactggcatttgacattatccacttataaattgtataatggaaatcatgtttttaggcccatgaatggttacataaaattatgcataatttaaatatacagatttgaggataaaatgtttttgttatgtactggcctgcataactcatacctacagatatggataaatttttatattaagtacatttaaagatcttgcacaaataactgtagaaagcaccatatttttcaacagtctcatatctatattccacccaacacagcaaatttcttaaatgtctctacctataggaaaatctatataaacatacctcttactatttttctgggttacatatgtatgctatctaaaacaactttataaaaagcaacaatgagttttcctgcttcagatgggtcataaaagtatactaacagtttctcatctgatgcaaagaatgagatgcaaaaatcaaccaaatgccagtggatttaaatttcacctgtgcaatggttccatgaagacaaaacaagtgactgatggagaaattgggggctctagtgtgttaatgtcacctgacttaattgaaagttgtcactcaacaaagttaattttaatattttttccttgatacaaaagtaactttctattattataaaaagttcttacaaaagagaatatccctttccacccatttgattctaacagtactcagttttttcctgcctttggctataatcacaaaattattcttaagataaaattgtgaatttagatacaaaatcaccatcccattgaaattatttttatcgtttcaatttcatacatggaaatatgatataagtaggtattttataaattataaataacacatttgttctcaaaatatttgatgggctagacttatttccacccttaagccatatataatgagagcctatttgtcattgacatggaatagtagaactaataggatctgtagaggagatccaatccaagaaaattttacaggagaggaagctgaatcctgaataagtaaatttgcttgctcaagaactagtaaatcacagatccaagactgaaacacagtttttatgacttccaatgaggtatgcaattttttcattatttatctatctggatagattgatagaatcccaaaaactctttcagtgacacttatgctgtgacactctgttgttaacagtcacacaagggaccttagcaaatcagtctctaggctagaacagaggcaaccaaaagaaagggctgctctcagataacattctagaaacatggaaaaggctatgcttctccttgctgcccccatgcccccaccccacaggcacaataaaaagcaaagctttgctttgccagtaagtcaccaactgcctctctcaggttgcacccagcactgaaattcccactttgagtttggcctggttatccatacactaatagacagaactggagaagacagatagatgtttaatcttgttatgaagacagtctgcatttgacaggaaaaaaaaaagtggggggaaagaacagaaaaaaaatcagctcatgatggaaatagtttgatggaaaagaacatttaaagtttttaaaatgtacataatttcaggacaaattatactaaccttggtaatcatccaatttttcattcatatagtagttatatatttgtagcatgttctgggacaacgtgctattcatagcaacatcctgagaggtacaacagggtactttacttctgacttataagccttgaggctttcattatcttgcccccatccccaaagaaacaagcattacaataaaaaagtattaaaagggattgtagcaatagtctatgtttctgaaactagaccagtgaacttcttcaaagacagaaaaaggtaatccttatatgatgtcacaagcacaatcagatccatgtggaggaaggtaagataataaacaaatatttggaaccaatataatgagggagaaattacaaaaattggagctgcccaacaaagaaacccactgtcttgacaagagctaagcaacttaacactagatggttcaggcagggacaatattgccatcacctgggggaagaggaaggctttattcattggattgtaatttagtaagttttaaaaatgcaaaatcacagttttctatacttgcttttaaattatctcctatactgcgaaaattgtaactaataatgttccagtaactttgatttgacaacagatattctaaagtcattaggacttttgggcatgattattactctaattagaagtggccaggaaatgagcgatgtggccacgagccactactacttgagcgatttgaccacagctctaggcttatgactttcctgaggacatggaactttaaaggataaaccctgataaagaatgattataaaattatacagttggttctcttagttgagaactattttctacatgcattcttttcatcatcacatcagaaagttagatccctgtttccagtctatttataacactatccctatcagttaatgctctgattatctgcagcatgtcttatattgttatgatattatgtggttggggagaaaaagaattgttcctctttttcactttattaaaagtaatcttagagtaatgagaaaagacataagtgaccactaactctaggctgaggaaaatccagatttacttgtatatttgtggctcggaataaatttttaaaaacccaactgacttttatcattttcaaattgtgtgactgacctctagtggtcagaatatgtcacttattgagcagaacccactgtcaattagtttgttttattgaaaaattactttgaaatttagagtcagatattgatattttgtattttatttatggtagaacaatgcttttaatactttatacagtatatctgcatatgtatgaatctaactggtgcatagatggctatcaattacatcccaagaaatcaatttatggagaaaaactcaacaaaatatttgtcacttgagatacctcacaaaaaaaagacaaaatacgtcatgtactttgatgtttccttgtctgtacttgagctaaattacaaattatggtcctagagactcagaatcatagagtacaaagaaataccacctgaatcatattcttaattgtctgacttcacatggagccgtacccaaattattttagaactgtgttagctccgtagagtttctaggtctcatgacctgtgatatgacctttgtgtctttttctcatagatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatgtaagtaaactgtaacttttaaaaaagggcaagcgtgtttaggtgagttcagcaagaagaacaatcaggaaaggatagtgagaggaaggcatcatagatgaggtggatcttacaagatgagtggaccctaattgtgtaatggagacaacaaagcaccacaaggcatactatgaatgcacttgaaacagtgaaagatgatgttgtcaaataaaggaaggccagcgtctgaggatcttgaatgactctttaaaagttagcatcaggctgggcgcggtggctcacacctgtaatcccagcactttgggaggctgaggctggtggatcatgaggtcaggagatcgagaccatcctggccaacatggtgaaaccctgtctctacttaaaatacaaaaattagctgggcgttgtggtgcatgcctgtaatcccagctactcgggaggctgaggcaggagaattgatggaacctgggaggcggaggttgcagtaagccgagattgtgccactgcattccagcctgatgacagagcaagactctgccttaaaaaaaaaaaaaaaaaaaagacatcaatggaagcaacaagccatgtattatcaaaggggcactatcacccctaagggggtgaaaattgtcttttgggggaagaaaatgtcacatattgcaacataatgtctgtgactcttcaaagatcaacccaatatgacaatattgtattccctaatatttaacttctaatagtaggaataaatttaattatattttagttaatttattttaaatttaaattacatgaaacatttcttttaattagggctaataatgaaaaactgtgctaagctaaaaattagaggttgttttgaaagaaaattttacattgggagatgagttggaccaggtgatctccagtatgtgatttgtcagcacttaaatcttttgcaaaatgaattataggatgaaaacaatgttttaagaagtccttcatggtagggtttatcaggagggaatgagaaaggtccaggaagagaagtaagattaaattagtgtggtgagagtggaaatgtaaataatatacattaaccataaggaaagaattaacaggttgcattgcacaaaaggaaagaagactgtacattttttttccaagttatgtctagtcagagggtagaaacattctgttctcattaataatgggatgggagcaagaaaaaccaatttcaaggatggcaggaagcatttaaatggttgcttcacatgcagaggttattttgatattgagttatccaagttgaaatgtcaagtaagctattgaggatagggatggcattcaagtaagacaccaggcctagagaagtagatttgaaaagtcctctgcaaaaaagtaacacttagcatagatgaattttcagaggtatacactttatactgagaaaagtaacaattcaatgttataatttgggtgccgatcacaggttaggaacaggaagagaggcagaaaaaaatagaatgagtatcagtaaaacaaatgaagaactggaagaatatcaaggaatcaagtgaaatgtaagttccaaatacatagaaaagagtaaagaaaattagaactgaaacaaacccagaatttgagaaggagcaagagattggttactttcacgttccctaatgagggtcctgcctttcacccttattccttcccgatatccaagccctccctcaggaagagaaatacccttcaaatgagtccattcctctaagtcattccttcttacttactttctttggtaggtccctggtttgtctgatttcattgtatttccagataccctgactgagattctccctaagtctgaaacaaaagtcttcaggatatttgtgattttcagggttgtcagaattcttatgcaggctgctcccaatatccatagactttgagctcataacagaactttttaatagtctatacaaaatctcagcaatgtaagaacgaggagctgactttactaggcttcaccaaaccactgagaagtgctgtatctcacgaatgagttatttgctgaaaggtaaaattgatgaatgtctctctttctattgaccagagagtgaatgtttctctttttttctttcgtaattagatcttgatcctttcccacctgaggaacgtcctgaggtcagagtaaaagaagggaaaggaatggtgcttctctgtgaccccccataccattttccaggtaaacttaattcctctctgactattagcatctatgaaacaaaatggacaagtttccattttcttagtaataatgctacattattaataatcatggcttattattaattaaatgagactgaatatttgcataccttgtaatgtgtcactaattgttgtggacactttctttcttggctcagtcacctggctctagtcccaaggatctctaatcattttagtttataaacatatatatatatatatagtattatgtcatcattaaagttcctattccatagggaaattctgttagattttctagaaaatattcctgaaatagaacagtaccaagaaaggatgtataatcaatcattttcttaacaagttagtatctatgaaatactgtgaactgtatgtaactaaaccctagaagggataaagacataataaattattaatctccttaggaataccaatcagcaagaataatcatctactttataaatggggctaaattaagtgtcatctgttatgaaattcaattttgaatctatgttttctgtaattttatatggctaagacaaaagccaccaaagtgctaattaaaagatgaattcctcatatactttcaccaattttcatttatttatcaaatatctctttgaaacaatatataaatacctgttttcacaatttaaaaatcatgtttctattcttttagttctaatattatgccttaaatttgactttaaacatctccatagagaatgaaacgtaacaggcttttaaactccatacaggattttgtgtgggatacatcaatctgatgtgtgtgtatgtacatatacacacacatatatttcacacaaaattatgttatatattccacatgaaattgtgtgtgtgtgtgtgtgtatatatatacacgtatatatacgtatatacgtatatatacatgtatatatatatatacgtgtatatatatatatacacatatatatatatagagagagagagttgtggttgtttacatatcaaatatttgtgattttctccacaataggagaaagatgattgcttgataaatacaggaggtacatataaaattcaaaattttctaacaccctttcaatgagaaaaacctttttcttaaggaactattgaaattatatatatatatatatatatatatatatgtatgtgtgtgtgtgtatatatatatatatatatatatgtatatatacatattttaaaaacctaccattttcatagtgtttcccacaaagtaatgaccaaaactatccagtgactacatttgaccatattcaatactggatggacttcactgcatcactcattgactcagaaaatctcttatgagtatttgttatacagcaggcacaatgtatgccacagaaatgcctcagtggagcaaaacaggaaaagctaccagccttcagaggtcttccacggggagagtcagacattaataagataaatggctaaaagacatgccatgttagatattgctaaataaggatagatagatagatagatagatagatagatagatagatagatagatagatataatgcagggaagtggggagagtaagtattgaggggaatgactgaactcaggaggagcatcactagaaggaaagttggaataaacacctgaaggaagtaaaggagctaacaatatgagtatccgagagaagagcatgccaggaagatgctgaggtcagactatggaagaccaaggaagccagggtggctgtcatagagtgaataaggcagagggtagtaagaaatgaaataagagaggtacaagagctgcattatggaggaccttatgatccataacaattattaatactttggcttttactttgaatgcgatttacattggtgggctttgagcagaggagacacatgacatgacttaagttatagaaaggtgactctggttactgttttaagaaaggacctggggaggacaaaggtggaaacaagagatctgtttggaggtattgcaatagtttaggtagcatatgatgggccagagtggtggcagtggaggtgggaagataaatccaagcatattctagataaaatagaatatactaaattctatatagaaatctaggtatactttggttaaattctagatatattttgaaggaaaagccaataggatttgcttgttgactttatgtggtatataagataaatacaagagttgagggtggcataaaagtttttgctgtgagatcctaaaagaatgaagttgccattacttcagctgaaggaatagatgtggacatgttaaatgtgaagcatctgttaagcttccaaacggaaatcaaggtggcagttctatatgtgtgtagatgtcgggggtgatggaatatcaatttatgattcatcattcaataagttgttttcaaaactatgggactgcaatgtgcttacctagacttctggggcaaaagcaagaagtgtcatatatctaccgataaaagcaacatttcttaagtatgtgctggcacttactgaaaaaataattttatggttatttattgtttaatccagtctataatccgaggaaaacagatagcttttgcaaagatgattgattttatcatctgtgtggggctaggaaagacacaaagaagatggtctgttgagtccttgaaagaactagatcagggcttagctcttgattgacaaagtcacatctcatccgtaagtcggagagtcagcgtggctattgctctggtgttggtacagcttattttggtgatggtgggtggggaaagaggtgagaacatcagttctgcctcccgtttgctgtatgacctcaggcaagtcacttcaccctattaggccttggatcccccatttaaaaatggcaagagccattcctacctttgttgtaacgattgctgacagattctaacaaattgcaattattgttttgtccaagtgaatggctttaaaaataagtaagatttgttaaataaatttagattaattatattgcaagtcccacaaatccaaaggccacatctatcttgtttagcagcacttggaaggtacttagattttgcaaaataagtaaattagagaatctacatcgggcattcagtcagttagaccagttgttctatagtccaagacttatgttcatacaacatcacgacaataacttctcggatttagcatttatcccttataaggatcaagtaccatcacttctttcattccttttcacacatctcttatgagtggggcacaggaaaatgtcttacattttagagaaactgagtaatagagtgactaactggcctgataaaaaagtcatactgagaattaaaattcaggtctctgtattcacataaccactgaggattcagattactctaaatgcattttgtgggcagtatctttcatacattctatagttacaaaagtcctttctctgtaaggaaatacaaaatttcttgacatttttggctttggtggtggggcagggggagtggggatttaatttttaacagaaatccttacaaaatttggatttacatttcaactgagaataggaaatattaattcagaatcagaaaagatcaaagtcttcttttaaatgtactatacatatcagcttggatgaaagactacttaatactcctttctgaatgtgatacttctttacttatcccaggagccctcatttaagaaatttaagcagctccctaaatattttcctatactaattatcctgtgaccctaaatcagcaagaagaaaacaaatgaaaagaattcaattattcacagatataagtgcctagaaatatatgttaaccgtaattctgagttagaggctaattatggtagtctaattttctgcctctttttatctgtattctgtttcttcaataataaacatatgctgctgcttctataatttgaaaaaatcaatgttgaaaaccaaaagaatataatcatattcactgcctgtcttgatgttgtattttgctggagaaaattacatagctaagctaaatataatgcccaggttattattcccaattatgtgaagcttatataatgtgcatctcttttagtttttcatagtcattgtgctttcacactctctttgaaagctttgctagccacgctgagttcccgaaagcaaaatagccatttgtcatgattattcatctttaaaagaagcctgagtgctgtgatttcttggtttttcaccattttacacctaaaatcctatctagtctgacctagagagattcccacttatattcttcccagtagaaattgtctttatgtgatcaagatgttttgaagggaatcatcattttttgacctaaaggtatgcattgcccattgtctccttgtgtatttgttgaatgactcctggggagtcattcatcaaaacagagaggaaagaaggaatagaaaactataggaaatgcagcaaattaaggaggaaattcagttttccatttaactagttagtgtgttcagccaaaggaatttcatgtgggtaagagttaccatatgatacatctcctaatatttaattaaaccagtaccatacttttccctgtttctgtggtttccctttttaatgtgaccacaataggttatgtaagctcatttctaactctataaaataggtgcacacacacacacacacaaaaaaaaaaagataaagcaataatatggtaagtaatcttaattatatttataaaatgcagtttggcagattaatcatggctttcgagttattagacatggattcaaaatcctatttcttcttaatagtcatgacattctaagcaagttatgtaacctcttcgagtttcacttagcccatcaatgaaatgaaagcaagaatataatagtttattaaataatagaaatagataaatagatgtaattgcttagtgtaatgcttatattcatgtgaaatatggtacatgtttaaaagtgtgcactgtttgtcttggctttctcctaacatttgctccacaatagcctttattagattaagtgatagcttgttactagcctctattaaattatgtaacaactttgggagaagcacttaatatttagaaggcaatattttctcctagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgtaagtattttatttgttacactctgttttcgcaaggttatctacatatggtatacttaccgtaatgaaaagaaatatccagtgaagactagctgacttttcaggaaggacaatataaaaggggatgcatgttgaaggggccaaaggcttggtcctaagctttttgcgttgagaagatttagctaataaaattgctgtaagaaggttgagttcggatgagttgcctctagctcggaaaatacacaggggactgataccttagtccagttctagtgtattggttacagtggaaatcactgacatctactttttgttttgtggccattcctacttcttagtaagctcatgaagaaatcaaaggattggtagatcaaaacaaacaatagtaattgtagaattttttaagtcattttgattattttggtatttttaaggaactatttacatgatacaaataagtaaataaatggtcttttctaatctacataatcagcatgaggtgctaccctggtagcaccatggcagatgacactgacaatctgattggcctttccccaggctccaattgaactacttcccttttaaaaagcactgctgcttaagagaatcaaatcacagtatacttgcttactttacattatttctatccaagtccttctgctacattaatatcagcaaattcaagctcatgagagcataccagcttcagattaacagatttaggtttggctcctgcctttacccctaagcacagtgtgatgatgggaaaaatgctataataccattgaggttccatttttatttttctctgcaaggcaacactcacataattggtattcaaaaaatattgttgactttctggctcatttttcttttctcagttttaagagataatctcaccccctacttcatagactgaaaaggagccatcatgtaaaaattctcttgattttctttctactcttccccagaaatatacttgcaattcagcacttctatttattttcttactttttgtctccatagcagaaatatttctcccctcgctcaagctaagttctccagttgttccggttcacattccatttgtttcaattagaaacttcactacaacacttattttcttctttcctgaatcctcagattctgctctacctcattatctctgcatattctcttgtattcaatgcaattttgaattattatgaattcctatttgctaaatccaaaggacactttgaagtccttattctgtttgaactttgacactgcctcttctgcctttcatgaacttttctttcttcacttaatttcctgaactcttcatctcccttctgcctctctgacaaatttcatagaatattcttcacaaaatattcttctttcttatatttttctctaatcttttcctaggtattctcacccacttacacattttcaacagtatacctttgcaagagacttcaagttcacatctccgaaacttttcttgtgtttagatgtcaattcttcctatatcctggacttgtcccccagaaagctctcacagatgttaagctcaaagtgtcacaaatacatgtgttacttctctccaaaaccttccttttatttagcttatttagcaatacagtttcatttctaataactcaaggtagcattatttattatcaaatcccaatttccactgatcttcaggacagctaaccctgtggttcttaattagtaggtaagcacctggggagttttgggaataatgcaggacccagagatactgattcagcaggcctggaatatgacccaggaatccacaagttgaaccagtatcctaggtgattctgatgattgagcctttaatctacaccttgagaaacattgatccaaggagccgtcctgttgattctgcctctaaaatacaatttatatttactgtttcctttctgttttcactgtaactatgccctagtgttggccctcacctgttttgcctgaagtattgaaacagcctttttggacctctgagactgtcttctatatttctcctctccatgctccatcctttaaaaatgccagcaaggtcttccacttaaaccaaagataagatccatattacttctcttaccaagtcccaatggtagttacctgatacgatttggctgtgtcctcacccaaatctcaccttgaattgtaataatcttcacttgtcaagggtggggccaggtggagataattgaatcatggggggctgtctcccccatactgttcttgtggtagtgaataagtctcatgagatctgatggttgtataaaggggagttcccctgcacatgctgtctcttgcccactgccatgtaagatttccctttgctcttccttaatcttccaccatgattatgaggcctacccagttatgcagaactgtgagtcaattaaacctctttcctttataaattacctagtttcagatatgtctctattagcaccatgagaacagactaatatattacctattgagaaaattcatctcaaaatattattttttcagtccttctagattgtgggttcaagctcatatacttcagcatcatttgagttcctagaccttttaaaattccttgcacactcctggagctttgtcgtaatatggtgtttgctcaagctaaactggtccaatttaaatgccatatttgcctcagagtgctatagcccttacctacttctaactaccgtcctcatcagtcactctttcaaagtacccattttgatttggcttatatatcattatttatttatttgtctctttagcattttacagtgtgtggtacacactcaatttgtgatcctaaacaatgcctttcacctttctaagcctgattttttctgtaagcctgaaggattaatacatctttcaggactgatgtgctaaataaatgaaataaagtgtctagtttgaagagtgctgtgttgtctgagtaaatgttttccttctttccctctctccttctctcttttcaatttgtttccctttgcctttatctctgtgggcatttcttcttttctccttagtttcttgccttgcgtctttcttttctactctcttctccttcttctctttccttctccctcattttctttctccaccttcctgagttccatgcagcactgatcacaatgtttgacacatatctgttgctcactaaagacaggattttttttagtaaattgagtcacaatggttatgcagctgtcagaacgagccaatattattgaaaatactgagaagttatactatattcatactgtgcataaacaaacaagtctatccattatgatatgacctgtacctgtacagagaaaagcttccatgttggagcagctctaatcctgtagaattaccatgtttaagaataactaatattgtgcctaataattagtggatatttgtgtttctcttaatattaggaacaacaaaaccatatcctgctgatattgtagttcagttcaaggatgtatatgcattgatgggccaaaatgtgaccttagaatgttttgcacttggaaagtaagtatactgacacttttattaatatatatagaaatagtaccattttaggaaataaataattgtttagctataaacataaagtaattgtcttttaagtgtgtgaaactttaacccttgtatcttctatttaaagtcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaaggtagatacattattttaattttgtataaatttcatcagtatcttatttagagccatttccatacatgaaaaactactatataatgattaatggttttaaaaacagtgatgcatgttacatcatggagaaagataaaatatttctcatatgtctaatgaagtcacaactatgagttatagaagttacgaacttattaccagttgaaccataggtaatagcaatagattgatagaagtgttattggtaattttcagaatatacacttaatgtagtttgtttactcattttatcactgtcttttttcagtatctttttatttatagaagaagctatgtgttatgacttagtttaagtcagtggtttgcaaacttaagcatgcatcaaaatcacatggagggcttgttaaaacagattgctgggccaaactctcagaatttttcattcagaggtctgttaggggctcatgaatttgtatttttaacaaattcccaaaggatgctgataatattggtcctggagtcacactttgagaaccactggtttaagaaatctttttttttttttttgacaaaattatcatggcacaaacctttgattttcacacattaaaataaacttacatttgggaagacagattttttttcaggccacactggaaactttccagactgaaataatttctataatgttccacaacatgaactttgcaggtcacaagtgaataaacatcgagggcttccacaatattattcgtttttaactctggctactgtcccatttcactttctcccgtctctcccaaaaaggaataaaaaatttgacagattcacgcattctctctaaaagtgttgtctccatctccagtttttcttctctcttaattgcactccaacatgatttgcatctctgcctctccacagaaacctttcttttcatgaccacagacttccatattgctaaagctaatgatcaattctcagttgtacttttttttgatctaacagcagtggttgccacagttggtccctcccttcttcatgattcactttctgcacttcatgtctgcaacctactttgttattaatttccttgtataatctttcattctccattgcctttcaactccatacttttctaacattggtgtgatcagggttccatctgtgaaccccatctccatttcagtcactccatttatgatcccactcgtgatcatggctttagacacactctgtaccctgaatgctctaacccaaacatttactctgaacttcagactcgtatgtccaatgccacagtaacattaatgcaatacatatcaagtctgcatgaaatggcctcctaaaaggaagaaaatactaggtaaggtcctttaaacttttgaaataaatccaccactttctactaggtttctaaagcttatagacctgtttttattcaacatattaagaaaactacactccaggttctcaacagagtaaaattttgaactgtctaatatctaaagccttagaagaaccaaggtgacagagcacatatttacagaaggtaatttaagagaaatattatttattctttactaatgcagcatactaagtattatctttaggtctgatcacatcactagaaggttacataattaagccatatatagactgtgtcaagccaattcaattattcattacatgatgtaatagaaaatgtctgtgttgtctttgtgaggccaagacaggaagggtgctgatattcctgtattatgtattgctaagattgtatacaaaataaaacctttctcccttacaatgaacatatccaccaatagtttaaaaaatatctccctatgttacaaatataatgatgagtgaaaacatgtactaaataagattatatatgctttaagatatataggtgtacatatgtctacatgtataatgtatacattataatgtataatgttgatggtatttggtgagataaaaatgttttctagtttttaaatttctagtattttattacttgttaaatgttttttataagatgcatatattgcttttgccataaaattaacacaagttcccagtttcaaagaaaattaaatattattctccactcaggattctttcttcctacttcctttttgtattaatttatttatctgcatttatttggactagataactgaaataatcaaaaagactgtcaaattgtttatttgcttgttctctaaaaatattttttctttggaaaatttttagcattttctcatttttatggatgtctctttagctatcaagtagatcagactaaagaatgagactgagatcaattttaccaatgcatggatttcaccaatcatggctactgtatatagtttctaatatggaaagagtatatttaggtgtccaagtcatttttctagcgccaaagtgagatgttaccgtggccactagctgaaagttccatcaaaatgaagataatgtatacctgagggagtgggaaaaatatctgagtctttatccaaaatgttaagagatggtatcatattgaattgagatgtaattctttaaaacctcaattatcattttgacagacttgaaaggtttatgttatgagcagaaaaaaatcagttattttagtaataattataactcagcttttcaacaaaacatgatttacaaatggaaaaataatggctgagttatagttacctcctgctgtaataatacaggatttgcgtaggttaagcctatgcaaagacaaggcctattactgagttcaggatgcatacactatctgatgtattctgcagaattaggttaactaaatgtaatatttatactctggagattatgatggatcttgagcccttcatttaacatttacaatgttccttactttttagcattccctgagtgggtagaacacatcaatgacacagaggtggacataggcagtgatctctactggccttgtgtggccacaggaaagcccatccctacaatccgatggttgaaaaatggatatgcggtatgtatgttcaagtgctttgctgttcctgagtccctgttcaagcagtgtttcagggtagtcctgggataaatttagcaggagagacaatacagaaagggcacttgggccctgaaatataaaagcttcctaaaaaagacaaaaactgaacataaagtatcttctttcagtttaaacaactttctgtaatcttactctaccttctctctctctctctccttatttttttcctttgttccacttttccaccctcttcctactcatccatctccaatacctgatattgtcctctttttcttgccactattttcctgtaccccacagagacagaggtaagagtgaagctctaagtcctacctttggccctggggacaagtagcagcagtgggattcttctctaccttcccactgtaatctcccagctggtccaagaggggaaaaggtggactctcagctctgtaggatgaatagaacaagagcctttgggcatggtaagtgggttttcctttcccatgccatgaaaatcccactcagttcatcttaggtaacagtgggggcagatgaacataatgtatctaaatgaaaagacaaccaaacccagacctaagtgaaagtatttctattaaagttcattgagaatatgtttcaattttattcttttcagtatcataaaggggaattaagactgtatgatgtgacttttgaaaatgccggaatgtatcagtgcatagctgaaaacacatatggagccatttatgcaaatgctgagttgaagatcttgggtcagtatcatttctaatttctgttaaacattgttaaagcaatatgtcatatcacacaaaatgtttattgagcctacacaaaatacccagtattgtgttaggtgtacaacatatgttggttgtttactgatttatttattgctaattatcataattcagactaacgaaacaatggaatagaatgaatctttgccacaacaaaagtcttcttcagagcatcagcagcagtggccatacctaggagcacattagaagtgcagaatcccaggctcaccccagacctactgaatggacactttaaaaagatacccagatgattttaatacaaagataattttgagaatgaccagaccagaggatgaagagtcaaaacccagatgaagatatgcttaggcctagaaaagcctccagaaagtacatagttacggatgattgtaatgtgttgaaatatatggatgaaatctgcttggagtctgccaagggaagaggagagtgagcagtggattaaatgtgtggatgctgaggaaagtctgagcatgacatcaatgaagtaaccttttttaagcctctgtattctgttctaataattattgctctgtacttggaggtaatgatgaactacaaatgatcatgtctccttaattagttgattagatccattattcccatagctgtttatagatagatcctgaaagcaggactccaattattttggcattttgcagggtgtttgcatacagatgatgctcagtaattgtataaagaaggagagactgcattgtttaatgaaaagtacatgctttggaaacagaaggacctagattcaaatgtgactcccacttattactacctgtggtacctttgccaaattaaataatcctaatagatttcaattttctcatttataaactgggaatagttcattcaacatgtggtttagaggattgactaggaccatatgtcagtgtgtataatgctggtcaattttttccagcctttcactttactttccttgtggaattgagtcaaagcaacagaattcagagttaattttaaggtaaatgtgtataaaacatttgattgaaattgaagttatttatttattgagacagggtctcacggtgttgcccagcctggagtgcagtgaggcgatcacgcttcactgcagccttgaccttctaggttcaggtgatcctccacctcagcctcctggatagctgggactacaggcatgcaccaacatgcccagctaatttttttgtattttaggtagagatggagttttgccgtgttacccagtctgctctcaaactcctgggtaagccatctgcccacctcagcctctgaaactgctgggattataggtgtgagccacccatgcctggattctaattaaagtttctaataatcaattcagttatcatcaagaattgtacatttgaattgggtgaattttataagtcaaagttattaaataaaagttacaaagcattaggtatagaatgcctattggtgacagctgatcatatttaccgagattaatcctttccattaactattaaggagaataaaagattctacaacacagaagcaatgtttaggctttacaaacagaaagagaaagataacaatttgttttctttttagcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcaggtcagtgctgaaactagaaatccaattgcaaaatctgtttgaaaaagtttattttatagaagacttgtttatatgttaataatgaaaatgttttttgctctgaattttttttttcacagaagatcctgtagttctaagatggacagaaatacctatccctgtcagtatctattataatgaaggtttaattaacaggactctataatgtataaggaatttagaaaattgaagctcagaggtgtttttttgttgtcttgttgttataaattgcccaatgtcacacagctaataaacaatgggaaataaagtaggatctctctaacatatttttccccagtataggcatctggcatctatatccattcatattcaactgaattttgtgcagttagcctattaaatatttttgtagaaaaataaaaaggtgatttcaaagtgcaaataatctcttcctatctcaaaatgaacaagatgttatcatcatcttccttataaatggaccatctaccaatgttttggtggtttggggacaaaatgaaaaagcagtgtacaacttatatagattatttgtataaaagccacactgaatagtttatatgtatcctagaagaagtaatattgagtgcaaaaattatgacgaggagaaagccaggatgggaaatgggagggatgggatgtgtgggttggcttgagggtgtatgtgagggtgtatgtgagggtgtatgtgaatgtgagggcagcatgtacaaaggccctatggtgaggagtttagaatgtgtaagaaattgcagaaactgaaatcagtgtgatttgtctttagaggaaaatggaggagacttttaagagatgagacatagtaagccacatcataaatgacaaagttttctatgctaaggggcttgggcttcatctaagagtaatataaatctgtttaaagtcttaaacaagggaggacaaggatcacttttgtcatttgaaagactgttattactcagatgtagaaaatacattattttcttcacagtaacccaataaagtaacatgggaattatcatccatattttgatgtgtctaaagcttggtaaagttaaagtgaccttctgcaaaaatatattcatgctatctaaactagaacttgaagttgtaagacattgatataaattgagaatatgccagcacagccctcttattaggatgagcacaggcacggctgtttatggaatggggcaagagggcagggacatcaggggcttccctgaacacactgacttttaaagttaatatgtttgacctcagggttgttaagattttaacaaaatgatactacaagaagggttaaaggaaaagtccatttgttcaatttgccgctgaaacattaatggtcagacaatgagcaatgcagagaccatgatcaaagggcagctacatgtgtaggtgcttactccttccacagcctagagcagggcattccccaatggacaaaccattagttctcttccgtgataataaaatctttttctgattctgatgaagacccatgtcatggacctcttcaaccaaggatttcccagaactatgtttcatggacttgtttttcctaaatatcaatatgtgttcaaaaaaagaagagaaagatctagctcctgaaattttacaagtttgattgtgttctgatatttttaaagcctttgaaatcaaattgcattatttccttgattaaagagtctataaatctaatttttacttagtactttaacccattactatctcagtgtaaatactatttaatagtagatatagtattcatatgcaaatatatttgaattgtaaaataagatgtataaaaagctaaacataaaaattttggtgtctattttgaaaaagaatacacaaggactaactaaatattggtctttaagcataaatataatcttattcttctgaatataattataaacaacatttccacgtaactaagttatttctgtatctggttagtgcctaaagagtggtttatatgatatttggaagaagctatgtatcttgataaatagtaattaggttttcattttatgattttatttttggctcaaatgatatattttctgcagcagaatttctttgtaattagcagaattaagttagttgctaatttaaattcaatggattgctattagctctaaggtcacttttatttaaaccacttataggaagggatcttcattagtcttttctactccagaggttattctggagtaattttggtaccaataagtgaccaattggttaaagaccagattgttcctagtttgtttgacagctgatctatatcatagtatctggaaataaggataagatcttgagagtttagtctatattactttaagaataaagagaattattacaaaaaaatcaggttttctaaatatttttattaaaaagtaattttaatctcaaaggcaaagtacctgaaagtataaatgagacgaatgacacatggaattatgtataccctttaaagatggtaaaagatcaattgaaaactaacataagtaagctaaaaatattagcatgatttaagaaagaatcatcattgttttttccactgctacttcattataatttttgttgtgcttcttgaaaaataattaaatgaaagggatgtgggaacttggctgaggatttatactagagggtagtgagaaaaagtgtgacccattaatattggtactgtgttaatatgtgtcctccaagaagctgaagccaggaagattagctatgtaagaaattaattaatggcaatgcatgggagggaaaatagagaggaagctggtggaggcttggaaaagtattttactgagatacaggtctgatcccagatgaaggacagagggaaggaaggaaaaaagattgtgttgaaatgacttggactgcactgcacttctaagagtatggtcatgccactggaaagtcttccattcaaaaatgcatatcagaggagtttgctgtcttccaggagcaggcctggtttaaaattcctcccatggtcagtcattggctaagaacagcctgtggaatgtgtggctttgaataaacacagtgatggatttctgagtacggcgtctgggacagagaataaattacactcctcagagttggagagtggcatattctcagagcttccatgatcttaaataattacttttatcattatattattttgatacttcatttctccttcaacaacaaaaagtactctgaaatgagcttcaagtcaggactggattgttcaagaaaggaaaggaaatcctggactataatgttagcggaaattttgttattttcttatatgaagatttttatcagtaaggtagatagttttgcttcttttatcagactttgcccttaaaatggatatacgtttgcatgttttgtgcaaactttcaaagataatttagttttgaaaattatctatttaaagaaagtaaaaaatccaatgacaggcaattcaatatttaatctaagtgtgagtttctatacaataaaacttagtgagtttttagtgtccatcccctgaggaagaggctgacaggtagggaaatatgtgtagtatgaaagacttagtttctgttcaaagaagaatttcctaaatattaatttgttccagaagttgttactaaggaggttttaaaatattttttaaagtttctaaaaataaaatacatttatatttctctgtagccatggaaatggcaatctgtcctcacctcctagtctgaattgaagtcctgaggttacatttctgggagaccggggctcatttctttcaggcctatgactgatttcagcctgtcccatagtggaaggtcagttagaagactacggcaatagttcaagaaaaagatgaaagtggatttccaaaacaaaatgtcaatgatgagaaaaaatattataactaaaggctagaatttgtcatcttacaaaaatgtctgtggtcgcatgatttatatagaatgtaataattgaaaaatattagtgtttgtaatctaagacataataatgtattttactaaatcaggtttgtgaattatatatatttttatttcactagaatactcatttgggaagatggtagcttggaaatcaacaacattacaaggaatgatggaggtatctatacatgctttgcagaaaataacagagggaaagctaatagcactggaacccttgttatcacaggtaagttaatgtttgagggtgcttaatttctaatgtattaaaaaacatgattcagcactaagcatctaaacagtcaatgtatttgtaagtttctttttcaaaagaatttcaggcaagtttcttgcttgatgatattgttcttggaatttggaagtgaaaacatcttattattttgcacaaataaaaatatattggttattattttaatataccagataatattgtgtcttatatcttcttgaattgtgctttacatttaaaaatatatagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatggtatgtgttttaagtttcatcttattaacaccccagtgattcctatgtgtctgcattgaaagttctattactataatcacattttatatcatctttgtttttcatgagaccaaaaagcaggcaaaaaagctttctgtggttctccttatattaactgttgtactgctaaatctttctaaaatggctagccctgaggattttggtataaatattaatcaattaatattaattgggctttaggtatgatttcccccttaattttaatacaattgatgtgtattacatcagtatatatgtgcccttggttctagtgccttcctttttactttaaatgaagagcatagaacttaatctttgttataatgatgatcttaaagcatttatgttatgctttaagagtaagaaagagacaaaattatatatgttggagaatttggagaattagtttatgtgatttgaagagggttaaatggctatattttaagaattgaaaggtgttacattctacaagtcctatagttaaacatagtgatatagagagtcaaggtgtagaaagaaataaaatagagggaaaagactgagaagtaatgcaggcaaaacaacttgtgtaagaacattgttggtgtcttggtaggctgtctaggttacagtgtatttaaaaagtaaattaatcactggccctatcagcctcttctttagaaaagcaaacatttgtaagactaaggacatatttagaacataggcataattaggaaaacttttattttagaagtcagttattaatataaaaaagaagcacaaatgaactcagtaggacatttaggattgtttaagtcccataaaatctgaagattgatatgtacacattattatattatgctttcatattgtccagctatgtttttagctttagaagagttgtaatttaactgatctagctacaactgtacacctctagtaaacataccaatactctttcagtttctgaaccaaaattatactttaaagaataacaattgagaattggcagagaactgtaaattttgtattttgacattatataccatgtaatatattttccttatagatctgaaactattttgcacatgcccaaaattagtcaaattggcaccaaaatctccaatactttatttaaagtgtattttattttgcaagaaaagtaaatacaacttgggttttattcattttaaaggaaaaaagtaagctaaacagggatcttactttctcaaaaagtaggcttctgaatttgaaagaattatctttggtgttataaattgaataatttcaaaagtaaagtctagaagttccacaaccatagtttataaagtagtaactaatagctgcaatgaagtctatgtaaataaatttgcagacaaaaattgccctaaactgaaacttcatatttagagcttatttatattctttaaaatactaattacattgtgctggtacatgtaaataatgactgcaaaaagaaaatggaaaaaaaaaggaatttaaagagaaagaaaaatagatcccagtcccctttaaaaaaaaaaacaggaaaacaaagaaataactggaatactaattaggaaacaaataataaattagaccataaaaatgtaaaagaccttgtggccacttagtgcacactctcccttttcagatgatagctgcagagattcacatagttacccctccagctaatccagagcagagtcctgaccgcaggctcaccacctcaggtttcagttcattccatcaaataatgatctgacagtgggagcaaacctactcaactgactagataagcatcttaattgaatcagaatatcaaatgcacatgtttagcatgtcatagatggacagatgcattcaattatctcgatttttaaaaagcctggataagaatcattttaaaataaataattaaactgaattctatctttcaaaccaacacaagactaatgaagctatccctggcaccttccttctcttttaaggcaaactacaaagttaaacttcactggtcaatatgccatgcaaaatttaagtaaaaacgctataaatatttgatccaccttttggaagatagtcctaacagctattaattgcttctaggattgttaatagatcattctcagaattagtggctcctcctatgaaaatcttagtgaatatatatatgtctcttaaataatgatttggtattttatgtagttctcccaatatttcaacaattgaatagcatttgttcattaagaatatgtactaagcacatgccataagcagacacagttgtaggcactaggttaaataaaacactgaaatagacatggacaccagcccaaaataaaccaatgataccccaagagtttaagattcagatgtaaatgttttttggtagctattacagttaacaaaaccaacataattaacatgttctaacaattttcattgctaaaaactaatacaggaagttctgactaataataaaaaggaatagggaaatcaaattttaaactttttatttcaagaacctaagtttttattttccaatttagtttcaataataaattgaattcaataattaagtatgcactgattttagcttgctattcttgattttaaccactaaggggcaaccttgtataaggattcaaatttcacagcccggtgtaatttgggacttcttttccttcatgaaattaaacaaatgcatttgctcctacttatgaataaattgtgagattataggtgatttttaaatgtcttctttatattttttctaattaaagttatgtaattattaggaaaaatgtaactgtacatttttaaagatgtatatttcttttaagagtttaatgggaacaccaaaaaagcaaaaataacactgtctttgtatttagtaatcctactttatgtaaaactttgggattaatttattttttaatgtaactttcaattttaaggcagtaattgcacacctagtactgattatagaaaaacactaaggagttaaacatctaaaaatttcctgagtattatattaatatgtaataattgtcagatgttccactggaacttgaactcatgcatgggggatgttaaaaatacaagctcgaagcagaaatttaataaatctgaggctttgatacaataagatattaaagcagtttatctgccattcttttattttgttgatgttatatggcaaatgatcataaatgtttcaagtccaattataaagtggctcctgttttggctttctaattcaatagctacttaatgccttggagtaaatacaaaaggcagagccattttatttattcatttaatgtataacttttcttgttccagaaaagacttaagacaatctatcaaaaatatgaattttaaatatctcattttattcctctttcaaggtggcacctaacctgtagaatttttcagtagccctcaatttttgacattcactttgggtcattttctttcaactgtttaacaacattccctgcttagagccattaagttagttaattacatgagttccttaaaatttccagttttggagattgtcactatttcatatatatatatatatatacacacacacacacacacacacacacacacacacacacacacacacatatgtattactcttattacaaatacatgttaaatttgtaatactgtgggacattattgcctgtcttatatgaattcataaatatcacttgaattgttcagagattgtgtcacaaaccaacctgggctttaggcttcattttctcacctcttatgtggtgactctgatccagggattaaaattctctaagcctcagaatttccctctgtaaaacgtgattaatcattcacttacttcattcaggttacttcactgggtttgaaaaactagttacttcatgaaagagtgcatatagagacttggcacagcatctgagagtattggggacacgaataaagtatataagtggttattaatactttttataagagagcaatcatcccccattggaaattccagaagcttttgctagctagtttttctttctttctttttttttttttttttttttttgagccacagatctcatttttcacaatttaatacttgcactgcttgctgtgctggatacttagactgagaccaaaaaaaaaaaaaaatctgggtatttcattgctgaaggcagtgaagaggtaataatagccaacatttattgtgggcttactgtttagacagaattgggttaaatgtttttcacatatttctcagttgatcttcacagaaatcctctgtggagtgcatattattgtgattttctcagttttcaaagtgaggaaagtgagtattagaaaagttgagtaactggtcccatgtaatcatacaagtcgctagaggctaacagaagatttgataccaggtggcctgactgccaaccctgtaatctccaccactttgattcatcttttggttaatgttcatgtctgtgtctatttaaataattctcccataagtatttgatgctctacaaggcaatactgttcaattcacattttattctctaatctggtttaatgaaccttgtatgctcactcagattgcccaaattacttcattctccctacactgttggccacctttgcaatacactgtaagtcatgtctacacagtttcaagtggtctaactatgaagttcctggcaattcctaatgatcccctgtagacaggtatgctaggtgtgtgtttgcaggtatgtgggtgtgcattttttctgagtgcataagcaataccattcaagagagaagaagacagatttctcacccaaacgttattttccttttttaaagaaaaattttattaaacatatcaaaaaaggtctttagattttacaaatatgtatttaaaactagatcatgctgtgatcttgtacagaaattttgtttctgcaagacaagaaaaaggagaggaaaaatgataaaacagaagtcaatttgtttttttttttgtttttttacaatttaatcttttatttttatttacattttatgtagaatgcttataactagaaagaaaggtttctttttttatatactttaagttttagggtacatgtgcacattgtgcaggtcacatatgtatacatgtgccatgctggtgcgctgcacccactaactcgtcatctagcattaggtatatctcccgatgctatccctaccccccctccccccaccccacaacagtccccagagtgtgatattccccttcctgtgtccatgtgatctcattgttcaatatttcattgtctctattcactattttggttgttgttgctgtttttgtgggttttcttcttttcttttctttcttttttttttttttttttttttttttgagacgtaggttagctcttgttgcccaggctggagtgcaatgacgcaatctcggctcactgcaacctctcccaggttcaagtaattctctggcctcagcctcccaagtagctgggattgcaggtgcctgccaccacacctgaccatttttttgtatttttagtagagatggggtttcaccatcttggccaggctggtctcgaactcctgacctcaggtgatccacccgcctcggcctcccaaagcactggggttacaggcatgagccaccgcacccggcctctattcactgttgaacaagaaggttaagattatccagaattatgtgggagaaaacgaggacggttgggcaataatccttggtaagaatcagattcgagccgaaaaaaattagagcaggataccaggcagccacagggagatcgtggaagccctgaagtattgtaactttggtcccatgtggagacatttttggttatcacaactgtagaggtgttgagagggtgtgtgtgtgtgtgtgtgtgtgtgtgtgtgtgtgtgtgtgtgtgtattgcatctatttagctattaaatatcctataatgcacaagacagattccaaaaacctagtattatctggcccaaattatcgatagaaccaagcttgagaaacgtcctcaagaaagatattaaaaaagagacttagcaatactgggactagccactgcaaggttttaagcatgatgtattggaaacaaagagatgttatattgttttgagcatctgagagtattggggacacgaataaaaagaaactagatttttcaaaatgcatatccaaaatagtttaagtagtagaggatgggttttatgtgcttcttgaatttaagactcttaaattttgatgagcagtggaaaagagggagaaatacataaaaagtatacaggctcctggcacagtcttgtgacacacaaaacatacaaaagcattcggccaatgtcaaattgctctatttttcttatcagtagttagttggaaaagagttaattagataattctatcatacttcattctgtatgaatatataacttttctgatcccctttttactaccttaataaacctttactgatacctaactgctatattttatttgctatttaccagtgttaaacgaaggaaggtatctatgttcctgggtgtgttttcagttgggctagcttcttttaagatcatcacacttcccatgtatagaccatgttagctgatgtcactctctagcctaacttctcatagtccttactaagcatttgttgataagaatgccaggtgaatggaattaagcatatatatatataagaatgccaggtgaatggaattaagcatatatatataatataatatataaaatgtccattctgatcacttttttctacaaagtggtccaagaagatttttagaactctaaagctaaggggaaccaacttgaaaaccatataaattaaatgatatatgagttgtatttcaactctaaaacataggttccaaatcaaaggcattgatgtttttgtccatcattcaaaatgcttaggagaaacctcaaagaaaatggtcttttgagttttcatttaaaatggccagctgatcaaaattggactcttcagctgtcattctcgttgtttattacatacaaaaatagccaaatttagagattttcaacacgtctactcttaatttatatgcaaacacactcttagtaattatcttagtaatcttagaaattatcctggacaacttgccttatttatttttttgtatgtccaatgacatcacttcactttaataagttgttttgtcattttatttatgtttttgactcaatcttaatattgatgcatttcttaaaataaccctaacaaaaactagataacattagagaattactgttaattatgttatgtgtgaaaatggttttgcatacaaaaattggcctagggtggtggtgcacacctgtaatcccagctactcgagaggctgaggcatgagaatcatttgaacccaggaggtggaggttgcagtgagcccagactgtgccactgcactccagcctgggtgaaagagtgagactttgtctcaaaatttaaaaaaaaaaaaaaaaaaaaaaaaaaagaagaaaaggaaaatggttttgtgattatgtaagaaaatgacctcaattttttgagattcaagctaatgtctttagaaattgctgatgagttgatgagttgagtagtattgatatcataatatccggaatttatttttcaagtgttcagtcctagacagaaagacagagatagtggacagagagaagtaaatatagagctagttagctagacaattagataaggcaaatatggcaaaaagtttacaattgttaatctagttggctggtttatagatggtgatagtactattctttctacttatgcttgaaaatttaaatagcaaaaaaataagtaaaataacaacatatcatatatgaagaagcaccacatctacttaccaaacactaaatccagttatctgatctattaagcactaccttggaaacagcttgacttggtgaaactagggctatatattacctatggagccttccacaagtagcttaatgtaaaatctcaaggtccttatttctaaaatgggaatattaatagtaaatctttgggtagtgttacttctggaactcagaagtgaaaaggagatagtcctagtttcattattagggctatgaaattataaatataattacataaattgaataagaaaatgtatgtaaagtagctagcacattgctagacatttaaaaaacattcagtaaattagatttggtaatagtaggagttcaatagtagtatcagtagtggcagtaacaatagaagttatattagccattttaatagtaataggagcagttttagtagtattaatagcgacactagtaatattagtggctatagttatagtagttttgtgtcttcctctgtaaaatacagctaaaaatagtacgtatctcataggcttgttattaagagtaagtcagttcgcatgtatatttataacaacctttgacacctagttaaccctaattaaatatctgctgttagtagagttggtggtggtagtaatgtttgcagttggatatgacatatttgctatagtatttttgctttctctactctaacaagccaaaagtaaagaagaaacgttttattatttcatggatatagcatatatcagacatatttaataatttttatgtttgtgaaacatattctttaaaggatgcacttctttccaaacatctatatctctccctttactctgaacttgaatggaacaaattatttaaatgacaattatgagctctaagttttatctagaccttttctgtaccatatagaatctttctttgttcactaagattaattcaatttgttaatacagcgtcatcactgagactcatttacattgcagaaatgattttgcagttagtttacgggggaaggtgaaggaagggctgggtatttatatgttggaagtcttttgatttaaacttgggaaacttctaagtggtcaaccacatatacactttggaacatccctgagctttgctatcacaatttccagtatgtgattcaactctcctcatctgaagggaggaattttgtaattgagccaagctgtggcttttagtaaaaatacagtgagcatttgtatctaatttgtggctagaatgtgctgaggcccatgatctttacttgctttgtaagcgttctgccaaccactgaggacctcaacttctcttgaggtatggaaagtgctagtagtatttacaaaaactttaggagtgctttcatacatacacaactatattgggaatgatactttatattttttcttctttccttctgagaagttttattgctacatgttcaccaaatgtagaaccagtgagaataaacattacagttgcttcttactgctttatgcaagtgggcttatcgataaaagagttaattttcaaactagtttaacattaaacttttagagtagtttaaaaatcgtaaaagagttcatggtgaaaaattaataaatataaatttaatataatgtattctaggatataaaacagtttgtgctttttattacatgtgacagtataagaagaatgaccacattattcctatcagaataaaataagtgaatgtataaacagcaccatgtttcaaagagagtttagggaaaaaagatagcaatttcattaagaaagaaagaagattagatacatcacataaatatttttaaaagggcaattatgataccacaatatgtttatttttatattactttctgccctcaattttttgttgtaaagttcaatgaagaaacattttaaattgctaaggtgatttttttgaaaattcaaatctaatgacatggctcattgaaatagtgggagtttagtaacagggttatctttcaattagacaccgaagcaaccaaagtactgagttcatttaatgaataaataccaaaaaagtgctttttacttgtatgcagacattattctttccaaatataactatcattttgtgtcgtaatagtttgaaagattttacttaatacatttatattattgaatatttagtatcaagtgcatttgtattaaggatgtcaagaaacatcaaaacagtctatttaacaaatatgtaatgtttattttattttacaataattattttatattttatttttcctcactaaaaattacttagacatatatgtcaattaacttttatgatagaccaagaaaaactcatatttaccttctctatatatgaatcttattctctgcttacctcaaaaaaaattttaatataagtaataaaataacatcttttacctcctttgttagatgaattctatttagtataagaagttaggccagctgcaaagttgggcacagtcccccaaaccaccctcacttctgacaccaactgcaagttcaaggggttgcaaaaatcaccctcagtttccatgcttcgctagaaggtattcacagaattctcttaaagctgttatatacatgggtacagcttcttacaggagaaggatacaaattaaaattagccaaaggaaaaagcacacagggcagagtcaagaagtacaaaacacagagcttctattatcttctccccgtgcagttaaaatgcattactctgactgctctgatgtgtgacagtatgcttgaagtactgccaaccagcaaagcttaccaagcctttctgtccagagtttttggggggacttcatcaactagacatgattgatggactcattgctcacatggttaatctcagtctctaggttgactgataccacatgaatcgaagaccctactctaagtcaaaatgtcctatttgtggcatgaccaggcccttctctaagactctacaggtgtagttaactcttgcccgaaatcacatggttggattttccagtatgacccaactcctactctatgaccagccccagcttgaagactatagaggtgtggctaacccctactctaaatcatatgattggactatcctgtatgacccaagacttcccaagcaaagaaagatattatagagattaccttctagaagctgagggcaatggcaagacctctctttgggcaaggctaaactctttactacacataggggtgggaaaagttagaagttcagttttcttgtatgttagtgatattgttttctctataaattttcacaccttcccaataacctttctattttcttatgaaaatagtgtatagatatttgaaatatatcattcctggtagtttatctcatagatatggatagcaatagtttttctcaagtcagttattttatctcataacattatcattatcttacctgaaaaaaccatttgaaattactgaaagaatgtctatttaataaaaacactttagattattttaatgtatctattcaatatttgttgaattctcttgtatgtcagatattacattaagtactttgtatgtaataataaataagacctggttctttccttaaggaattacagtctagtggaagaaatcaacagtgacacgattacggtagaaaggaatagttacaatgaaactgtacagagggcaataactaatccagccttacaatttcagatatgggaggggtatccaaaatgtgggttgaacattcatagccaagtaatggaagtgggaggtggggcaatccaggcaatgcaagtgatatatgcaaagttttgacgtgagaacacatagcaaagtataccctattcactgtggctggggcacaggagttaggtgcaggggtaatctgtggaggctgaaggtgtgtgtacttcactctcacacaagaaaagcctcattatttgtttagtaaatgctgtcactgtcatgggttatatgtacttgctaacataattctgaatgtagctgaaaagaagtgaatacatattatcttaagagcagataccaaaattcttgacaatttgacaagttcattcaaacaaggcatatttagcgtgattatttgcttggcactgtgctggacttgagaagacagcgcatacagctgtatacatatataacacagggatacaacatgtctgctaaataaaacagacgtatttcctcacatcaaacttatagtcggccagggagaacaacttcaaccacataatcacaaaagtgtttaactgcatttacgatatgtaatatgacagaagtttcatggtagcataataaaatatagaaagggtacctgcctagtccacagaaaatggaaagacttgctggagaaaatgatttcaactggtattgggtagaggtgaaggtgataggggagggggtattgaggttatgaggggtatgaatcacaattccagaagacaagacaatgtgatgaaccagagactgaagagaacaagatacatttgtggtcctaaaaagagaatgttctgcctggagagcagagtgtgagtgagatggcacactaggtgagctggagcatcagagagagcctagagaatggaatcaagttggctacaataatgctatggcttttgtcccaggaaagggaaattttaaaggtttcagtttatctgcttttatggagacaagtgagttgggcccagctgcatttttaaaaggttattctaggtaaccaatagaggaaagaatagagtggaacagtggtggaagtagtgatcaaataagatgtaggggttcaggtgagagatgtgggtagtttggacaagaggcagtagtgatggaaagaatggataaattcaagaatttatgatgagtttatgagaaagttgaagaaagggaggggttaagaatgtcctagaagttcctggaaagtcagatgactagaaaaaaatgagtatttgaggaaggaaagccaaatgctatcaagaagtcaaataagatgagctgaagcagtgggactcagatgagaattgattgaagagtaagaaatgaagaaatggaaaaactaaaaacagaatagatattgtcagaatccaagtaaaaatcaaacaatcaaacagcttaatatgagaaaataagaattatttatttccaagagaaagaagagaaaagaagagagaagtaagagattggtagtaggagtggctgccaacaagatggcagagcactgggagaggtgaaggttactgggaaattcccagtaaatttacggccaacaggacttttaaaaacagaattatgcagtggatgatacttttcaaggttgatttaccctaccttttttttttttttgatataaccagttccagctccttcagttgttcagtaaactaactttactaggtaagacttcatgctatttggttttctgataaaatagagaaagtgctgaatttctagtctggagctccctggtatgacaaaaataaataaataaataaataaataaataaataacagaccaagaggacagaaggaaaaaaactcccctattgcaggaatttgtagaaatcttgggaactgtttcaatttttgaccaatctatacctcaagggactggaagatctcaatcgacattaaattaagactggctaatatcaaggattaaggtgtgtggccactgatcagttctttatatggagatattaatattctgttccaactaactataccaatatgctctctcagctattattcttaacctcattaatccagcaagggttgcaaacccaaatgttttccaagaactggagggaacatgatatatgaagaggttattggtagaacctatggtgaagcaaaacgttcactccatgtacagtcatgatacatcataggtatctagatatttatcactgaaatagtaaatcaatatttttggttcataggaaaaccaaatgtccatttaaaaattgagttttccaagttttcattctaagaaaatatcttggagataattaacatgaactttgacatgctcctgctaccatacaagctgagtgaccttagttatcttagttaaattacttggattccttaagtctaacttttactgttaatcaaatggatataataagacctatctcatagggcagttgtcaaaaaagaattgaataaaagtgtgtgtatgtgtgtgtgtgcctgtatgtgtgtatgtatgtgtatatgtgtgtgtgtatatatgtgtgtgtgtgtgtgtgtgtgtgtgtgtatgtatgtatgtatgtatatacttgcacagaccaggacccggtatagagtaggcattgaataactattagctatttttggaaattacattgaaatggtgtctcatcatcacaagcaaaatttcctcaagactcaaaaatatgtgttgaacactcttggaggcaatagaatagagcattgaacaaaacaaatactcttgtcctcgcagaacttataatttggcaacagagtacatgttagtggaattgtacattttctcaatttctgcaaacttttagtatctttgtaaaatgaactgtggcacatattaaaactagtcaattagatcagctttgtgaaaccaaatcaatcattcttccaaaccatatagtatttgtttgtactcattgatacttaaaacttattgatacttattagaccttaatatttctctttaagagatatcaatgaaatagtttcatcccttgagtttctctcgatataaccctctgattgtggaaataatagaatgttaaagatatgaaagctaaaaaataccttatcaataaattattcactttatttttcagttgagaaactgaagcctagagcaaggacatagagttagcatgtctaaaacacattctttaagtggtgttcattttgttaggggaaaaaactacctcttggatcttaaatgccacataattggtgaaaaatgtactgatttgaataattgctgtttttgctaacagctggattccaatggggaattactaatccgaaatgcgcagctgaaacatgctggaagatacacatgcactgcccagacaattgtggacaattcttcagcttcagctgaccttgtagtgagaggtaagagtttcaacattttaaaattacaaaaccaaaagtatttgacttgcataaacatgtataatcttctggtaactctggtgcaaattcttacatatttagagtctcaatcccatgcttaagaatggatcttaagcttcttcccatgcctaagaatgatctatgccagacaagtagtaaacaacactgattttgtttgttttactaactacgtatcttctagaaagttacaccacatatctcctactaaatgtttgtgctttgtagacttaccaaaagttctcgtttcctgctaatactttttagtgtgttgtgtatagtgctgtttccttttttatttctatggaaaagatatatactgatgctgtttactataacctcaactgttatatatttatcacttttgtcttagagtgtaaagttaatttatacatgtatcatgtttttatttgttgctggttttttcaaattagtgttttcgttcttatgaataatataattgagattgtgatggaatatacatttattaaaaatgcaacccctttgctactggccgctgccatagcagtgaggctggctgggaacacagcacaccttgtttaaaataaagagctggctcttcactgactgccctttagttttgcacccaagaagtaccatgtgttgaccccagcttgcttacctttaatatctcacttcatgtaaccaactccaaccatctaactaatccacaaaaatacactttaacttccatgtcagttgctttattcacagtattccttccatgtctttttctcatgatttgttgaccaaatcttattcatccttcaagtcttaaagtatatactaagttcatgaatccttctcttgatgtccccaatatgagctccgatcttctgaattttcataacatatattgctttctctcatatgttttatagcagttggtacacagttatctactctcctaagttgtaaaattcatatatgttttttttttagtgaatggcagagttcctttgcattgtttcgtagctctctctttctgtctcagtgtcagttaaaattactattttttcacatttcacctactaaaaatatttattgaacattaattgtacattttgcctttacttttcacactatcagataaattggcaataaaatgatatttgtggcttgtttattttaattctccttccacatctgggtcaatataattttactcaatctcatgcagctcctgcatttccctctagagcaatgttaatatggggtccctaagcaacactgggcaaatgctgaaaactcttctactccatttgaatatattctccaatagagttttaagaagtctagttgaagtttcttcatctgaatgaacttggaaatacattccacaaaccacttattgaataataacaaataaaaatgagactacaaaatcctaagtcaaacaaaattcatttaggttcagtattttcatttattttgttatctgggacattgattgttttcaagaattattagggagagggattagagggattagttcaccattcttcctagtcagaccactagctgttaagtcatttccagaagtagccaaagtgtatatttaattgaaattgcttgcatatgaaaataattagcattaatattgcaataggagttatgttacagtgtgtggacataaatgtcttcatatgattacattgtagtaaactcatagtactattaccatagaatactctgtaatattcagagtgaagaggaattttacagatgaaatgcaagggtagtcatgatactagccacacatacttaggtaattaattatcaccactatatgtatttttatagagaatcaataaaaagaagctatagccaatattatgtagaaataaaaacgtatacagcattttaagtccttgcactatagtaggatgctaataaaaccatacaggtacatgaaaatactgcttacctctgttaaagtcagcagagtcataaccattcttcaaactttatttctaataatagaaaaagtatccatttcatatcaaaagaaatttgcaattaaaatagtcaaatatatttgactattgcagaacttgtgtcaaaaacatgtatagatgttctaatatgctttatatatttaaaccagaaggtagacaattaaacagttgtttttattttttaataataatggtgagcaatgtataagacatgccctgccttaagtgatattattattggtctatttattcatttaattatacttttgtatctagttcaggaaatcataacctggagtctatgaacaggctttaagggatccatggaccaccagaaattgtacataaaattctacgtgtatgtacattttcctgggaaaatgatttgtaattttcataagattttcgtagccagcaatgtcccacaaggcattaaaaagctaatctattttttatttccccatctagatcaagactctctaataaaataaattgaagagatgattattcactttatgcaaaagaataaaatactaatacatttcatgtagttaaatctaatagcacatttagattgtgaattgcttttaaaagattcgatttgcactcaacccttcaaaattacatgtttgtaaaaaatattaaatatgttatgtagtagacagtagaaatctataagaactttccatatttgagatggactaattttaatccatattcagatattggtaatctgaactgcagctgctgaaattagtggtgcaatgagaaggacagtaaacacagtagaggggaaagcaatttcatctgaggatcgctaaaaaattttttataacaaaattatttctgtgtataaatgattatgccttatcagagaagactgaaacaaaagtataaatatttagacataattaagattgtggatttcttttagcctacatcacactgaaggaaatgaatacatagtaagaacagtgttgctgccctaatcaacatgtgtgtgtgcgtgtgtgtgcatgtgtgcacgcatttgtaattgtgggtggaaaagggtgagtatatgcatacagcatgatgaaagcaatttctatcagaaaagaagtgtgttttaatttattccttgcctttttattgtatattgagcttagaatgtaagcagtcaagtagttaaatctgaatgcctctaaatataaaactaaaattaaatgtaggaaaaatatagtcaatggaaaatgtagcattggatctgatttcatggggccttttactgagagaaaacactcccgctgtgagttttttgtgtcatgtatggtaggatttagaaatgaagaaagcagtggcaattgtcgccaaagaaaaacaatctgtagaaaatgtccccgataataagatatgaactattgtaattctgtaaaagcataaatgtgtacttatagaaagctatagcactttaatttatttaccatataactgggtccaaagatgcttgaggaaaagaggccagtaaagttgcatgcattgtctaatcctccagctctgcaaacaacttcaaatcatgagattgtattgaccatgtaattttcacttttcttttccaaagttggcttttatatgagttatatctgttaactttggcaacatttctgttagtctttctatagtatagagattatttttgcaagagtaacatttcttcaaatgctgttgtccaggaggtctaacatataaaatcgaagatgaagataaataaataaacatttgtgtcgtcacaaccctggcaaaagcagattatctactctgaaataggacaccttcaaccagccccctaaggattctaacaaatttagataaataaaatatgaatctatataaaaaatgaaaattgatggccaggtgtggtggctcacaactgtaatcccagcactttgggaggccaaggagtgcgtattgctttgagaccagcctgagcaacatggcaaaaaacccgtctctaccaaaaatacaaaaataagctaggcatggtggcaagagattaaaatgctatgcttgatatgatgacatttaaataacttatagaagattttagtgaaagtttatttttttcctatgaagaacacatattgacctcaattttccaattttccaaataatattgttggtgaaaggagtaatttcagaatcacccctttaagacaggggtttgtataatatacctgaaggaatttagaacttaaatcactatagattacttaatatttaagaggccttaaatatgttgcgttatgtttaaaatgtttaaaatatttatattttaaaatgttaatattaatatttaaaatgttaatatttaaaggtcttaaatatgttgccttatattgccttagctttaaaataagaaccaggtattacacttcagatgtttttaggcttctggtataaaagtctacattaagagtattgatacaaatttcctctgttgttgcaataaaatttttatttcttaggtcccataaaagtatatttcgggttgcctcgtcaaagtaagtgtctgatgcttgtgaacagccctgtatgaatattttttagcaaacaacatttctaaagctcttcagctaaaagagtgtcatttagaggcaagagttttgcaggatttatacagcaagatttattttggaaacctatgtgcagcttgccaaatctaaattctcattcatgagtgcacctttggacaacattcaaaaatagaccataaaattaggccccaaatgaaaaagaaattaggctttaacttgtacatgtattaccactttctctggtatttctgatgtattataaatattttggcaatgcttctggctaaggaacactttcctgccacctgggtgaacaaaacatgtttgccactgaaattgccaaaatagaaaatgcaattaagattatatcttatatactatatatttgtttacatcttatgtgttacattaaatgacgtttgttcactcaaatctgagtttaaaaacaaacaaaagaaaaagaaaacgactttgctatctaaactttttcttttggcctggttctcaactctaacatatgctgtatagaattttaaaatgttttggaaaaagagtagctgaaactaaagcaaatgatatgaaaactctgtaaatcattttctcctcaaaagaagtttgtgttgtttacattattacattagaagcttatttatttaaccttacgtggacttgtatttaggtgaaaacaccgtgtaagtgagtgtgtgtgtgtgtgtgtgtgtgtgtgtgtgtgtgcatgcagctttccactttatttctaaggaaaaaatacagttacagaatggagagagatattagttagaggtcatctttattgatataccctgttaaggtttttattgcttagcctaatgacgtggttaccagattttttcttaagaaggctatttagttgattactaaaccacttttaaactcttggataagttaaagtaacacggtcgaacaaataaataagccaataagcctgatggaagctgtcagtatacgttttagctggaataatattgcagtattttaaagtactataatagttgcctaaaggtcttttctatggaaaatgctcttgggtattttactcccagctggtttacattagcagagttaatatccagagtatcccactcttcactgtccagacaaaattagttctgaagcatttacttggagatgatggtccaggaaaattagtattctttttttgtaagaaatatggaatagataaacattttctttctctaagataaaagtgttctaatggtcctattattggcaaatcatgtgttagttacgtcttttctccttcccactttttcacagtaactatatgaaatctctgcatttatgttcaaatttgaaaatacaattttaaatgtagaactaatcctatgggttatctagaaagttcctaccccttcatttaacaacttggactctgagagaaagagttcctcccctgtattttccatctacatggtggcaaacaataatcttgggaccccagtccagtcttctcattgtactagactttctccagaaagtatggataaataaaatctatagttaatttctaaaactcactataccagaaagattatcaagtctattctggagctggtaggacaaattcttttactaatttttactaaatagtaaaagttattgatttcagtttctgctcttttctctttctgttcctactatctggcatatgctaatacaaaatatataatttttaaaacattgtaggaaaaataaagccaaagacatgcattataaacagatgtaatcattaattcttggattatttagggttctatttgcatgactagctcagggaccttggatattagtgagggccacaggaccgcatgttgccatgtgaaaagtttgtgtaactcttggtgctaaatcagattttaagcttctgtggtatctggcataaatgttcacattgtgttcaagaatccttacattcaacatattcttaaataagcaaatatggctttatgtttgaaattattattaaggtatggcaggccaaaataaattaaaaaggacttttaaattaagcaatttaagtattatgtagttgagaagaatagacataaaagttctatataatatacacaccaagttaaacaggcgtgtaagtatacacacctcatcacaccacacacacacacacacacacacacacacacacacacacacgcacgcattggaagagatccaggaaagagacgatcatataaaggcagaaagatctgggtccaaatcatcacagtcaaatcaaagagaatggttgaggtagtttttcaagtatttggggcagaaaaacacacatttacctcagatatttggataattgcctccactttccacttgctctggccaacgaagtcttgccacagagacagactagagattccatctcatcagccttgcagaactgagacaggaaaatggtccttgctgcccacactggctggaacaatgacaactgggcgccattctgagccatcctgaccccactctgcactaaccacagcaatgcatccattgatagcaaaacctgcctagaaattaagccttccccttcccactgagaatcaacaaattcagatcaaagaaatacgactgggctggttctccataattgtaatacacaaaagctaaaatattgagctgaaatgcatatttggttataacaaatgcagaatttagaaaatttaaagtcagaacttagtggttatttaaacaaaaactctagtaaaaatgacagctttcccaattacttctggaattttaaagtacatcaataatttgaaattgtatttttcaatgcaagttcagcgtaaattgaggtacactcaagaattttttcaaatatggccacaaaataggtaattcactcagaatgattcacattattttaaattttaagataggtcttgaaaattatctagatgaacacttcatcttacaaattcaaaacttaaaatataaggataagaagatactatgttatgcgctaatataaatttagatttttctttccctccacactagagtacagtgagaaaagctcccgtggaggatttcttcttttctgcaattaattactcccgggtctcttataatcaaactggtcagcttttggcaaactggaatttctttttttgctgcacatttagtgtgtacccatggctcccttaaaaaataatcggccaggggaggcagaggcaggagaattgcttgaacccagggggcggaggttgcagtgagctaagatcatgccactgtactccagcctgggcagtagagcgagactccatctcatctcaaataataataattataataataataatcagcctggtgcagtggctcatggctgtaatcccagcactttgggaggccaaggcgggtggatcaggaggtcaggagttcgagaccaacctgaccaatatggtgaaaccccatctctactaaaaataaaaaaattattgggtgtggtggcacatgcctgtagtcccccctgcttgggaggctgagacaggagaatcacttgaacccaggaggtggaggttgcagtaagccgagatcgtgccactgcactctagcctgggcgacagagtgagactgtctcaaaaaaacaaaacaaaacaaacaaacaaacaaaaaataacccttctaccactcagtttgattccagggagacagtaggaaagctttacagaacttagcaggccttgggagcttttagacactgcatgcatttcagtgctccatagtgattcatacatccatgcgtatttaccagataattatgccaaattaggctacaattatgccaataatgtcaaagttcaagagcaatacagataatcagagatacctacaagtctcgaagaatatgaataaatggcaattagttcatattttgaaagtaattgtgatgtatgttggtaaaatactacatttttccaactcaaatctttaggctgtgaaaaggtatttatataaaatgatgaatataaaatgaaaataaagatatataattatataatttaatatataatgacagaatgtaactacatagcatgttataataaaatatatattatatgtcatataacatgtattgattatatcataaaatgatatataacatttattaaagacattgtttaccagatttaattttaaaggacaggtatcgttactgtattatattcattttacacatgagaaaattgaatctaatgaggctaagttaatcactaaaggtcacaaagctactaagtggaagaacaaggtttgaatgcagacagtctaatttcaggtagaacacccagctcatggctgtagcacactataactaaaacttaattcaaatatattcaatgtgataaaataatcagtgtggaaaagctaagctgctggccttttactttcttggcaataaatgtttattctatagagtgtcactgatactgatcttgctattttatttttgctcatgttatatttatggctggcctattacaagggaaactatagtagttatttttttttcagctactcaactttacacagttataattacaatagcaaaaccaataaatgaattgtactagatggcttgaaagcttgattttataatgtgctctttggcctaaaaataggtaaatgaaattttgatgtgtgttttcctgctttttaaaataatgtataattcatacagttaaaaatagttcattcagaatatttaaatatcttagattataatgtctacacttataggattttcctataaattttaccacgtcatcctacaaaattgctgtgaggtggtagtacaaggactgttattcccatttcataggcaaaggaagtttaaaaaagaaaaaaaatatattttcaactatcagttataaagccagaatgtggccagatactagtgttccaaattcaactacatgaatatgcttttcccttcttgatgtttaatgttcccaaagacagaagtcagaccatataattttgtattgtgcatctctatcattgttggtacatggtttgtcaaattaattaggtaattccctcaaaacactctgagttattgataattccaagttaagttagagagtagagtaacattttagctcgtttaaaattagaatttcattaatagtttcccttttcagctcattttactaaataagacaaaaacaccttagcctcattgctgaaaatataaccaagaaaaaacttaacgacgtaaaatccctttcgagcagttttattacctatgatttttgtgcagtctgccatttccagtctcgtgactatgcagtgctttcttgagggagccttttgtgggcttgctttccacccagtttctggaaatttaatttggtcacaaaagtttgggcatattagaatgaaggaaactcagaaaaagcttttaccctctaaactcatcatcggtttatgaagctacagagagattttagtgcttttgaattcctacaatagcttctccaactctaattgtcactactgggattaaatgaaacatacacagagagagaaagaaatgtttaagtattctgcaactgacgcttagctaggataccccattagatcagagcagcaaggcacagttctaaatcttttctctgccagagtgcttttccatcatcatgtttaactgtacactatactctcataactgattgcagattttggcataaatccaaaaaaacctttttcccctaaaaagcacaacactattttaattgttatttgcttaatgccagctaacagtgatgatcattgtgtggacatgggaagacataagggagtggctgaggttcatgtgcattttccagggcacccctgaagagccaacaccttcacctaaaagtgcattgggatgcaagtgagtgagagttagcatgctaccaggataactttgaatccactttatcctttgggaaaaaaatgcagaaacttctgaattctcaatcttattagtagcaaattacttgtgacacaccagagtgtagagatcccttgtgtaattattcccagaatggtctaacgtccgtcactctgaagaacccacttctgagcatctgcttcctgcactcttagcgactctcaataatgagagcttgaccccgcccctccttcacacattcctgagaatttctcgagaagaaaggaactgttactgatagaaatatgtcagatcccgctgatgtgtagggtctaagcaacttggaggaccactatttgatatctttctacattgtctggtagatacagtgactaattcaaggaaatggcacccctctctggaggagtttaggaaggctcccttggtgactgttcacagcacccccttttcagacttaaaatctcaaatcacagataagcaaactctggtaaaataccaaaaactacccaaactgcgttcaaaagaaaaaaaaaagaatatatctaaaattaggattttcagttctcatcaaaaggatttaaaattttatatgcttaaaatgtcaaatgtcttacgaccttttttttactatttaccgtaaggactgaatttacaacaagcagtcagcataggcaagttttcctagtttccgtttcttctatttaaatagctatctccagggggcagtagtggctataaaatggtataattctaataataactatccttagttatgcgtaggggaatgaggtaggtgatcactctgttaattacatggttttctataacaatattgctgtattaatatacacatactgttgttaaatgattacatggttttctataacaatatttctgtattaatatacacatactgctgttaaatgatttgcatggtgtgatctaaaagctgtggcctttggtattaggtaaatcgattagatatccactttgcctacctaacctatggtcttaggctagtctattaatcactgtaagcctcaagttccatatttatgaaagagaatatgagtagttacagtccatacattgttcatggcaactttttataaacattgtcctttacttccttccctttactatgaatgtatatatcgacataagaaataaataaaatataactcaagacacagttctcacaaaacagccttaaccgttgattaactttttcaaaccattgcttcaatctatccttattacttttattcttagaagtcttcaaggcataaccatatgtttcagtagatagacttgcactctgtggaatgaaatttacaaaggatccacgagatttgtttcatttatttgttttttgaggagagacttcagttacaacgcttgctccttagaaagtcagtcactgtgtatgagggaaaggttttaattgggccacagcttgtggcatcggtcttctccctttggccccccgtcctcagtgtgtaggggaagatacctttctgtgtttattctttcaccttacccatcaaggaaatagggcaaatcccccaagtgcatggcttcctgcccctaattgggcatccacactctcccttcagccttgatctttcctcttgcaggtaaaaacagaaaaggtggagagaaaaacatggtggattcctttctccccgtctgtgcaagcctgcctccaacctggtgatcgttgacactcaccatttctgtgaaagacttttttttttttaacatattatactagatttgactaactcaatcttgtagcttctgcagttctccccacccccaacctagttcttagagtatgtttccccttttgaaacatgtaaacatactttgggcataaatattttttaaaatataactataatgcttcactaataccttaaaaatgcctagtgaactaactcagtacattatataatggccaagtgaaagttttgtgttttcatgtcctgtttttctttgaaattatatagcccagaaattagctcattatctgaaaaacgtatgaagaactgatgaattgtataatacaggagtattgccattgaatgtactgtttgatttattcaagcaggtaatgaacaatgttgtcaaactctctaatgagacatcataattaggacataagctaaaaggggcattactccggcagtctttttttcttaatcctagtaccatacatattctttggcatgaaagaatgaaaagcattagtaaacaactgaagtcctaccatggctctgtagggtttttggaacaattcctggaattggaaagtgaaaatggatagcatgtgggggaaaccctcatctgagtagcaagattttagtaaagatgactaagccattaacagcatgcattcatatttaattttattgactcctgccatcagcttttgtagatcgtttgggtggaaggttgtgatttttactgggaggacttgagtagaagtggatgattaaaattgaggagtatataattctttctgggactgcttaaatgttattgtttgaaaataccttcactttccccctttggtcaaagagatgtgcttaaaattcttattccttcacaataaataattttgattttcttagacaggtttgtgtttaggtatgagtttctcttttacttcatctagcaattctctctgtggtcagaagaactctgaagaaagctttgagggaaatgaatataactcttaaattattatatgtgtgtgtatatatatagtttaactttaaaaataatttattagtcatcataaagaaataaatgtctctggctcaagatgttacttatttccttcttttatattttctagtctcaattactgttccaaaaggagctatcttagaacttagactagagatccagattaattgccatttttgtaagatgtttaaaatcaatttgagaattttcatgtgtctgtaaacagcaccatggagacatgtatgaatcgtattaagggcatctttccatgtagtccatactgaaattatacaaccaagaccagataggaatattttttattttattttattattacacttcaagttttagggtacatgtgcacaatgtgcaggttagttacatatgtatacatgtgccatgctggtgtgctgcacccattaactcatcatttagcattaagtattttgttttttaaagaaataataaaaattctaaaggaaatcataggacagatgtgacttgtaccagaaagggaaggacaaccttaaactatatcaatatcaagtagaagaattatacaggttcatttatcttcctttagtcttgttcttatttctaactgggatctaaatttacctttatcaatatcagaggttaagaaaattaccatattcctattaaatggtagagatatttaataagattcagcttcatcttagtacaacttcaaacatcaacatgatcagaaaacattgatttatattttaaaataggatattggagccattgtcttagataattttcaaggcaagaacaagcctgcaataaataatgagactttgacattccttggcgaagaagatgtctcctgccctaatatgactgtcactcagcaatttcaattttatgtttacttgatttaaaaagggaggataaattgttctgaaaagttttttgtttccttaacatttcaaagttttcactgaaatttgttgttttggtaaaaataaacagttaactacagaatatttttacgtggtgctttgcttttaattacttactagggaattaccagtggaaaaaagaatgtcaccagtgtttttcctacttacaccagttctgcagcatgaatatttatattaaatgtatgtgctatatgaattccccaaagggtcagtagttttggggggtttatttccaactatagttgtttagaaagccagtgtttaagagggagagagcaggttagggctactatctaagtagtggcaccaactcaaatgatacgtggggtgtagtcacagctactttacatcctgtttataaattgagacacgaggatcttaatttctagtcttctatccaatttgatttatcaaaaaaatgaatcttgattattgattaagaaaatatggtcagcttactatgtgtgaatggtcatttggaaaatttatatattgttttctcactatctttcctcaaatgtctaaattcctcttcattgaatgttactacatttttaaagcagaaatgacagaactgattaactatatttctcctcatttttaaaaattagtttacatatgaatgaaaactgagtaaaaatcaaatctatattttgttcatacataggtatgtttttctaaaaacattagtaaaatccaggaaagattaccaaatatatttatagcaatcaataaagagtgggaatgtattgaatatgaatttataaatggatgatgtgtttatctttacttatctgagttaacactgaaacaaagatttaaaaaggcatgattggccaggcatgatggtacacaccagcactttgggagactgagatgggatcacataagcccaggagctcaaggccagcccaggcaacgtggtgaaacctcatctccataaaaataaaaaataaaaataaaaaataaaaaaaagctatgatcagtatgttacagtttttgtcatattttccaaaatattcacttgtatacaagtaattcatattcttcccaaaaagaaaagtcagcaacggaaacctaataacatttttgaatgtgatactgacaatgctgttttaaaaatattgtttttaggatagttgttgaaaatttggtctcatgacaaattgattaggctcagattctaactttgacatttacttgctgggtgaacgtggccattttatttaacctattcctgtctgtttcctcacctgtaaaataggaaaaataatagcacttacatcatagggttattggtaagaattataaaagatttggcagtgacttcaatataagtactcagaaaaaagcataatttttattaaaatgtacagtataaatttcccctttttgaatgactaataattttataccatgtaaattttatattgttagcagttcaagtccaaagagaacaatagtgtagacttgttgtcatccaggtaattacttggaagtcttttgcagacaggcacatttaagctgtataatctaaatttgaaaatagatgttttctcattttgagcgtgttataccagaaaaccctgtctttgatcccatctctgtactctgtcactgattagctatgtatctctgacaacagcccttatagacttcggtgtccttttgtaaaatggattatatatatatatatatatatatatatatatatatatatatatatgttttagtggactcttaaatgtatgtgatctaccttaaatattgaaatgtttctattatttgtctgtagtgcatgatttaattgtaaaaatgttgaaaacataaatttagagaaagagagtaggggtgtggcaaatgagactctgcattgaaccatgaatgacagaatgacaggagatcattcaggccgtttccccagtcctttactaggttaaaaagtgacagaaacaggtctcagtagctgttcgtaaacttgtttttagtcaactttgaagaacccccaaggtaagaaacataacactaacaaggactttgatagatcattatttttgtatgccccataggtgaaattttatggaacattctcagtcagcattctctaagaggaatttttaaagtgagagtgaaagaatataatgggtgcaaaacaagaatagtaagagagggggtcatgcaaataggaaagaaagaatagtccatagaggcagccaccatctgaagtacagaaaggtagcccaaagaagggtagcaatttgaacactatgattttgaatgggaaaataagaatcaaaaaaatcaacactgaagtttgtcctgccaactgcaatgaaagaggaattcaatcagctggataggctgagcacaattagtggtatccactcttgatgacatcctgtgagcatttgaaagaatcaggaaacagaaatagcataaatagtagggatatgatatatgagcgtaataaaatgtatttcaaaaactcgagagcatgggtagggggaggtggtgacaagagaggagtgaagataaaactgtatttataaaagcataaaacaaaaagcatgctttaaataactttttattccctcctccatattgttctttttctcctctttcacctctttctaactccccaatattaatgttagtgagaaaaatggataaaaagactttgccaggtctagtcagaaatatatttcagttctttttcccctaacttcagatctttaataattacagccaaagaaagaaaaaagaaaaacagaagacaaatttgtcatctaatgtatctaggcatttaaaatcaggtcagattccaacagtctttttcaactgaccaatttctctcttttatgttaactttggggtaaacagttctcagaatccttagctatctggctgagaacagcctaagaaactggaaggagatatcagtaaagtaatagtgaaataagctgcatgcatcaggccatttgcttacattttccctggtttcctgaaggatttattgagagcgcatggtaatggaaactaaaaaaagaaaaaaaaaaaagaaagaaagaactcagggttagaattatgtatggttgggtttttttcattgacaaaagaatcagaagagtggtcagttcttaaatgccttcctttgtgctgagaacaaagtagttttgtcattttattttctacctcaacacttttctgtccattctaaacaaaaaaaataagcaagtaacatcagcctacactgcttgaaaaccttcctgctgagagacactgcagggctggccctgggttgaagtccgaccgtccacgtttgtctccgtgctctattttttgccacaaactgattccttaatacacagagtatcttcacattcccaaattttcctcacctacatcaaaattactggaaaacattttactttctatgttgtcctataaaccaaagagtatctgagacaagtctcaagaaagtttattttgccaaggttatgaatgcacctgtgacacagcctcaggaggtcctgacgacctgttcccgaggttgctgggatacagcttggttttatgtattttagggggacatgagatatcaatcaacacatgtaagatgtacattggttccatctgggaaggtgggacaactcaaaatggggggcttccagatcagaggtagatttaaggattttctgattggcaattggttgaaagagttattaccaatagaaaagaatgtctgtattaccatacagacttgtgggtggcggaaatcaaggttttctcccgcagatgaagccttcaggtagcaagcttcagaaaatagattgtaaatgcttcttattagacttaagaagtctgttctatcaataattcccaaagggaggagggtgtaatgaggcatgtctggctgccccttcccatcacttcctgaactagtttttcaggttacttttggactgcccttgccaagaaaagggttcctttcagatggctggggggcttagaattttatttttggtttactgtccctgctttcttttaagtaataagtggtaaatgaatactctgtaaacagatccctggaatgactgacaaagtactaattaataactcctgccaggtagctaagatgctcagaaatcttttaaagaagtaatgacaataataatattgttaatagataaggtttcctgatggctttctatgtaccaggctgagaactacattctttaaggacattatttcagtcctaacaatcatctgttttgttttgttttgttttgttttgttttgttttgttttgttttgttttgttttgaaaaggagtctcactctgtcacccaggctggagtgcagtggcgcaatcttggctcgctgcaacctctgcctcccaggttcaagcaattctcctgtctcagcctcctgaatagctgggattattaggtgtgtactgccatgccagctgatttttgtatttttcgtagagatccggtttcactatgttggccaggctgttcttgaactcctgacctcaggtaatccacctgccttggcctccaaagtgctgggattatagacgtgagttaccacacctggcctaaaaacaatcctatatgttcggtttttattactcttgttttacagatgagtaaacaggaacttaacgattttaagaaacttgcccaagataaatcagggcacagaactgaaagctgagtctatcttaattctaaaatccctgttttttaatacaattatgattttaatagtattatttttctcaggcatttttggggagatatttgtaggcaattactagatggaaaaatctacttcatatcagtggaaccattaccgagtaaaattcccacaccagggttttgaagataccaacacaaccctttccatttgtcttctcgattccacctcttcatgatgatatagtatttcaagacaattggaaaaatgaagactgtattgtggatgacaattatgtttacagaactgcctgaacattaattataataaatttatttatctatacaccaaatatttatgaagaacctaccataagccagacatgtatccgagaaaacaatggacaagtataattatagtgttttgctcaacaatattacccttaaatgagtggatgactgaattattatgcatataatgtctcaacaaatacactaataatatgcagctttattctgacctttatgaaatattactcatttgacacctcaagaacatcagagaataacagcagggaaatgatttacattttaatggttaatgactaacctatgataattttgtcttaaattccctttaacgttttctgaatgccatacccctatgctcagaaaaagtaactgaatgcatgcattacagggctttttcttcatttgagaaattcttttattattcacctctaattttttattttaacactctgaaatattctacttagtaattgacttaggatgctgcattatgtgaagtaatgaacttcttggttctgatcaagaatgtacactgtatttcaatgtgttttcttacatatgaaaaatgcaatatgttctctctgaatatcaaatgtgttctgttatgtgtctattttcaattatttaacattaagaagtctaagtatactattataggttacaaatttataaaagttcgcttgcttttcttatatgtgatatatttccaaataataaaatttactgtcatggatagggtatgtgtcttgtgttattttaacattggtggtgatgtgtttttgttgatctgcacacactttctttcttgggaccactttaaggaaatgggtgaaggtttggggtgttggccatacctctgcaaataccaatgttcttataaagaaaaaggccatctaagctaagcaacccaactgatatataaatataaaggtatatatttcagctgaaagataaagacaaatgtcctctttagtattacattaattatgaaaaatgatggtgctacttaataaaaattattaattattatattaaatatgcctaaatcaattgggggtggactcctttctggtgcaaatagaacaagtgatatgtatgtttagttataaacattctgaaatgtctatactaggagctgtctattaactgagagacttctttagcttttgaagtgatagatgccacttcaccacttaaaggacatttttctcttatttttatttgtcttatttgaagacaaaaagctcttcaaagcccaaaaagttgtgtctcacttatcttttaatttctatttcccagcacagtgcactgttgaaaggaaaaaggaatcatattggtactgagttatgaagcatctatgaaaacctatttttaacattgttttttgttctgccagaacaattcttctaagactcttcaatataatttgaggttttaagagcattcctggtatatctctgaattgacaattattttctatatattatataagtagaaacatttttaatattacttattcttatgactataactaacatgaaatgtattatgcaaaatgatacatgaaattattcccagaaatttccacttcaagtaaaatgaattacctataacatttagagttataagaaagtatgtgggccagtgcggtggttcacacctgtagtcccaacactttggaatgcctaggcatgaggatcacttgagcccagaacttggagaccagcctggacaacacggtgaaacccagtctctgcaaaagagtacacacatgcacacaaaaattagttgggtgttgtggagtgcttgtagtcccagctacttgggcggctgagctgggaggatctcttgagctggggaggcagggagaggctgcagtgagccatgatcatccccactgcactccagcctgggtgacagagtgagaccctaactcaaaaaaaaaaaaaaaagccacaaagaacaaagaggatgtgttcagttctggggaggcagaatgacaatagaccaaatgttcccatatctaaactgaattgtgctaccatctgattcatgcattcagcaagaattcattaaatcatgctatgctacaatctgttaggtccccttggtgccaattgcatataatgagtcagagattactatatctgcataacaatgtcatttttaaatgatagcatttatccccttccttaaaaagagatacatgaaatcattcagtgaaaactacaaatgatatcacttcttataatctatatttaaaagaaatgcagacacactgattatattggacaaatgttctttagattaatggttagaagacatttttatattctaatgtgtgtttgactcactagatggaattcactgattcattacccacattttcatttcaggccctccaggccctccaggtggtctgagaatagaagacattagagccacttctgtggcacttacttggagccgtggttcagacaatcatagtcctatttctaaatacactatccagaccaagactattctttcagatgactggaaagatgcaaagacaggtgagttttatttgtctgattaatccgtgcatgttttcaaagtgaattcttttctcaaaaacaaaaatttggaggttttaaaaatgtcattatctaccttgaaaggctttctttcttaaattttttaaaatgtattctaatattttggtaatgaagaaaattacatagaatttacacatttaaatgtgttaaagctatagaaaaagaagtatcatttctaaatcaatatataatggaaagcaaaatgaggcctcctgggtttcttacttgagttttgtgtgagatttactgccccaaaatcatcgggaagtctatttttgagcaaatagcatttatagcatagtatttatgaccctttttatttgggtatatatgtactatagttctgaatttctaaaaaaccacattgatcataaatcttaaattaagcatccaaatcttactactataaccctttatgtgaatgatctcacccggtttgaatttcctcaaaacagatttttaaagacattttggatctttcaacctttttcttttcttatattaagattttctaaagttgatcgggaaaaattaactaagaataagtgggtactttcctttgtctacaactttgccatttgtcatgactagcctacaatatcacacattaatacatatattttctcctgtaaaatggaagattgaagacctttttgataaaataacctgtttatctttgtaacttttgacaatatttttaaacaaacttgtcattgccagaattctttaagatggaaaagaggagacatagaaatattttcccagttgtcacaagaggagaaatgagacacgagtgtgtgaataaaatgttcctcctttttaaaaaactaaaaaaaaaaaaaatactctaatctcccaaatctgctttcattttagatttatcttaacataatggaaatcccatttccaaaatgcctatatttgtattgctcactaagatattttaatttaaatttacttctatttgatacttctctccctccagggaaataaatcaaatataaacttgaggtctgttgcaaggatttaggatatattttaatatcagatgattccccacctaagtgtataaagttgcaataaattagaaataggtgaaatatttccattacattatgcttattgttttaagaattatctgtaaatattcttgacaaaatcagatcatctgaaaaataattttaaaaaccttttagatactttataaacctaaagcatgggcagtttctacttttctgaagagaatggaaaagtatgataataatgaaactattagaaatctagccacattaaaataagtaaatggtttaaatttggtttggccctgaaaaaagaaatactaattgcaatcattttcattatttatgtatgcttactatgtagctcaatttaaatatgcttcttattttaaaatatccactagaaagtaagttccatgaaggtaaaaactgttttattcactgttctatctctagcacctatatcagggcccacagtgctcattcattaaacatgtttattgagtccccactgtgtgccagaacctattctagatgcagtatgtataggtgagtagcagtgaacataataacaacaataaaacctgtcttcaaggagcttatattatagtagaagagatgccaatacagaattaaaatatatagtaagtcatgtggtgatgaatgctagagagaaacaacagaaaagaggaatggggaagtaggagatgtgttttaaatagggtatttctcatattctcactcataggtgggaattgaataatgagaacacttggacacagggtggggaacatcacacaccggggcctgtcttggggtggggggaggggggaggatagcattaggagatatacctaatgtaaatgatgagttaatgggtgcagtaaaccaacatggcacatgtatacatatgtaacaaacctgcacattgtgcacatgtaccctagaacttaaagtataataaaataaataaataagtaaatagggtacttctgatattagtaatagccactgctgctttctgaaagttcctatttccattatatatcttttccaattcttctactttcattgaatttgggtctttgaatctaaagtatgttttctgttggccacatatagttggatttttcatccagtttgatagtctctgccttttgattgaattaatcaattaacatttaatgttattattgatacagttggattgtagctgcattgtatttttgctttctaaatattttactatttttgttcctcttttccttgttcactgctttcttttggaagaagtgagcattttctagtgtaacattttaattcctttgatgatattcaccgtgtgtgtgtgtgtgtgtgtgtgtgagtgtatgtgtgtatgtgtgtatatgtataatcctgctctgaagggaagtttatattcactatacatgtgtatattcaaacacatacatacttaatgaatactctagggcttaccagatacatttgaatttatcagaataggttttataattttattagcttaaattttcagtgaatatgaaagtgtttctcctacatagttctatttcattcttcctcttttgtgctattacagtactatatatatatactatatattatattactatatattaatagcatatatagtaatatagttatatattactataatactgtatattaatattttgttatatatgctattatagcatattttattatatgctattatagcatattttattttatgctattatagcatattttattatatgctattatagcatattttattatatgctatgtcatatatagtaatatatatattgctataatagcatataatatatgatattaatatttagtaatatattattaaatatattactcacacacagaggattaaatatattacgcacaaaagaggaagatgaaataaagctatctaggggaaacacttttatactcagtgaaatatatataaatatatatattacatctctatatgtcacaaacccaataatcttatattaatattatcactttctataaatgtttgcctattaaaccaatatgtttatattatcctttgttaatttgtctgttatattatcctttatatttactacttctaatcctcctcacttgttcatgttgatttgaatttcatctgtctaagtctattttgcattgctataaagaaatatctgaggccgggtgattttgaaagaaaagagttttatttggctcacagttctgcaggatatacaagaatcatagtgccagcatctgctccttgtgagggcttcaggaagctttcattcatggtgaaagcaaattggcttgtcacatggtgagagagggagcaacaaagagagaagcaaggtgctaggctcttcgtaacaatcagttcttgcatgagctaataaagcaagaactcactcattattggaagaaaggcacaaagtcattcattgggaatccacccccatgacccaaactcctcttattaggccccacctccaatattggggatcaaatttcaacatgagatttagagtggacaaatataccaactatgtatcaccatctgatatgatttctttacaactttgctcctacctgtcccctttgtgcagctagtatcaaatatattacatttaaatatattatagatccaataagacaattatatatatacatgcatatataaatgcacaacatatgtgtgaatatatatacatacatatatagttttctacaattacttttaaataagttaagagaagatagaagaaaaaataagtatttatatcatcttttataattacaaaattacctttaccaatgctcattattttgggggagtttattcaaattgctgtttgggatcaactactttcaacttgaagaactttaatttttttttgtaagataagtcttttactaacagtttctctcagtttttgtttatctaggagtgcattttgcctttggttttaaaatatatttgcttggatatgatattcttggttgacagtttttgtttttcttttctttttcactgctttgaatatgtcatcttagatgccttttttaggctgagaagattgttttctattctatttgctgaaaagtgtctcaaaatccctttatatttaccagtatatttattatatctgggttcctcattcctttctgtaaaactctttttttatctggtataatttgcattactaagaaacttatagcatttcaaattgttcaggttgttggactcaaaggtttttacattttttctatcagaaaatgtctttaatttcatctttaagtattatttttatttcatacaaaatccaaattgctcttcattttactttgatcactttaaaaacattgttctgttgtcttttgtctccattgttttgggtgagaagtcagttattgttttaatcataattccctgcacttgatatgtcccttttatgtgactgcttcaagatttctttttgtatttgcttttcagcttgataaaatgcatttatcctaatggagcttggcttcttgtattcttaggttgatattttcttcaactttggaaaattcttagccattcattacctcttgaaatatttcctctgctctactctctcttcttggtttctcttgacacatatgttagattgtttgatgttgttccacagataatggacagtgtgtgtgtgtctgtgtgtgtgtgtgtgcacgcacgcatgtgtctgtttatctgcgtgtctgtgtttctgtatggataatggctaatttcctctcttgcttacatagataatttattttgttggattcggtctgtgaataatcccattaaaatacttttgaccttctgctttattgtgttcaggaatttttatttctagcatttggctgcttttaatattgttcacataatattccatgggaatttcctatttgtttatacaagttgtgcatgttttccacttgacatttttacatacttaacatagttatgctaaaaccctatgagatgatttaaacatctagaccatcttaaagtctagctctgttgatttattttttctttcttgacagtgggtcatatttctttgtttgctcatgtgtctgataactttttgctcaattccaaacattgtgtatagaagaacagtgattactaaagtaaatattaattgatgtctgggaaagtgcatgtcattactttagggactgagtcaatcagatttgtagttgagatgatctgagcattgttagattcagtttagcacaggcttcaagtaattcgaatgtatgatcagacctcctacatatctgagtgtctggaggttttcctgtcctgctatcagatttcggcagactcttctacgttggaccccacagagggctctttcagttcccctgcttctgcccagatacctgctgctgataatcagtctaaagcccagagtgctcgggctttttactcagttctccttctcttcccttagacttcaacaggtccaaagcacctgtccctcaaggggaagcagatctctctcagcactcctgccactatctcatgtttgtagtatcggtgccgcagagggaagtcttttttggctcttttgttctgccccaaaactttcttgagtacacatgatgaaggcctatgaaaaataattgtcaaattactatagattctccttgttctttgatctccccacgtttttaaacagccataccagcctatactttgtctgtaaatatctgttagaagttaaactgttttcttcttgctaacatctgtgactacaaccttctttcatcactgttctaccaatgatgaattttagtccattgtgtcttcacaaactcagctctctaatgggctttgaaagatggtggtttatagattatctatgtgttgtttttgttagtgtactagtgaagttctcttgtgactgcatcctaagtggaagtgaaaaatattttctgcaacaaatacagaaataaaaatcatatggtttttatttataatgtgaccactaggaaacaaaggtacaggattaaattcagcttcatgaaggtaaatacttaagatatgaaataaatatgtttcaaagatatcaattttcagtgttccaaagattaaatttagaataatgagatgaagaaatagactatgtacttttaaggcaatctattgtaaattttacttctcttggactgtttttagcagatggacagcagacagcttgatgctgttcctggagttgtacaagatgctcaggtcgttgttagaaaattgtgtttgattctatgctgttgttttcagcggacaaatgatagaatattgttagtgatggtgtgtgtgtatgtaagaagatgttggccagaacatgaagaggcatagtaaccatgctatgagaaatagttaagagaacctggaatagattatgcaacatgaagaaaatatgtttatatttaaatttctgtgttatgtaagactgagttgattattaaaatttttctgcagttaacatctttgcacataaatgtttctctatactttagattatttccctaaaatagatatttgtaaattaaattgttgagtgtaaacagccaaaacccatgagctgtattatataatcgctctgcaataaagtagaaccagtttttattcccatcatcagtatttgagtatctcttctgccatatctttacctagtattagtattatctttttaaaaatgaaaactctctaggtttattgtaggacagtatcctttttttttttttgcctttctgtttcttcagtttttgtagttctcatttcaaacatgaatttctagatttttatgaggctacattcgtatttcccttagagaaggatcaaggattcacaccttctgagatgccagaacacagcttgctttacttttgcttcatggaaatttgcctaacctatggctccttccagagtcctgccaggcgatccatgggttgggtctaggacctgtaacataagactgagtaggtgcgttagaaccagtgagaagcctttaaattctcatttccagtctcaaacagacacctgaatttttatttagaatctctgagtgagtaggtttgttctgcgtacttacaaatatttgggttttagattgaaatgggggacatcaaagattctgcttgtgttcggatcttaaagaaataccaggactcactcaggtaacttgtaaaagtctacaatggaggggcttacattggctggagttattcttgacacaatctgttttttagtcctgaagtcattctggctgtttccaaagctgctcaaacaattaatcagtgtgctctaaaggcagggtaccacgagcatgatttccaggcaactaaaacacaatgaattattggtcttatgatacccatgaggcttgattctcttttcctcaaagaatggtggaaacttctttttattctaagccttagggcctcaaggcatttgtaaatagatctttgaattattgcttacagctggttgctaaactgagtactttggcctaagtactaaagtaagaactaaggtctcctgctttatatctctttgcttaaaatttacactaaaagtaaaacaaatttttaaagaactacccatttaatacacaaagtttagttttttttaaaagagagatgcctctaacaggcattatactgttaagatctgatttttcactgctgagattaactgtattgcctgactcagaactgacccggttaaaaatcaggtctagaacaaggtctgctcctgatccatccccagtatttgcctccattatgcaaagtactttactctctttctggctccaagaataacaaacaggttgcaaggaacttggctgaagaaaaaggacacaaagtctctccgttcctgtttctcttcatttggcttgaggcataaatctgcttccaaagcaaagctgacttctttagggagcaggcctctgctcccaaactgcataggtgattttggaagcagtaaaaaaagaagaaagagaagaagagaaaaggatccaatagttcctaccagggcttaaggaataggaaagaagattgcattaggtacaagtccatttatgaagacatttagggctcacaataaaacatataaaatgtgttttaaaagtaaaaccatgtttttaaaaagcatacaaagcggcagtggaagagataaatgagaatcaactcacaattgaagggaaaggaagaggccttaagaagatagagtagtactatctgctttagacaggacaggacaatttatgggctgaatacatgacaatatagagtcatggagtgatggatattatgtggtggggcaaggtaaaacagtgccctccttctcttacctgcctgattcaaggatggagaagacactaaagtgattgatatagacaaagctatgcttcttgcattgagacactgtccactctaaatagacacaaactttagaatttgtattacatatatattttaagcaaaaatgtattaagtacttctatttgtaaaacatcatgctgggcatactaggccctgaggggtttcaaaacatgaataaaaagtagaagaaatgtatacatggccacaaatgatagctaggaacaagcaagggggagacagaagaagtatattgagtgtgggcctcatgtggacctagccagtcttggagttccatttgtagtgatgatatgggctacttagctcaagataagagctgggaaaatagacagaaagtgttttaaattatgtacttctgatgtggttggggtcagaagtgccaccgagatttgcagaagtgaaagcagcttagagagaagagacacttttaattcttggtacatcttttaaaaatgatagacgttaatcatgtttttgctaaattattcctactacttacatagatggttttattgaggggatattataactatctaccaaaacatgtttgttttagatatttgtattctcgtaggtactgatgttaatataaattatcaagaagaagaataattgggtttgttctaaaaagaagagttgtcaagctattagtaatcctggtgggaatactatttttaaatatttacagcaaattccttccttaataattcagaatgtccattctggaattccatccccttaacttgcacttcgttttccccctttgagagagttttatgcgtctttggaccaaggggttcttcctagggtccacctgcttgaggtcatgactctgagtctggttgcttattcttcctttcttcatctcactcgttaaaatcaaagccttggctcctcagctggaatccagatctagcataaaatgactcctgttgacttttcttgccttacctaccatcattccttcacatatttttggtggtcaactatgatcttctactttatgaaaatgtcttccatttgtttgggatattttcatactggatcctcacactttttatatgcactcaaaatcagtcaatcaactgcagcttctccacacatccacctggttcttctttgtctgtcctagcagatacctgcccttacctgttgacctcccagcttcctggaaaagccccagtgtagccttgactatcataagaacacaatatcctcattctttaaaatgcttccaacatttccatccttaaaacccttaaattgtgctggagttttgggactaggaagcaggggagcaggtcagactgcctcaagcctcctaaaacacttttgtactgtacacccctcaacccctgccaaactcaagaattataaactcacaaatagctccatcagcttctgcctttaaggttcagtattagttttctagggttgccaacaaattaacataaacttgttagcctaaaacaacagaaatttactctctcatagtttggagaccaaaatcaaggtggtggcagggctgcatcctctccaaaggctccattccttgcttctttcagcttctgatggctccacatatcccttggcttgtggctacatcactttcatatctaccttggtggtctcatggccttctgctcttctaggtgtgactcttctctgtgtctttcttttataaagacatttgtcattggatttagagcccacctagaaaatttaggataatcctaccctaagattcttaacacttacaaccttaatttgagggtctgccaagcctttttttttttccatataagataacatttacaggttctggtaatttggacatggacattttttgggtggagaaaggtaccatttaacccaatacagcctgttttctataaggggttaaaatcattgaaaagtgtccagtaaaaaagggctaccttggccgggtatggtggctcacgcctgtaatcccaggactttgggaggccaaggtgggtggatcacgaggtcaggagatcaagaccatcctggctaacacggtgaaatgccgtctctactacaaatacaaaaattagccgggcctggtggcataagcctgtagtcccagctactcgggaggctgaggcaggagaatggcgtgaacccaggaggcagagcttgcagtaagcagagatcacgcaactgcactccagcctgggtgacagagtgagactccgtctcaaaacaaacaaacaaacaaacaaacaaaaaggctaccttactcagcgttatcagttatcacttcactctgtaaacagcccttcacaaaccaaaacttcactttacttctttcaattacctagaaaaatgtccttatgcatgtgaattaaaacaaacagtttccgatttggtgtgagggaggagtgaaagaggagataaagaggtagaaatccttaatgaatcttaataaatcaaaacagaggcgaaggtaaagggaaaattttaatcagaaagtcaaaaatatatgtcaaatctacagaacaaatccataacaaaataagaaattagatggcaaaagtagtgtctagcagagttaaaattatggcagggtgagatgggacagtctgagccatgcgagaatttgtccaaaagtagaaactggaccctggggtgcttagcatttattgtgttgatggacacgtcatctttaaaaattatgtattcatggtctacattgccagataaaacttccctaaatgataagatattgcgtcatagacaagcctacaggtacaggtatttatatggataggttgattattaaaaactcgtggaaatatttgaggcaagcttataataatgcacagatctaccttggttgcatgttttattatacctcaattaaataagcaagctaagatcacattccacccataatttatcatctaatctatattagtatctagtagcatgaattctgagggatacttaacaaatcttaataaaattattatgacatttattatcacttgtccaaatgatttgagtataaatctataaaaccaagtaaaaaggatataaacattaaccttttctacctagttataaatcgtttgctagccatagactatatcagtggcaatacataaaattttgctgctccaattgtacctttatctcaggaaatctttttagattgcaccttcagaatacagctccttgctattcaaggtgcagctcatggactagcaccaagcctggaggcttgttagacatgcagaattgcagactccctgcctcaaacttacttacataggtgattcatatgcatatcactctttgtaagtttattatatattaaacctcttctcttactcccttgaatttaacattttgtcattcctagttgtagtttttacttcaactcagtgtaatatataccattctccctgaaatagtaaaataaaaagggaagttataaaagtgataagttaatcaacctgtattctctatttactatttattttattcagatcccccaattattgaaggaaatatggaggcagcaagagcagtggacttaatcccatggatggagtatgaattccgcgtggtagcaaccaatacactgggtagaggagagcccagtataccatctaacagaattaaaacagacggtgctggtatgtatatacaagaaacttgaaattttaaaagatttctaaatacagtgccactttcatatatggttgaatgtatttgaaaataatgctctgaggtaagtgattcatctgaaaagcatgtgtgtgtatttcactatcaagacagtcaaaaatcaaaagaggaaatatgaagtttaagaatattttaagacagtcaaaaatcaaaagaggaaatatgaagtttaagaatatattaattaagaattaatatagaggaagaggtgaataggaactactgaaatgccactggagaccattggaatgacgtaagtatttagattataaactttaatgtaaattctgaatcttaactaggcagactcttgcttgattaaacatgtttcatgatttagaaggttcataattctgtgtctctctcgaactcatttataactgaatggccaagtcggtggatattttatggtaaataccaactgcaattaaatagtgccaaaattttaggtttgatattacttggaaataattttttcctaacatttaaggataagtagacatcatggtaaatattcttcagagttacatgcgaaccactgatagtgagcatatcacttctagatatgatcttaagtattcagagtccagagtgttcaccattaccccgtggaaccagctctagatatgatcttaagtataaattatattcagacatttaggtatgaaagaattagattgaatctctccgagacattgtttttgttattattattcttaaaaaatatttaatgttgtcacttctactttgagattaaaaaataatttaagacagatcttatggtaatcatgtctagatgatgagcctatatattgtaaagaaatcattttctgagataaataatacagataatatttgcaacaaaattccaagaaagaaggagggaggcctacatctattatcagtgtcaaagaaagtatcctttctctctgacgatttttacttcaaagaatggtgttcagctaagacttaggtcatattgtattagtcaagaaatcacagaaaattaattaaactccatgattaaaggtctgtatttgagataggtaagtaaaaatattttacctgagatgtttgtttagaccaatttaatcacttagtatttttctgcaattttagtgaatgcttgttaaatcaaatcaaatacatgatctgtcagtataaaattacataggtaaaccaccagtggaatcatgccacagtttctttatatttttgtttttaaagaaagagcaacagtgttcggtccataatacagaagcctctattacaaacatatgcagctctagggaataataataaaaaccaaacacaagaatcctggctatgtggtatctgtctcctataaagcttcatcttagattacctacatatcctgatgaaatttctgtgaggtagagaaaagcaaacactagtgttcattttgtaggtggatatgctaacacaaaaaatttagtgtttaggtcatatctagtatcatagttaaggttgaaatctaagtttctattagaactctaataaagattcatataaatagatgtgtttctagaatcctgcttgagaagccgactttgagaaaactcaatgtatgagaacagctgtcagatctaaatttgaattctgaatcttgcaattagtcatattaacttagataaactatttagtgtctctgagtttattgcccattaatgaacatgagcataggactacctatgtcaaaatgttattatgaggattaaatgaaatggatgtgaaaatattgaacatagaccaagtattttagtgctttggccccttaatttcagaattatccttttttatctaataaattacattaaattacatgaaactttaagagatagtttacttatagcagtccctgtttaaagacattagaactcataactatatttagaagttaggccaaggaactgaggtaaacagaaatgtagagaagtgatattaagagatcacagtagcattttaatggaactctgccattcatttaaaatcttctctacaccatctaaaacactgaagtttggcaagtcctagtcaaatgagctcagagaggctacattttttttttgatatagggaataataaaagaagagctatcattagaatcagaacaacatttttccttagtgatataggggagaaggaaaaaataatagagtatttcctgctctaaaggcacagttgttactttaaaccaacttatttttgtcatcaccttctttaggcatcacctcttacattttctcaaatggtattttgttaaggacttagttccccatctgatgtgcttacaaaataacttcccttacaagccattagagccaaggccaaaagcaaacacacctattcacagagtaagatacaaccttgtagtgatatgagatgattcattcttctcaattgtaaaaaaaaaattaattctgtaacttctaacacatttgttaatctatcatcagaaaatattttgagatctttgattaataaactcattactatagtttacacatttgcagtatattgtcagacacagtgcttagttctctgtttgcattgcttaagttaattcccacaataactttatgaaacagatgaggaagttaagattacacccagctaatgtgaggcagagctgggattcaaatctaggtgtttctcatctaaaggctttgctcctaaaccactttctgaagacagtgggcagtattgtggctccgggccactgatcctttggtggaatgcccgcattattatctaaaagctatgtaatttgaggcacattacttaacctctgagcctcacttttttttttttttagacagttcagtggctctttttttggagtgcagtggcacaatcacagctcactgcagcctcgacctccaggtctcaagctaccctactgcctcagccatcctagtagctcggattacaggggcttgtcaccacgcccagctattttgtgtgttttttggtagagactgggtttctccatgttgcccagctgatcttgaactcctgggctgatgcaatccacccaccttggcctcccaaagtgttgggattacaggcatgagccaccgggtctggcctgagtctcacttttttcatttctaaatgggaatcatttatcttaagggatgatttttatgtttacaaacatattaggaaagcagttagcactgcactgcatagtatttgctcaataaaatttatttattatgctattaaatgtcctttaaaaatttaatatgcttacaagaaaatatggtctcctgtctactttgtaatggattacccatttagcaatacatttccaatttttataagcatagaagaaagatcatataattttatgtaattttcaataatcttttaaaagtcattttatgtatttgatataaaattctacagaatttctctactgttttgccatttacttgctttattaaaattgaatatgcatcaaattggacatttacatttttcatttttataagaaaataaaaatactttctaaatgagggatgtttgtcttgtcgtgtaccattataacaactctctaagagatgccagcatatgctatgtgggacaaaggctggttcccatttgatggaaaggttggtccccagcctcattatgctgattgaaagacatgacattatccaatgccacacatgcccttatctgtccaattacttaatgttaagatctcagcgcacacttgggtgcattctttggattcagacacgtgcattataaaatggatgctcccaaatgaaaaattagaagatgtatttgtaattcattttaacccatttaattttgactgtagaaaagagataacaaaagtaccctttgaaataatgtgtcattgtaagacatgcccccatggctaatagctctgcaggttcagttggtgagtccacatcctaaaatggtacattcaggtttgttttaacagctttctttattagccagatcaagccagtcaaagaaaggaaagagaaaaaagaataaaaccaggaacaacactttcatattatgtataaagccttgatttcatgcctaatgaaggtctgttgttctttcatttagtattctttctcattctttcttttttctttctctttttcacacatatttgataaaagagaagaatagaactaagaaaatattttatagctggtaaggtactatgtgatgttagttgctgtcattaatacttaaatagataaatctttaaaagaagcaaagaggatagatttttaagccatctgaagacctgaattaaagatggcagcttctccacatgtaagcagtataatctgggcaagttaattagtgtattcgggacacatttgcctttcctattaagagaggggataatgccaattctccatgatgctgatctgggtatccaattagatgaagtatatgaaaataacttctaagttctagatgtgtgtattattaagctgagatcattcattcagcaaacttttatatttaacatatcgaattaaaactagttgtacatatttattttttaccactatgagaaaatcatatccagtactggaatctgattttattcatattgttatctttagtgcttcacacaacacaatgtccatagttggtactcaaaaatatttgtagaagataaaaaggagaaaccaggagggtaagatgatgattggggctattggaagttaattgaggatgatgaaaaaaaaaggagtgatcaaggcaacaatagatttgcatattataatttagaagaatctattgccaaatacattgtgttttgatgattgaaaacaagtttaacatatacattcgatgctattgtccatatactgatgaaagaagaaagcggtcattttttaacttaatttaaacaaatagtctgtaactggtttggattcttcataagaattttactgtggataattataattttaatgtaaagaattcttttctgcccatccaaacattttccccaactgacttattcttagattatcatttcattgtgcaactaaaaactcattctgcttcacctatttaaatttcttgtttgaaaacaaggcctataacaataaacaaacctacaatttctatctgatgagacataactatctgtgaccctctatctttttaagctacaatgggaacatcattttaacatggtggattatattaggggtgttagcaatccactcctctatcagagcaagcgctcagaagagttgcaaagaactattctcattttaatattaaaatattatatagttcatttgatttttttgatagctcttcagaattatatacttaagtgcttaaagtataataaaaaagaatgtatgtataaatatagaattaatgcaggtgttagacttcagtccttttggttttccaaactagagcactatttacataaccatgttgaatctcttactaaaaaaattgtattaaatcaccatgaaattccaatgcaagttaaagtaaaaagttacattcatgattaacttttcatctgtaaaaatgactgtataagttaaagttataattaacaagaattaaagtagtcaatatgttttcaatcaagagcttatcttcatatactttataatttttataatttaggatttgtcacaagccaatttgtacattcttaaataaaacatcaaagcccaaagagatacttatatgcaaattatttaagcattcagatctgaaaggaaaattggcagcattaatttcttttcatgggaaagaatagtcatggcattggcttgattttctttaaaaaaaatttttagatctatgactgaaatacagaagcactcttataagcatcataagggaattactattaaatagaaattaagacaaaaggacaagttaaagcagctcactatttttaaccgttcacagtaaaattatacatgttattaataaatgattaataattcaataatttttctgaatagtttaaattctttttaatgatttattgtgtaaagaatgtctagtttgtttcctgttaagtgcactggagcctaaacttaagcttccttgtacttagggtgatttacttccctgaaacaaatcatgctttggccaagtccccatttctgcagggctgagtgcaaatagagcacctaactcctctattctcagattcatgttaaatatgtaggttttgtgtcaattccacctgtgaaaaactttttctaatatgctaaggctacaattgaacattcaaagctaaatgagagaaattaaatcaataatccaagtaagatataaaaacactttattaagagaagcagttactgttcttctgtgctttttttttttttttttttttttgagacagcatcttgctctgtcgcccaggctggagtgcagtggcaggatctcggctcacagcaagctctgcctcccaggttcacgccattctcctgcctcagccttccaagtagctgggactacaggcgctcaccaccacgcccagctagttttgtttttgtatttttagtagagatggggtttcactgtgttagccagggtggtcttgatctcctgacctcgtgatccgcccgcctcagcctcccaaagtgctagattacagatgtgagctaccatgtccggcctattctgtgcttttgtttatgtcccattttccatggactgagctcagtgaatgatctctgaagagcaaatcagtcttgaaaatatattacaaagtgcttaaaagaaacatgataaaatggaaagagatattcaatctaatttaaacatactccatttttaggtctgttccaaataaaaaggctaatattgcttataatgaaaaacatttcagtaaaatgctttaacaaataatacttgtcctaaggaaggcaatatttgattcaacaaattgcagtataatattttagagttatttttgaaattatttgcctgtgactactatacttgtacttaaacacccttattgtttgattataggacaacttactttttgttttcctatagcatgaaaagttttaacttcagaatatgagttataggggtaaaagagttcctagaagttattttaatactccagctcttaatatatattatatctaaagtgctacaaattattttttaaccctgtgtagtcagtttcattttctaacagtcatgtaatcacagttgaatagtaaaataaaatctctcaaacttcatattattaataatttctctatggggaaacaaaataatcatatagttttattttttttaattttaagttaagaggtacatgtgcaggtttattatataatgtaaacttctgtcatgggggttagttgtacagattattttgttaactaggtattaagcatagtacccattagttgtttttcctgattctctcccaacttccaccctctactcttcaatatgccccagtatgtgttgttcccttttatgtgtccaggtgttctcatcatttagcctccacttataagtgagagcatgcagtatttggttttctgttcttgcactaatttgctaaggataatgacttcctgctccatccatgtccctgcaaagtacatggtcttgttcttttttatggctgcatagtattccatggtgtatatgtaccacattttctttatgcagtctatcactgatgggcatttaggctgattccatgtcattgctattgtgaatagtgctgcaatgaatactcatgcatgggtctttagaatagagcaatttgtattcttttgggtatatactcagtaattggattgctaggtcgaatagtatttatgttttcaggtctttcaggaactgacacactgtcttccacaatagtgtataagtgttccctttttctccacaactttgccagcatctgttattttttgactttttaataatatccattctgactaatgtgagatagtatctcattatggttttgatttgcctttctctaatgatcattatgtggagcttttttcatatgattgttggccatatgtgtgtcttcttttgaaaagtgtctattcatgacctttgcccactttttaatggggttgttttttcttgtaaatttaaattctttatagctgctggatattaattagacttttgtcagatgattagtttgcaaaatttttttcccattctctaggttgtctgttcactctgttgtagtttcctttgctgtgcagaagctctttagtttaattagatctaatttgccaatttttgctattgttacaattgcttttggcatcttcatcatgaaatctttgcccattcctatcttctgaaatctttgcccattcctatgtcctgactggtattgcctaagttgtcctccagggtttttatagtttgagattttacatttatgtcttcaattcatcttgagttcattttcatatatggtgtaaggaaggggtccaatttcaatcttctgcatatggcttgccagttatcccaacaccatttattgaatacggtgtcctatccccatttcttgtttttgtcagctttttcaaaaatcagatagctgtaagtgtgtgaccttatttctgggttctctattctgtttcattggtctatgtgtctgtttttatgtaccagtaccatgttttttttgattaccgtagccctgtagaataaagttgggcagtgtgatgcctccagctttgtcctttttacttagggtttgctttggctatttgggcttttattttattttatttttttggttccatgtgaattttaaaagagtcttttctagttctgtgaagaatctcaatggtaatttaataggaatagcattgaatctataaattgctttgggcagtatggccatttttatagtattgatgctttctatccacgagcatggaatgtttttccatttgtttgtatcatctctgatttgtttgagcagtggtttgtagttctccttgtagagatattcatctccctagttgtctgcattcctaggtattttattctttttgtggaaattataaattggattgcattcctcatttggttcttggcatgactgttgttggtgtataggaatgctagagattttcccacattgattttgtatcttgagactttgctgaagttgtttatcagcttaagaagcttttgggctgagactatagggtttctttctttttttttttttttttgagatggagtcttgctctgttgcccaggctggagtgcagtggtgcaatctccgctcactgcaacctctgcctcccggtttaacgccattctcctgcctcggcctcctgagtagctgggaccacaggtgcctaccaccacgctcggctaattctttgtatttttagtagagatggggtttcaccatgttagccagtgtggtctcgatctcctgacctcgtgatccgcctgcctcggcctcccaaagtgctgggattacaggcatgagctgctgcacctggctatgggttttctacatataggatcatgtcatctgcaaactgatatggcttgacatcctctcttcctatgtgtatgtcctttatttctcttgcctgattgccctggctaggacttccaatactgtgttgaccaggagaagtgagagatggtatcctggtcttgtgccagttttcaaggtgaatgattccagcttttgcccattcagtatgatgttggctccgggtttgtcacagatagctgctattattttgaggtatgttccttcaatacctagtatattgacagtttttacatgacggggtgttgaattttatcaaaagccttttctgtatctattgatttaatcatgtggtttttgtctttaattctgtttatgtgatgaatcacatttactgatttgcatatgttaaacaagccttgcttcccagagataaagtctacttgattgccatggatgagctttttgatgtgctgctggatttggtttgccagttatttttttttgaggattttttcgttgatgttcatcaaggatattggcctgaaggtttcttttttgttgtatttctgcctggttttggtatcaggatgatgctagtctcatagaatgagttaaggtggagtccctcctcctcaatttttcggaatagtttcagcaggaatggtaccagctcttctttgtacatttggtagaattcagctgtgaatctatctggtcctgggcttttttttttttggttagttggctatttattactaactcaattttagagctcattattggtctgttcagggattcaatttcttccttgtttagtcttgggagagggtatgtatccaggaatttatccacttcttcaagattttctagtttatgtgtatagaggtgttcataatatcctctggtggtttcttatatttccgtggggtaagtggtaatatccctccttgtcatttctgattgtgtttatttgaatcctctctcttttcttcattagtctagttagcagtctattttatttttttccaaagcaccagctcctagatttgttaatcttttgaatgaaattttgtgtctcaaacttcttcagttgagctgtgactttggttacttcttgtcttctgctagctttaggatttgtttgctctttgttctctagtttttttagttgtgattttaggtttttaacttgagatctttctaactttttgattgggcatttagtgctatgaattttcctcttaacactgcattagctgtgtcccagagattctggtatgttgtatctttgttttcattaattttaaatatcttctcgatttctgctttaattttattatttacccaaatatcattcaggagcagttattcaattttcatgtgattgtatggtgttgagtgaatttcattcttgatttctaatttgattttgctgtggtccaagagattgtttcttattatttcatttcttttgcattttctgaggagtgttttatttccaattatgtgctcaattcttgagcatgtgccatgtggcaatgagaagaatatatattctgttattttggggtggagagttctgtaggtatctatcaggtccatttgatccaatgctgagttcaggtcctgattatctttgttaattttccatcttgatgatctgtctaatattgtcagtgaggtgttaaagactcattattatgtgggagtctgagtctctttaaagctctctaagaatttgctttatgaatctgggtgctcctgtcttaggtgtatacatatttattatagttagattttcttgttgaattgaaccctttaccattatgtaattcccttgactttttttatctttattggttaaaagtctgttttgtcagaaactaggattgcaaaccctactttttactgttttccatttgcttggtggatttttcttcatcactttattttgaggctatgagtgtcattgcatgtgagatggatctcttgaagacaacataccaatgggtcttggttctttatccagcttgccactttgtgtgttttaattggggcatttagtcatttacatttaaggtaactgttgatatgtgtggattttacactgtcattatgacgttagctggttattttgcagacttgtttatgtggttgctttatagtgtcactggtctgtgtaattcagtgtgtttttgtggtgtctggtgctggtctttcctttccatatctagtgattccttcaggagctctggtaaggcaggtctggtggtaataaattccttcagtgtttgcttatctgaaaaggatcttatttctccttggcttatgaagcttagtttggctagatatagaattctggtttggaatttcttttctgtaagaatgttgaatattggccccaaatctcttctggcttgtagggcttctgctgaaaggtccatttttagtctgattggcttcctttgtagttgatctgacctttctctctagctgtctttagcattttttctttcatttcaatctttaaaaatatgatgattatgtgtcttggggatgatcttcttgtgaagtaccttactgtggttctctgcattttctgagtttgaatattggcctcactagttaggttggggaagttctcctggatgatatcctgaaatatggtttccaagttagttccattcttcccatcttcttttccagggacaccaatgagttgcagattcagtcacatattttttgaatttttttcatttctttttattcttttttctctattcctgtctgactgtcttatttcagaaagccagtcttcaagctctgagattatttcctctgcttggtctattctgctgttgatacttgtgattgcattatgaaattcttgtagtgtgtcttttagctctatcaggttggttacattcttttctaaactgtctattttttctgtcagttccttcattgttttataattatttttagcttccttaccttgggttacagtatactgctctagctcagtaatcttcattcctgtggataatctgaattctatttctgtgaatccagccatctgagcccagttcagaacctttgctggagaggtgattccatcatttggaggaaacaaggcactctggctttttcaattttaagccttctcagaggattctttttcatctttgtgggcttatctacctttaagctttgaaattgacaacctttgattttttttctcttttatcctatttgatgaccttgagggtttgattgtggtataaggtagattcagtagactagcttctgcaagattttatggggccaacattcacctcccaattcctggactgcatgctataactctgggggactcatattaggccctgactttgtcctctggctcctcaaggtttggaatccactgcactggaagggagggctaaggtgtagcagctgtagcagagtgctaacaagtgctggggtatctgcctccctgcaggtgttcaccacagtggcagaggcaacacagctggcaggcaggagcagaggacccctgctggagactgtgtgtgggcatgctggaggtggtattagctcaggggctgggtactggtgggaaaagtctggatgtcttctctgtgtcccctaagcaggtgtgatccaccatatagttctgcatatagttttatttgtttctgtgcaattaatgtacatacttcaccaaagaatttacatagctaatatcagaagttttcatgtaggtatctttgaatcacaattattaggagctacaattcagtaaaaggataccttgctttcagcactctaaggaagatgtggctattccaaaatgggagggcatttggggactaatatttcatctctttgaaatgttaacagatttgaggatggtatgtcagactgagtcaaagcatttgcatgggaaaaggtatgtcctctatagaaacatggacttcatccagatggctgggtagctgggtggtgcccagattgcaggaacaaacaatgaatactttgttcatctgtacaaggccagttaggtgctaagcatacaaatccaataaggtacagtgcttacctgaaggagtttgaaggagagagaaaaacttggagagaatcaatgaagaggccattggacttggcagttaaaagcagttttgtgtggttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtcttgatctcctgaccttgtgatccgcccgcctcggcctcccaaagtgctgggattacaggcgtgagccaccgcgcccggccagttttgtgtgtttttaaagagaaatttcagttatttaaagaaatggatatgaagcagctatatcacctggggtatataccctggggtttgtcatcttgcaccaggaaaacttaggacatggactcacacgaggagtttagcagcagaggtttaataggcagaagagaagtgaaagagaaacagttctctctctatagagagaggggtccctcagtggaaaagactggctgtcagtgaatgtgccaaattttatagtcaggtttgaggaggcggtgcctgatttacatagggctcacagattggtttgatcaggtatgacgttcacacaatgcatgcggaaggtggttgtcccactctaatgttagcatgcaaatgggctttccagttgactggtgccatcttctctgcttctcactgtacacttggccgacaaagggaagagaagatggaccatcttgaacatgtatagtccttacttcctgccagcattcacccatgcaagctcccagcttgcttgtttatgtctgcagctcaactttacaggctgctctttgttagaaaatgatttgtggctgcctttcaataaaaagcaaagccttaccaaggactctcattcagttactttctgcctaagtgatttcttaacttctatatcgttcccccctctggagtggtaaccctaattgctgttagtggtcatttgaatgatgactctttctggcaacttcctcctataaaggggcattgtgtggggaacagcagctatggctcctcctggggtcaatctaagggtccttggaagaaaggcatgtccatgtatggttctgtctgcagcaccatttggagtttgattgtttctaaatgagaagagatgaatgttagttcgaatatgactattaagattgccactattagtggaggtaccataggccacaatcataacagtagggtttgttacctgtcagtcattttgatgaaatgaaatactggtttgcttctaccaaatgttgctgtactttatcagaagtgttgatataaaagcaacatttttttttctttgagaaaaacatatatacccccgttgctttgccattaggggataatttctggtctaggtcatcttttttaacttgcaatatgattgggagaaatatgtcattgggtggctagtgtaattttagtgttaaccctagctaaatctttcctgcaattaattccttcacagcttccaccaactatctatgacatgcttaaactttctggcttgtcctaaacatccttctttttaaacaaccaactattctttttaggacatgtatttaccatccttctaatcctttcatgacttccatgaaccatctatgacatgcttaaaccttctgacttgtcctaaacatctctcttttaaacaactagctattttctttaggacaagtatttctcatacaagatcccttcttatataaaatctctttcctttataaccttctttgcaccaaacggtagcatgagcatggagaactaaaaaagcatacttggagtcagtgtaaatgttagctacctttaccttgcttaactcaagtgctcttgtaagagctatcagttcagctggttgagcacttatgcctggagtgagagacacactttcaataacattcagagtgactactgcatatcctgccttctgtactccttgctctgtaaaggagcctctgtccatgaagagggcccaatctggattttctaggggagtttccctgagatcttccctggccgcataggtctgtaccacaacttgttcacagtcatattcaggtcctccagttcccttggggagaaaggtgactgggcttaagcaaaaacaagtttttaactggatggtggaaccctctgatagtagggcttgatatttaaggagcctgctgtctgttaaccaaaggctttccttagaggacagtaatcccaccacattatatggggtataaatagtcatgtcatttcccaggattaatttggaggcttctgggaccagtagagccactgcagcaatggatcaggggcatgctggcaatcctttaaccatcaaattaagttccttactcaggtaacccactggctgttgagctggtccacagacctgtgttaaaactcccaaggtcatttccttcctttctgatacatacagattgaaggcccttcctatggaaaggctgtgactatggcctcagtgagatggaagtcctgaagtagtcttcattccccattgagttttatgtgctcctaacattggggtgttgaatgggctgcttcaggttttgaagaggccctgcatcatcaggttattagtaatggcttctagccctttcctagcctctggcttcagtggatattgtttctggttaggaaaagaagtgggatccttaagatggatctggactggcctagcagttacagctcaactcattgttccttcagttgcccacacttctggattgatattagcttctaccagggggtgacagagtttgtcctggggctataaggatgctggtctgcctgcaagtaaaatatctctacctaataaaggagtggaactttttggcatgattaaaaaagcatgtgtcaataataggtttccccatctgcaacctaaggggttgtgaaaaatattgaattagactttttcctgagatgccctgtgatgcctggtcatgctacagaaagaggggaggcctggattagagaggagaagagagagagagactggctctagtgttcacaaggagatctaccttccttcaatttccagaatcacccagggctcctgtgctgtatgttggtttgagccactggagctccgggacccatcaatcctgttggacaatctgtgagactggtttggaacccggtgaccttcatctctgggggcagtccgacttccaatggttccttccacaggctagacaaggttaaggtggttttttcttgctgcctgggcactctttcttaaagtgccctgacttgctgcacctatagaaactagcagatgtacctcagggatcctgggctttgtatgtttgcagagcagctattagtgcctctgtccttctcttttgcttcctctctttctcctggatctcctcctcctggtccctattataaaacaccaaagtggtcacccttaggaggttctccaagatgctatctggtgctatagcctccttctgtattttccttctaatattgggaggtgcctttttaataaacttgtcccttaggatgagctgtcctcgactgattcaggggataaaggtatgttttatgagtgcctatcagtctttccataaaggctgcaggattctcatctggttttgttctatcttggaaagtatagagtaattaatagattttgcccttgctcttcataggccctccaatatgtgcattaaatggtgtttccttttccatccatctgtggcatcaccggtgttccaactagggtttgtttttttttttagaggaactgcttcccttcctatcgggaatggtgtttccattatttctttgccttccttatctcctttttcctttttaatctaccacaggagacatgttgttcatcgccagaattttctgctgcctgcagaactgcctgcttttccactgtggttaggatttggcttaagagcagcaaaacatctctccgtgtgtggtgaaacacttgagttaaattttggaagggttctatatacctatcaggatcatcagaaaattggcctaaatcttcctttatttgcctaagattctgtaatgagatgggaacttgaggtgaccccaaataacggggattctcagatggctcctctggaagttgcttttctagtcttagggaatcattccctttgggcctgcctgatatgattgctacacttgcaaaggtctagtaagaaggccatgcccttgtgcaaaagaaaatgagccattttttcttcaaagtctcaggatcaaaggagtccctgtgcttcagaatgcactccagaggagtacaggccttagatgataaagagaaggaaaaaaaggcatccctttagtctccttccttttgatgtgacccagggtgggagaaagacagtgggggtgtccccctgttgttttctctccatggttcctggcatcctggcaccttgttaaatgtgctgcccatggttgcaggtgtggcttccccagccatggaaccagaggaactaagtggtgggttttagtcaccctcacccatgcaactctagtcctctgcctagactttggggctctctgaaaaatggatcttgggaaagactatgtaacagttgcatttgggcaattgttgcactcgcctccttaatggaggaagcgtgctggtttgagctctatatcctgctattatggcccatgctaaagtgtttacccttagagaatcattccagttaacttctgacttaaaatccccttactaattaagtaccattctaattggaggcagaataggtatcttaaaagaatgtagggaccaaatggccattttcctgaaggaaggacagtattaagactaaaatttggttttggaggacattttactcctaattgctgaaggcagagttttcccattcacagaaacagcataaagcctggtttctagtagagaggcgtaaaaaggggagagaattgggaagctagagtgcttgggtaaaggagaggattcctattccactaggtggtgctgctgactttgagatgccatgtgctctccagaccaagggcagagtgaccttgacatgccatgtgctctccagatcaagggcagagagagagagacctggaaatgccatgtgctctctagaacaagggcagggagagatgctcactgggggtaccctctgtttctagaacatcacaaaaacaccttcccttgagctatatgcccatttactatgacattatctgatcttgccaaacaggattccttccctgaaccataaatcttcccacacattgcatacacagagaggataagagttatgacagttgccaacaggaaagaaagaaattatgataggaaagttggagatcttgtggccgatagcccatcagtggggacagaggctggggtcagtccagtagcctttggataacaccagggatagccccagccagaaatcctcagttgctccaggactccttccagccccacatgacggctgagtactccatgaaaggaagctggttcaaacatggccaatatgccaagcaacccatgggttctccatgttctccccagtaagcctgtcccccaagtcttatatggctggcagccacgctaattattttatggctgaagggggtccagtatttggtttgatttggttcttaaatggaggccaatagcctctgaatgaaaggacagagttggagtctgctcctctactcattgtttcaattaatgttgtacgctggtatcatggatgaggtccccagtatgaaatggctatgttgtctggggtatataccctgggattcatcatctcacaccaggaaaacttaggacatggatacacacaaggagtttaggagtggagatttaataggcagaagagaagtgaaagagaaacagctctctttctgtagagggagaggggtccccgagcagaaaagactggctggcgttgaatgcgctggattttatagtcaggtttgaggaggtggtgtctgatttacatagggctcacagattggtttgatcaggtatgatgtttacatagtgcgtggggaaggttggtcactgtaccctaatcttattatgcaaataggctttccagttgatcagtgacatcttgtctgcttcttactgtacatgtggctgagaaagaaaagggaagatggagccgccatcttgaacatgtgtagtccatagttcctgccggcattcacccgttcaagctcccagcttgcttgtttatgtctgcagctcgactttacaggctgctctttcttagaaaatgatttggggctgcttttcattaaaaagcaaagccttaccaaggactcccatacccttactttctgcctcagtgatttcttcttaactcctatattggatatattgtgggttgttaaaaagtgattatggagtgaagtacaaaaaaaaaaatagccatatatcagttcttccatgcagtacagtggcagaaaaggatgtgatggcttagggattaagaagaaagcagtatgacagaaagatttttaagatcagagactacaaagggtctttctagcagggaaactgatactacaagatgatataagagaacgggggagagagtactttggagtcactgacggcgcagtttcagaaaaaattggggaattgaaagtgagagcataagagacgatattagatttataatatttctagatatttggggaaacattatccaatacaaatgcatggtttcttaacatttatttgtagaatgaagcatgaaactaacacaacattaagttgttagaagttcataggcttcaaaagtaaaagtggcaaaatctttttccaacagtctatgtaatctttcaaaatcatactaactgaaaggacaggaaatgggcacacttcctatggcaccaaatcaatttttatcttggcagaaaaactgattattacagctactgtgagccattgttattataattgagtggatcatttgtccagtatgtttttcctagtaaaagaaaaacatttgtggtttctgtggtgaataagaattctaacaccaggaaaaaaatgcaggccctctttttgttgttgttttgcatatatttgtttgtttgtttcagcaccaaatgtggctccttcagatgtaggaggtggaggtggaagaaacagagagctgaccataacatgggcggtaagtattgatgagttgcacatattataggttgctgtatctatatttaacttccaccccattttgtttcctgaaataaattgagatgaaagtgactgcctactgcacaagcaagaatatattactatttttttttcttaaatgcaaatcagattttatctggcttactgtggcttagtgtgtagctcctatgcaagaatgaatcctggatgctaagagatctgttagcctagatgattaaacattcagctgtctgattccagagatactttgatcattgtagtctggtaatctaattgtaattttaaacattgtctctggacattctaaattccaaagattccatttacaaactttgtatcaaaacccatttttaaattggagactgcctcctcacttgaagcttactttgatcactggtgtaatctagcatgataggtcagtcttagaagtcacccatgggactagttactgaggtatccaaagcattttattacagtttcgtgagtcaaagagttctgtatcagagactacaatctctagaaaacaatacatcttggctggatttttgaaataggaaagatattgggaggggtgggaaaagttgtctgacaaaactgtctgacttagacatctggcatttatccagataacatggtttatacagattcatttattcattaaatacacttagtgttgaatcactgcagatagtcaaagagcacaatttaggctccaaaggattttgaagactgtggaaaaaatgacaggttttattctttgcattggtcaaatggatttatttaataaatgaatgtttagcaaaacttgactcactgtgtgctttgtagtcattttctatacttagcatttaaatcacattttaaagcaagatttagcaaaaaaaaactaatctgaatcgtaaaatatttatttctaagtttaactgccaatgaaatgtccaaaaatgcaaatattataaaaattagaacatttcgctctttctcttatggctttttataaattctgtggatatctgctacagaataagatgggccttataaaaaattcagtattggaaattctcctccaaagattcaaattcaggtttctggagatagagcccgagagttgttatttttgaaattttcatagctgattctgttatactctaaattccaaaaactaagtagagaactatcaataagaaaaatgtttaaactattgtagaaatgttaggctatactatctaataatctaaaatcacatacctattaatatattgtgcaaccacatacagcttctaccatttgacctttccacatttctatatcttcctatttaatataagtatgtccaagcaatagtgttatatttacttcaaggttttgcctcaagacatcttaaatttgattttctggtaaaaaaaaaaaaaagtaaatatacaatgtgcacatttacctaaattgccaaaaaaggctaactgacaagtactcactagaagtagctgtaagtcagtttttattaataataggtgattagggctgacatagacttctttataaggcaatttacatgagtgacaagaaaccttgagaaaatgatgaaaaaccaagcacttgctttagaattggagatagaaacccaaagccatcctcctacaaatgagtgcaatattgtcccttcctccttgtcacctacttttattcctcttaccagtttcttttcgatcacaaggtagatattctaggctagagtcttatataactctcttaccattgcctttcaattctaatgaaattcatttgctcatccctttaatacatattacttgaagccctgttctaggtgctagggataaagaggaaaacaaaactgacaaaaacgctgcattcataaaacgtgtattctagtagttgagagagacaataaagtagataaataagtaaactgtatagactttgttagggttaaagaaaaacaataggtagggtgcgggacatggagcattgtgttggagtcttgcagtggcagaacctgtggtcggagaaaacgtcgaggtgattttacctcgggaaagtgagggggtgggaggagtcacataacatctaggagaacattctaggcagaagaaactgaaaggaaaaaggcccggagtgagaggcccctgaggtgttctaggagtagtgaggctacaatttggtaaataagatcatcccatgtttaagtatgtttttcctctgacatttggaaccagcactaatgtatgaactgtgtatgtttttacaaagagcacgcctccgtgtgtgtcattatccccatagcatttcctccctgttacctgtattactaaaacctactcaatcttttaatttctatttagcctttgtcaagagaataccactatggcaacaattttggttacatagtggcatttaagccatttgatggagaagaatggaaaaaagtcacagttactaatcctgatactggccgatatgtccataaagatgaaaccatgagcccttccactgcatttcaagttaaagtcaaggccttcaacaacaaaggagatggaccttacagcctagtagcagtcattaattcagcacaagacggtaggtgaaagaaagaccttcttacctgaggagggaggaaaaacgtatttctctagcaggcatttagtttgtttcctttcaggccttacttattaagacctttttatagcattatgcatttagtaaatgagtactattttgaaccaaattaaacatcaccctcttcatctaaatgatgagaatgttgctagagtctttttcatcatttagatcatgcccatggtatgaggaaatccccattaaaataattggctctgacttccatttttgggctcttgattataattttgtagtcagaaactctccatacttgaacagaatctcaacatgtctgtatattcataaagtttataatttaaaacttctataatatggccgggcgtggtggcgcatgcctgtaatcccagcactttgggaggcggaggcaggcagatctgtctggaggacagagcaagactccgtctcaaaaaaaaaaaaaaaaaaatttctgtaatgtatatattatatatattatttgtaaaatggccccaaattctaacctaaaaatgtgtttaattgcagcatttacgtaactttttattacaatacagaacacaaattttgttaaagggaatctagacataattatatgaaaaagaggtcagttgaaattgttttcttgaaaagggaaaaatttgtcctgtagggcatttaggaaaaaaacaatgctaataccagctctttttgtttttctagaaactttaacttaactaaccatggtcatagaagactttatatatttatacaaatgatacacagttttagattgagcataattacattattttctctgatttctgtttaagctgctatacttttgttatttatattcttgttaaaaataatacctttctggcctggcatggtggctcacgcctgtaatcccagcacttagggaggctgaggcaggtggatcacctgaggttgggagttcgagaccagtgtgaccaacatggagaaaccctgtctctactaaaactacaaaatgagccaggattggtggcacatgcctgtaatgccagctacttgggaggctgaggcaggagaatcgcctggacccgggaggtgaagttgccgtgagccgagatcaggccattgcactccagcctgggcaacaaaagcgaaagtccatctcaaaaaaaaaaaataataataataataatagctttctttattcatgtgcactgtgtaaataattaatgactagaaaaacaaatagagatgtcattgccttctgatctttggcaatgtacatttacccttggccaagtttctctttgcacatgtgtgagaagcacaaatagaagagcttgaaaactaaaggtgtgtgaggtactcttctatcattagaggaaatgggctctattggttcacccaacttccattgttttcactccaagatagacatttagccatgccttatacctcaacagaaattctcacgtatattcatcggtcacagaattattagttttagtatttgttaaaaatgtaatatataattaaatcatcctatgatctttacttttattaaacaccattgtattctatatatgtatgtcataataccatgtcatatgtcttaaatatacataacaaaatttaatataaaaggcagttattcatatatgttaaagtatatatgtgtgtatatataagtatatatgtatatatttaaagttatatatatactttttactatattttttactgcatacaaaagtatgtgtattttaatatatgtgtgtgtgtgtgtgtatgtgtatgtgtgtatttttttacttttaagttagcacaaccaaatatgtcaaaagaataaaatgtagaaataatttgtttattatcaaacagtggaaaagtcctgatgacaaacttatattctctatgcttgtgctcattcagcagaaatatgataacttggctgagcgtggtggctcatgcctataatcccagcactttgggaggtcgaggtgggcggatcacctgaagtcaggagttcgagactagcctgaccaacatggagaaaccctatctctactaaaaatacaaaattagccaggtgttgtggcacaagcctgtaatctcagctactcaggaggctgaggcaggagaatcacttgaacctgggaggtggaggttgtggtgaaccgagatcgcgccattgcactccagcctgggcaacaagagcgaaactccatctcaaaaacaaaacaaaacaacaatgaaatatgataacttcactcagttttaataatttgaagaacgagtacatcttacagataaaatgagtgtcttaagcattttacaagttaccttctcacctttttactgctttacttgatgctaaaataagttttcaggcaaatagcttgtcatctatttagtcatggctatttgtatttaattatatttctttcctaaatatttcatgagtctcataaaacttgcatgtgttgaaacttgtataagtgttaatctcttcttccactgctgagaaatcaatcatagtgctacacatttgccttgttttagaaagtcaacagtgttcatgtgtagaacatttttaaacattaaataggattatggcattttaatgaaagacaataaaaattgatcacccctgcttaaagccttcattggtttctttgtgtaaatttcataagggatgtcagttactttttttctgtgaacagagacctttttgatacatatttgacttgatgcccagttggaagattagacatataaaagctttcttgagcccaggaaacagtggatgttacaacttgtttcaaaggctcttaaaaatttttttttaaagatcttagcttgaacataaaaagggaagttttattaataatattgctgtttgtagttagttcacacaaatagcaaataagagaaaatgtattatattgaacaattttctataattccaaatttcctatttctgataatatagagttgacagctaaatattaataattttaatttgcatcaacaggctttcttaagcatatcagttgagagaaattaaaaaaatagtttttttttgctcacagatgtaatagaaattgatgaagctttctgtatttggtaaaagtgtgtgtgggaatgtgtatgtgtatatgtctatattaacatttatgtaaatgaatgtgtgtgtgcacatgtatcactaatgccataaaataaagtaacattagaaaaatacaggaagaggtaatgaaataattgcacttagtttgaaaatagtaaagctattttagaaacattaaaattaaagtatggtccaacatcattcatatagcaaatgatgctattcgaatttcttaaatgtaaatatctcactaataatataatgttctcataaaatttcagctcccagtgaagccccaacagaagtaggtgtaaaagtcttatcatcttctgagatatctgttcattgggaacatgttttagaaaaaatagtggaaagctatcaggtacgttaaatttttatcaaactaaatacatttattcataaatatataagcatacgttttcaaatgtgttgtatgtttcaatgtcccattaatttatgtggcaactaatactttattctctgtgtctagtattgtggtcatatataagttaattgttaagaataaaacaggggttcctaactggcctatctaggggagatgtaaagaaacctaagtcctggcaaacaattggccaaaataaaaactatggtaataacacttatgattacccaaggtctttttaggaaaacattctcataaaaagctagtgaatctcaagttttttggaaagcattttggtaatttatagaagcatcctgaaaatagtcatcctctttgagtcagtagttccatttcgaaaagtccctccaaagtaaacaattttaaatataccgaatatgtcttatgttatctatgaagtaacaatcaaaatgacccaaataaaacttcccttgagcttaattttaaagaaccagtaagaatcagtcagacgcaaatgagaaaacttgtcttagtcaagggagtaaaaactggaaaatcaaaactagagagattagttagggtctttaatacaatgctaatgcaatttagactgagttatgtaggaaatgtgaaatcatcatctcacatttttaagtgcaagaagtgaaaattcaaaggaattaacatggtttttcctttacagatgagcaaatggataccaaagagatttgacaacttgcctgagttgtcacttacagaaagtgtcagagcagtgtctaaaactcaagttgtctgattcaaagttcggggttttattgccacacatcacagacttccctgttttttttttcagtgagtgctgtctagggctgcctctccacccaccccactcccccagccagcttgcattctcagcttcagcaccctcccttatcccttgtccatggaatattagccccatgagggcagggtattgttctattctcagtgccatgcaagaccagtgctgagcacctggcaggctctaaatagatattaattgaatactgataggaataatgaagtatgattaaataaaatgttacaattgggctttctcaaggccatgtttctgagatgtagctgtaaaagaaactcaaggctttgagcagacacacccagaccaacaggaagctttttttttttttttttgacacaataggttataatttgggaagatcttaaagagccctcagatcatctatgcaagggttcagctgaatttattacagtacacagaagagtagactgggaataattagactgagaatacccaatattcataacttactaacctgacaattgtgtttgcggctagtaggaaagagagaaattcactagatgttacaaacccctgtaataaatacgcctgaggtatctttgggagaagacatcaatgtgtagagcttggaaagtaaaattttggagcacaggatttttttcttcttttatattatttatttctaactaataaatattgaaaaaaggataatttaacatataacccatatcattgagtcaaaatgccaaatatatgacatattttactttatttaaaacatgctagaaaattatatattatctttgttaatgccaagaattatatattgacgatttgcttacttttaacaagaagaagacaaaagaaataagaggtaggaagcaacatagtggaaccaatgattcagatgataattaaattaaatatgcttttttaattgggaactaaaccttgattaaggattttcacatagtcagtaaaaagtaatctttatcaaagaagatttttttcaaatgataatttcaagggaaaagtatgtaccatgaggagttggtttcacagatgtctgaccttttccaacttacattaagtaaaaacttatgcactttgctgctgagcaaacatgggtttatatttcagctctgtcacttaagaattttgtagaaaattgatttgaactttgagtttcctcacctataaagtgagaaagtaaccactgcctcatagaactgttatgtgaaagatattaaataacctgtatttaagaattttccctgtttatgtcattgggcattccaagatggtggtgatgatgatgatgctgatggcagtgaggaagatgatgatgatgttaatgatgaaaagactgataacacgtcttgagttcttattgtgctaaacacttaactaagctcattttattaaatccacacaaccctagaggatagacactattattatccctattttagagatgaagaacttgaggattagaaatgtttgtctgagtaataattgtcataatcagattttaatctagttcttgcctctccagagaacggttgattaaaattgctggaagtaaatcatagaattattcttcccattcattctttcttaaaatccttttaaaccttttacacagggtcttggatatcaaagagacaagcacgaacacttaaaagagaaaaatccatattatttattgttctgcaggaaatgctcctgtgactgtggccggtaggggggaggggggtcttgactgactataatgtggttattgtttccattttaaaatatgatgggagaagccaatggtttaacaagatagatgatggtgaaaaccaataccccaatgcacttcccatgaaaatgtacgatggatctctatttttctgtgtataaagatacacagaaagaaagcagcacattgaaaacataaaatataaagctggaaagccctgactcctgcctgattgacaccatctcaaggttcatttcctgacatttcaaatgagaattgtgagcaattgaatttaaagacaatctcttcccttgtggttttaaagtgtatctcagtagaatgtttatgtcacttagtatttttttatcttacttggttaaagagctccccactttcaatcttaatacccagggagtttttctatagtgtaggtaagctagaagaatacaagaagtctttcttatcaagggcattttggaactttgggctcttgcccaggaatccacaaaagacttagtttgctcacacagtgggtaaaatattcacttaattaatttaacaaaaatgagtaaaataggctaccaggaataatgaatgcaaaaactttagcacctaaattagagattaatgcagatgactgatttcagtcatcataaaagatgaacaatcctgtatagtctactcaaatatttttaaagtttaaattattatggtgagccgaaactgattacttagaaagtgctttattttcttattttggagaagacatccgttttggtctgaatctctttgaaacagagcctcaaacaaagatgtggagaaaggttgtttattattgttgttaattgtttgttttcaatatgatcctaggaagcaggtatgaggaaaaggcagagtgaacaggaaagaggggagctcagatacaaacgtgctatttgtcttgttggcaaccactgtgggcaactggtactccatcccttgagacctttgaggagttttataaatgtgcctctgaagctgccctgcttgggatgaaaagggaagcattcatccacttctgaatgtccagaaatgtgctcattcaacacataaacctcacttttgtgaagtgaatttgagccatcctgttgcacttcataatagtttcttacatgtttatgtaaataaaaaatgcaggattatattattattagacattttaatctaggcattttggttaattgtgaaattacaatcccgttattttatagacagggcatctaaaatatgtaaaatatcaggatagttacaaataatccttttctttttattcttatattacatataacatatttttattcattttattcataccttagatataattataaatcttgaatgcaaaaaagcctttatttaaagatgaaaattataatccataacttttcttaaactttaagagaaaagtaatcctgtaattatttgacaaaagtaatcatttctaatgaaaaaatcgataacttttttaaaaattattttatgggtaaataatttctacagtttatccagttattagatatatttctttgatatctagcttctatatgggttcaaaggaaataacattagatacttctgaaaggaggcagaagaaagtattactttagcgtattctaggccacatagtaactatttttatccagcaaaattatattcctctccaactgctttaagaatggctcagaagaagtttgaaatcatgcaaacagaagtaaaacaggaaataaatgataaaaattatagtgacaaatacttccaaatggagaccacttttatattttgaaagtaagtctgcttcaaagtttttgggatttttaaattttttattttttattttttttagtcaatgtaaaacaattttgggcaatgaagtaagactttgattcgcttttggcatctttagtcattcctgccctgtatgctttactatattctaaggctgataaaagggtagatatcattaagaaacatttgaaaatatgatgatcagccaacaccaatggtaatagaaccagttgaagagaacttttcatagctgaagactctaaatcatggcaaaatataactcatcctgaatgtttgcagattcggtattgggctgcccatgacaaagaagaagctgcaaacagagttcaagtcaccagccaagagtactcggccaggctcgagaaccttctgccagacacccagtattttatagaagtcggggcctgcaatagtgcagggtgtggacctccaagtgacatgattgaggctttcaccaagaaagcacgtgagtctcacgttttgtttttagacttgtcaaaaactaccactggattcaatcatgatacgaatatatttgaaggaaatttcctacctagctacctgagcacatttttcaatatcctttacagccacacaagatttcccttaaaacgtgaattattgtagatgatgaaaaaatgtgaaaaataccctcacacgttaaatattccattatagaaataaagttagagaactatccttttgtaaaggctgtcctctcaaattctgtgccattaacttgtctttaccctgtacttattaatttaaacattgttttcataggagtacatcaacagcatgtgaaaactaaaattctgcttatttttacatgctttaatttataaacctctgtcattgcacagtgcaatgcaagttaagtgtgtagcattatgcttactctcttattactgtatgttctagtactgtatgttttaggtggttcataaaacaagaccgcctatccctgctcacgttctggtcattctaatctctctgggttcattttgatatctctgttcttgaacccaagtggaataagtaaaaaggagaatttttatgtaggactctagggaatgtctcaagaatctgaagatgtgattaccattagagtgtgaaaatttatgaaattcactttgggacagagactctcccagtgagatgacagaatgtagtgacaagaactagaatttggtgtctaacatgtgtttgagatctgtctctgccacttgctagatgtatgacaatagataaattacctatttaaacctcagttttctaatttgtaaaaggagcattcatttttgttctttttccatttgttcatgtatttattcattcatcaaaaatatgctgtgtgctcagcactattcttgatggtgaggatacaaaagggatcaaaccagtccaaggtgctattctcgcatggtttacaagctaatgaaatgagatagaaacttcaaacaaacacaaactctgacaaataaataagtgggattaaagcagctgacagggcaataaaatgaataaatagacaaaagtaaagtgacttagataaaagtgaaattctgattgggtggccaggaaaggcctctgagaagatgccagttaagctatgatttgagtgataaatgataagaagaacccactatgtgaatagctttaggcagagccttaaggttctttgcactctaagtagtacaaaaccttaaggtgaagagcacttaaaatattttaggtgtggaaaggccactgggtccagggcataggttctgagtaaggagggggaagtgttctggggcccaattacggagaaccttgtaagtaattgtgatgagtttgagttctttctaaacatgataagaagccattgaaagattttaaaacagagagtgatatctaatttatgatgttgtttttaaaaaagtcattctggcatctgtacagaaaatggattgtggtgggttaacagtggaagcagaaaagccagttaggagactatttcagcagtcaaggagagaattgatagtggctagcactaagtgaaaatggagacagaagtggaaagttttctgtaggcagagttgacaacttgctgccaatttggatgttggcaatgagtgggatgagagactaaataccaaatttctgcttgagaaactagggggttggttgtgccatttgctgacgatggcaaagagtcattggagaaagatttgaggatactcgacattatattacatttgaaaaatgtattacatttgattatattacatttgagaaatcttttagagactcaagtagaaataggctgatatctgcctagacagagagacctatagccacatatgtctagaggttgaaagagagattagggctagagacagaactgtgaatatttaaagccatgggcctaagtgtcagtacttagggaagatccacagagagagtagaaaaggtacatagatgaagtcctaaatcatccaacagttacaagttgacagagggagccagctaagcatgaataatgggaagcagcagcccatgaggtagaaggaaaacccagttgttaagatctgaatttaagaaaaaatgagagattcaagaaagaagatggtcaattctgtgaaatgctccaaaaatgttaaatttaaaaaagaataatcaagtgacattagatttaaccaagtggaggtgattgatgaccttgcaaatagcaatttcaaaagactagtggagaaagaaacccaagtggagcatgatgagaagagaataaaagtcatattacctagctcacagggccatggggtacattaaatggactcatggatgtaaagtgcttagcatagtgcctggcatatagtaaacacttattaaaactagatggtggtggtcattatcatcagcattataatacctgatgcaatagagtatgcagaattgagattggatatagtgaccactgattgcatattactacttttcacagctcctagccagcctccaaggatcatcagttcagtaaggtctggttcacgctatataatcacctgggatcatgtcgttgcactatcaaatgaatctacagtgacgggatataaggtatatacaaatagtgatgattaatgtttgcaattcttgctatttcagtgaaacccaagatgggtttcttttctttttttgagatggaattttgctctgtcacccagaccggagtgcagtggtacaatcttggctcattgcagcctccacttcctgggttcaagtgattctcctgcctcagcctcccaagtagctgggattacaggtgcccacacccacacccggctaatttttgtatttttagtagagacagggtttcaccgtcttggccagggtggtctcgaactcctgaccccaaattatccacctacctcaacttcccaaagtgctgggattacaggcatgagccaccacggctggccccattcaactttcttattctatttaatagttgtagagcagaatcagataacgtagtgccatgatacattttgaaatggaaaacattatcttcagtgaatttcagcaaaatgttatgtcaaaagtgtaagataagtagaatactttaaagataaaatagaataatcagagcttaaggaggagagagaacgaaactatttttgtttggcaatgattatgatagggttgcccagcacccagaaaactccttgataaactgagttactgtttataaatgaataaaaaggagaaaagcttattttaaatatattctttatatcacacactatcacatttttcactggataccaaattttatggaaaatggtaaaaataaaaattgagagacaattttcagaccatttcaatatattttaaaagttctcattttggacttttttcttaaaaagactcattctttctatatttttattttgggtcatctcaaaaaataaaattcagatgcttaagtcacatctccttggataatcctacaaacttgcaaaaatcaactattgtgaattgaaactaacatgatttttttcatctagttttaaatttagtttttcctcttgttttaaatttattactttttgttaatcaaagtataagcatttttattctggttttagtgttagagcattggctcattattatgactttactgcatatttacatttctgtactttataaggtactctacagacctgatggccagcatgatggcaagctgtattcaactcacaaacactccatagaagtcccaatccccagagatggagaatacgttgtggaggttcgcgcgcacagtgatggaggagatggagtggtgtctcaagtcaaaatttcaggtaagtgagtcatttaagacacatttcaactaagtacttgtgagtttctagaccctgtggattcccaagggtagggataagcctgatacaccagtgtccatattttcctaagtagattggacatatcaaggattccctgaaacttggtatttctcctcttatgagtcacaaaagtaagtctgtgacataccacatacttcttgattattatctggatgtcaaagcacagttgaaatctttcagacataagacgaacgagtttttgggatccaatatacagtatggaacatattagtttatttgattgtggtaatcattatacaatgtatacatatatcaaatcttcatgttgttcaccttgaatatatttaatctttgtcagttaaatattttcaaataaaaagcacaattaaaatggcataatttattgaatactatataatactaggctattatttaataataaccaaacttctatcaaaaggaaatacactaggctatttttaatactcttataactctttcacttggactatagatattgatatagtagtaaaagagaaaaacactaaattatagcccctttgtcttttctctttctctatcttatctattccttttctacaaactctatttctcacacctttgtttgatttggaaatacatatatttgaggcagtcatttctttttttttatttctggcaatctgttatttaatttttgacatatttttcttaacctatatgcatgatatagtttaattatactgaatttcaatagatgttaatttgagaaatgtatgagaggctttgacattaccagaagatcctagaacaaagatgataataaataatttataagaaaatttggttaatctgtacaacaaaccccatgacacaagtttacctgtataacaaatctgcacatatacccctgaacttaaaataaaagttaaattttaagaaaactaaaaaaaaagaaaattgaaaatttggtgattttgatataaagaaataaatatgctatatattaaaccaacaaaaaatcctttaccacaatgccagagtatttaatggtatttaataaatgctggcttcaattgtatgccatgtttttgtgaagtttgccacaatacatatatacatcctttacaaatcaaaatagaactttgattttttttagtttaatcatcagcaattttgtcttttaagaaaatagagaaattacagagatgtgaaaggaaaagaaaataatcatgttccaaataccctaaaatagctactgttaatgcttagttgaatttacttatagtcactctgtatacatatataatttcatgtttcagcttccatttttgtaaattatttaaaaattataaatgatattctttcaaacaaatatgcaaactcattaaagtttttttctatcataaataatacttttagagtccattttcataaattaatctttcttctggttaaatttaagacaaagtgttttaggttgctaaatttcttcaaaaacacttactaatttctattcctattatcattgagtataagtgcttttctcactgtaccactctaatattattgtctttttagtcattgctaatttgacaggggaaaatagaattttcttatttttgaaacattttctatattcagaactttgtcaacatcttcaatagttttacacttagtgggcagtttcacaaaaggaaatcagagggaaatatggccattatttcaaggaaggtaaagcacaaataactaaataaattgctcttgaaccctgggccttctttctcttgtgtagaagccagccacagcgagcttttgctctctgtactcacccttggttcatcattcctcaccgaaaggagaacctagcttctgggatttagactagaggttttcagcaagagatgatgtagcagtgatggtaacatcagtttacctatcactaatggcactggtaaatgttaaacagtagaatcactagggataggggaaagccctgtttataatgtttgcctgtttctgtggtgtaaatattctcattatgtgtgatttcaagctttccaagtgatgtcacttaatatggagctgtgaagagctacccagtagcacatcattatatgtaattgccaccatacaggtataataagaacctaaaaaacatttgacaacattataatatagtaaaatattaagaaatgatgggttttgagtatttactacatttgttttaagcttttaaatttaagtttacataaattctattttaataattacatttttaacacattgctcatacatttcctaaaaatttaacaattggatttcaggggttgtatcggttgatttcagcataccacagctgtaatttgatatttcagtatatatagctcatgtatagaagagtatttttttaatcccaaacttaggatatttttcatatttttctctttttgccaactaatggacaacattcttattgattttagaatttctattatttatctcttattctgaccataactgtacaaataaactgtagaattaacgttatgaaatgtcagatgcttggtgaataacaccattctagaatattcttgtttttaagtttggattttcaaatcatttaaattattttaatgaggcaaatgtgtaaatacaaacagaaattacaggtttttttctaaatttaaaagactcttagtactttcttttggttttcatgccctaaatacgtagccaggattataacacactactagatcttaatgtttataagcattatgctgtttgttcattcattcattcaacaaatagacattaaatgcctacaatacagcaatcacagttcacatatttaaaatgtgctaagatttacatatttccacatctctgcctggccctgctgcaattctaatgatcctcttgcctcccagtgttggcctctcaaggcctattatctatgcaatagacaggggggttttttaaaacacaaatcaaatcatataactctcctgttagaaagatggctcacagggaatggtgtgaaccctggaggtggtgcttgcagtgagccgaaatcgcgccactgcactccagcctgggcgacagagcgagactccgtctcaaaaaaaaaaaaaaaagaaaaagaaaaaaaagaaagaaagatggctcacaggtaacatctacatttcttactgtggcctatagtggtctatataatccaccctctctctcatctcaattaagtgctttgtccctttctctgttgacatttctcttcttgaacacaccagtgttatccctgccttgaggcatctctacttgttctcccttctgcctggaattctctggatcttggcatgttagtttcattctcatcattcttgtttctgttctgatgtcacttcctcagaaaagctctatatatggccagcaattaaggtagcaggctactctgagtaaatcttccttatatcatagcactgtttacttttcatcctaatgttagtaaccatgtaaaattatcttatttattaatttgtatttgtttatcatgtctctccatccttacttgaagctaagctccatgggagcaagctcttgtttgcctcagttgacctttgaatctccagcacttaggggactatctggcatgtagcagggttttaaaaaataactgttgaattaattcatgatttctgtatagagaaaagcccactaacaagaataacttgggcaacttaaaactatagttttcatctctagaaaactgatatacttccccattaggttcatgatttatattatttcatgtgctgatccgcaaatttgattcttaaaaaaataagacttccttttagacatattttggaaatatttcagatttgattatctgtaactgcacttctatctgacttgaacactgttatccattgctttaataacttattccttattgaatatttgtagtgcatatcaaggcaaatgtaacaccacaaatgtttcatcacacatatactatctctaataattctatattatccttcaaaaaccgtttttaataattatgagcaaattaagaaaatatacatatagctataattttcaatattaatttccataagctaatttggattactacatattttctataaattttagaatatcaattgacaaggatccttggtcataaataaatatcctcagagaagcacatatttaattatttgtagtgagcatgcatattttaagtctttacttttctttttagttttaaatagactatagatagctgaatcaagaaagactgcagaacattttagagtctgaacatttttctacggaaaagaagtagtcatttgaaatttttaaggtaggagtaacatgatcagattttctcacttggaaaatcatattggtgattgtcgaaaatatgtataggaggggactaagatataaggagatgaagtaccaggttattgccatagaatgattaaaagataatgatgtcctgggccgggtgcagtggctcacgcctgtaatcccagcactttgggaggccgaggcaagcggatcgcgaggtcaggagattgagagcatcatggctaacatggtgataccccgtctctactaaaaatacaaaaaaaaaaaaaaaaaattagccgggcgtggtggcgggcacctgtagtcccacctactcgggaggctgaggcaggagaatggtgtgaatccaagaggcggagcttgcagtgagctgagattgagccactgcactccagcctgggcgacagagtgagactccacctcaaaaaaataaaaataaaaaaataatgatgtcatgatgtcctgaactggaaagaaggcagtggtggatgtctagggtagattctaaaagagcaaggcattttttccatttgatttaaagttactatatattcattttgtgtattttgtcttctaataaatctgtaatttatcctgatattaccactgatgatgtaatctgtatatttaacctaatatttttgttaactccaagatattaagttaaactgtataaccaaacccactgacttaaacactgtgatggaaaacacattttgttgttttgctttgtcctctcctgccagtagcagaagaaggtctagaaaactattttttgggtagaacttttatatgtttaactccatcactactcctgtcctcccttctccatttcctaagtattgcagtgtaagagggacaagaggatagtaggatgtttagattcatttcatatgttattacatttagtctgtgattaagatacaatcagatattatcattcaggaaatgctgtctcttcaaccatcttgaaataaccaaatattttgttttcctttaccccatttttcatgggatcaatttgagtattcaagtatataaatctagcctatatattttagattgacaaatagcttacatttaaattacctctaaaatgcatattctcttcattaccattgaatcatgactaatcactcaaagccttgcctaaccacataaatgtacttagcactcccagttttgtaacaaacatgaagttggaagataaattatttggacaaagtaatattgtgtgagtctctaaattcaactttgggaggcaactcatagccttgatgattattaacataactcctgcagtgactaggtttgatccagcagttgttggacaactcccagcacagggagtttccagagccttaattgtccttcagaagctttgagtacaacttctagaagcacattttaatattttaactatatgtcaggccgtgaacagcacctctgtatctaaactaacctaggttttttcaaattttccctaaggtttccattagctgctaccaagttctcacaacaacttcaatattttattttgctcatttagttagactcagaaataattttgctgaaacattccttgatggaacacatgtaagaatggaaaggaaattttaaaataatcctccaagatgtactttctaccagaataattttcattaatgaaataaagtcttagcctccagagttatattttagtattataatgtgccaatgatttttttctacgataaaataaaacttactcttcaaacattacagattttcaaaaacattttgttctctagtaaattaattcattcaataagtgtctaaacaccaaccatatgtcaggcattctgctgggctattggttacaataattgcaaaccctcctgaagctcccattctaatggatatcagaagaataaagaaccaacaaacaaataataaaacaattagatttaataaaaacacaaggaaaaatgagtggctctttatatttttctttatatttaaagagaaaaacaggtacacaagtttttggtaggatgattaggtcaagcctcactaagaaggtgatgtaggctgaaatctaaaggacaggaactagccatatgacaaaagtgtgggtaaaggaagagcttgtcatgtcaaggacctgaaaggaggctggtgtaactagtgtgtagtgaggatacagagtcatatgggatgaggttggagaggtaagaggggtaaagttatgaacagcctggcattgattacatctaaaaggcaatactcagatgtttgtaatttcttgtaagttcaatagaaaaatgttgatgtgctttcaggagatgaaggacatgatctaatttaagatcatttgctgcttttgtgcagaaaatagattggagtgagacaagaggggagggagttgatagagctagtgaaaagaaagcaagtctgagacacaatcagaacaaggcactctctttcagaaataattaatttataggctactgtaggtttttttatgactctaagaagcaaagcaaatcatgacaagatcttttccaggataaatggttaaagagtgtatgtgaagactccagcttcttcttttctatgacttcccaattcttccccttctgccttttggtggcaggagagtctggagggaatgtagtgtccacatttttaccccagggagatgcaggagggcattgagagcaagaagaatgatgctgagattctgagagaaaatgcttcataccttctaaaaaaataaagagttttttatggtaatcatcaagactaacttagagaaccaagccaaatgtggactttttaggaaacatgaaatgaaatgaaagaaggacaataaattagctcttagcttctaaatcagtttcatggtatataaattgatatttttagtagcaccattaaaattatagaacaaaagctccagatgttgaagtgatatgatgatgatatttacaagcaagatttacccaagattcagaaaatagtgattaatataacctaatcaccaaggcccacagataatagtgtagccattatatttagttacttcccatattttcattttcagtattatgataacctcataatggatatctttgtatatagaccttttttctggattcccaattattttcttagaatgattgctagaagtgcaatgactggattaaagggaatgactttttaaaggcttggcatatacttgccaaactgtcatctaaacagcaatgcctgcattttatcattaaacaaatttttgtagcattttgtccttttaaaaatctttgttaagcaaaaatactatttcactattttttgttactattaatgtaaatatacagatgtatttgacagctgtttatagttccatttctgtaaaattctgttcatgccctttctatgtttcatgttaagaactttctttaaaatgttataatcaatgtataaaggaagattataaaacttttcctgccatatttgtgtaaatatttttccaggtttgtttttaaatgttattaatgatggattggtatggtttatttttatgcaaaatgatgaattctgattataaaagttcccaaatatttaacgttgaacataaacagaaagtcacaaaataatacatataaggtcatgcatcacataacaaagtttccatcaatgatgtaccacatataagatggtggtcccataagattataattctacacttttgctgtaccttttctatatttatgtatgtatatatatatacaaatacttgccattgtattacaattggctacagtattcagcacagtaatatgcttatgctgtggaggtctgtatcctgagagcaataggttataaatacactatgccttctaggtatagtcatatgttcgcacaatgaggaagttgcctaatgacatttctgtgaagacattcctgtcattaagcaacgcataactataagcccatttatatgaagtttaaaattagaaaatacattgatgtttaaaggggtttgtgtgtttaatacacacacacacacacacacacacacacacacacacacatatttatatataacatgtgaaacttcctcaaaaaattcagtccagtgttgcctctgtggagtgatgggggaattatcaggaagaggcttctggggtagtgcctgtgttctatttatttgcctggctggtgagtacaaaggcattgatggtattgtttttaaattatgtttttaggccagacatggtggctcatgcctatagtcccagcactttgggaggccaaggtgggtggataacttgaggccagaagtttgagacaagcctgaccaaagtggtgaaaccccatctctactaaaaatatgaaaattagccgggcatggtggcacacacctgtaatcccagctactcaggaggctgatgcaggagaattgcttgaacccaggagactgaagttgcagtgagccaagatggccaccacatgctagcctgggcaacagagtgagagtccatctcaaaaataaatgaataaataaataaataaagttttaaaaattactaatttacataatttattttaaagtggcaaaagtcaaaagaaggttgaagtagttgagtaaaggatagttagtttggcactttggaggtctatgtattagttttctagagctgtcatgacagtacacagactgggtggctttgttcattttctcaattttgggggctagatcaagatgttggcagggttggtgtcttctaaggtccctctccttggcttgtagatggccgtgtcttcccatggccttccctcagtgtgtgtgtgtgcaagcatgtgtgttgtactttcttcttcttataaggactgatttgtattgctttagacccactctaatgactttattgaaagaccctatcccaaatgcagtcactttctgaggtactagggggttagaacttcgatatatgaacttgagagggacaaaattctgcccaaacagaggtcattggtaggttcaagagagcaactttcacaaaatagtgtgggtgaaagtcttatttctctaagcaaacctcatagaactcacattttaaagcgaggaggcaaaataaataatatatagcaatacataaagttttgtcagatagtgatagtatctgaaggtagctgaggaaggtaaagagaggtgggagagagcaagggcatctgttttcactaagagtgcagggaggggcttattctgataaggaaatgcttgaaaaaaaatggaataaagtgagagaaaagttgaagaagttatctggagagaaggaaatgtattcccaccagaacagtacgaaagccctgaactggctgtatgtttagatgttcaaggaacagcaaggagaccagtacggctggggccaagcaagccatgaggtgaatctgaatcatagagttttataggtcctgattaaggactttagattttatcctaaaggtgatgagaagccattgaaccagtttaaggtgggaagtgacatgatcagatttatattttacaatagagcatctcaaccactctttggaagggaagtagaaatctcatgaatggtggtgcaaatctctgtgaatctctggaaacagggggatcagttaggtgatagtccaagcaagagatgaagatagctttgactagtgtactaagagtagaagtgggaggcagttatattaaggatttatatggaggaagacccaacagtattttctgatgattttatgaggtatgtgaaatggatatggcagaactttaaggatttagacagaccagcacaatcatctcctgaaacaactagcagaattatatattaaaacagaatcatctactgaaaatacatgaagaaaagaaggagtacttcaaattttgacaagctgagttcaatatgctagttcaatatgcctatgagacatcccagtggagagagagaaaaagagaatcatctagcaaaactgagaaagcagctgaggtcagatgacataaacttgtcagagaaccaactggcataattatataactttatttgcaatgcataccagcctggatggagatggaggaaacagagatagcagatgtttcttggtgttgcccaaagttggcaaatggcatggttaatataagtggagatcaaggaaaacaaggatttattacttctagttaaagaataattaaaattgctgaacagagtcagtattatatattatgaatattagaatattttcagctgttagtaacaaactctcaactcaactctcaactcaaaattgcttaagaaagcccctgtggaatcagtgtctcaaaaatataactaaagaacaatttttccccatttctccacttgagaggcctcagcttcattctaaggcttgttccctctgtggttgaaagattctgcagatgtgttaggaatcacacagaccctataatgtccaagaaagaagagggtctgtctcttttgaagcttcatcttcaaaggaagcccagcttttaacagaagctcctcagaaaaaccttccccataatgttcagaagtgtgtcaaaagtctttccttaaactagttaaatatcatttctataattgctcaaagcgatcaagattcatggctggtctgtgattgagaaaaccttccttgatgagtgaataatatctgaacaaaatatgaagagtattagcaaagaagcagagagagaaagattttttgcatgatgttcaaagttaaatagtgaggtaaataaacacagacataggatatacatttagagaaattagagacgaggaaattaggtcaaagagcagcttcataaaaatgcagagaaagttactttgggcagtatggccattttcacgatattgattcttcctacccatgagcatggaatgttcttccatttctttgtatcctcttttatttcattgagcagtggtttgtagttctccttgaagaggtccttcacgtcccttgtaagttggattcctaggtattctattctctttgaagcaattgtgaatgggagttcactcatgatttggctctctgtttgtctgtgattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgactaccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttttgcatctattgagataatcatgtggtttttgtctttggttctgtttatatgctggattacatttactgatttgcatatattgaaccagccttgcatcccagggatgaagcccacttgatcatggtggataagctttttgatgtgctgctggatttgacttgccagtattttattgaggatttttgcatcaatgttcatcaaggatattggtctaaaattttcttttttggttgtgtctctgcccggctttggtatcaggatgatgccggcctcataaaatgagttagggaggattccctctttttctattgattggaatagtttcagaaggaatggtatcagtttctccttgtacctctggtagaatttggctgtgaatccatctggtcctggactctttttggttggtaaactattgattattgccacaatttcagagcctgttattggtctattcagagagtcaacttcgtcctggtttagtcttgggagggtgtatgtgtcaaggaatttatccatttcttctagattttctagtttatttgcgtagaggtgtttgtggtattctccaatggtagtttgtatttctgtgggatcagtggtgatatcctctttatcattttttattgcgtctgtttgattcttctctcttttcttctttatttgtcttgctagcggtctatcaattttgttgatcctttcaaaaaactagctcctgggggctttaattttttgaagggttttttctgtctctatttccttcagttctgctctgattttagttatttcttgccttctgctagcttttgaatatgtttgctcttgcttttctagttcttttaattgtgatgttagggtgtcagttttggatctttcctgctttctcttatgggcatttagtattataaatttccccctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcagttttgagtgggtttcttaatcctgagttctagtttgattgcactgtggtctgagagacagtttgttataatttctgttcttttacatttgctgaggagtgctttacttccaactgtgtggtcaattttggaataggtgtggtgtggtgctgaaaaaaaatgtatattctgttgatttggggtggagagttctgtagatgtctattaggtccgcttggtgcagagctgaggtcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgccatccccctcaagctaccaatgactttcttcacagaattggaaaaaactactttaaagttcatatggaaccaaaaaagagcctgcattgccaagtcaatcctaagccaaaagaactaagctggaggcatcacactacctgacttcaaactatactacaagtctacagtaaccaaaacagcatggtactggtaccaaaacagagatatagatcaatggaacagaacagagccctcagaaataatgccgcatatctacaactatctgatctttgacaaacctgggaaaaacaagcaatggggaaaggattccctatttaataaatggtgctgggaaaactggctagccatatgtagaaagctgaaactggatcccttctttacaccttatacaaaaattaattcaagatggattaaagacttacatgttagacctaaaaccataaaaaccctagaagaaaacctaggcattaccattcaagacataggcatgggcaaggacttcatgtctaaaacaccaaaagcaatggcaacaaaagccaaaattgacaaatgggatctaattaaactaaagagctcctgcacagcaaaagaaactaccatcagagtgaacaggcaacctacaaaatgggagaaaatttttgccacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacatgaaaaaatgctcatcatcactggccatcagagaaatgcaaatgaaaaccacaatgagataccatcttacaccagttagaatggtgatcattaaaaagtcaggaaacaacaggtgctggagaggatatggagaaataggaacacttttacactgttggtgggactgtaaactagttcaaccattgtggaagtccgtgtggcaattcctcaggggtctagaactagaaataccatttgacccagccatcccattactgggtatatacccaaaggactttaaatcatgctgctataaagacacatgcacacgtatgtttatagaggcactattcccaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggggaggggggtgggatagcattaggagatatacctaatgctaaatgacgagttaatgggtgcagcacaacagcatggcacatgtatatatatgtaactaacctgcacattgtgcacatgtaccctaaaacttaaagtataataataataaaataaataaaaaaataaaataaaaaattcagagaaagagtaatggaaatttacagaaaggctaggatgttagcttcaaaatgcaggattgttttggattcaagaaacagaaattgctgacaagatggatactgagattaaaacaatttatgatgctgggtaaattgccaaggattatgtcaataagttgagttgtaagaattctggtgcaaacaaagtcagtaaacacaggtttatcctttaaaaatatattatttggctctatcactgttaaataacatttaagtagtcaagtagagaggaatatttaaggattggtttacatcattaatgacataaaaattgtaaatgtttttgttttgttttatattttagattagttattccacaattttgaaatctatgaggcaaatccttcacctcaaataactgcatttggtgatgtgttctaaatttagaatgttatactgggagggtagaatctggaaagaatattgctgaaggaactaaaattggaatctagcatgaggaggaactcccatatatagtgagtgctttggaaaaggacgtcagaaattaaagaaattaatcatttttggagaatgtaattatagtgaagaattttcggagaatgaaccaatagtcctaagggagatacctttattcaaagatgatttcatttttctgagtattgggtattagcaaaattttaattttactaaaaagtaatgtgtttctcttacctgtaagtataacaccaaggtttgagaaacttcgttgtaaagtttcaaccaatttatgatatatgcatgaataaattattcatgagaaaatggataatcttttacaatgatttatatgaagaattttaattattggtaagcctaattttgtatttttctatgaatgttgatttactaatgacataaaaagttacattaagatatctattctttacactcaagtggattgaaaacatcctgttcctaaggatgaactaagatacacctacccccgccccaaatcataggatattactttaccttctcttctgaaataagagcaacacaaaagttaattaaaacaatcagattatctttaatagatatatgcatcaaccatcagaacaagacttcaaaattcactttcctttgaaacattataggctgtgttgaaatttgtaaccctcttaggaaaatataaaaacaattgtctgttctgagaaagggagttgggttttaaattttctctcctgaggtttgacacttattcactataacataaatttgaaaaccatttagaaaggaaagtgactttgtgatttttaaaaataaaacccttgaaatttctcataaatattactggaagcctttaatgccatagtaagagggaatataaaatgcttaaactggaaagtgatatgtcaacatattaaaatggtccattcgatactacattagggaccagctttagtgatttatgaaggagcatttaggtctcaaagtaattcccatagttgggtaaggctagaagccaggcctcttggtagattcttcacagtatgagagcagtgcaaaggacattccagaggcagtttttatagacacattctgcaaaatcatccagaccaaaacaaaataaataatttagaacaatttcaagagtatgagattatccagccagtagtccttcttctataaccttccattttagggcctgcatacttgactctcacttctttttcttaaaaatgggctcaaaagcaaataatcagtcttgggtcacatggccaggagaagtaagaagagtgaaggttattgaaggttacagaaaatgcaggaagagtcgagggtgtggcagagtacagagactaactcctcaagtcccttagcccatagagatgccttagaattctgatgtgcctgaaagttgtgaatctttaggatatcaacatccatgtagatgattcatccaatgccatagcttcttaatttatctaacttttcttttctgatgatcttgtcctgtgtcctgcctcagccacccactcatgatcacaaccgaaacaggaattcacagatttcagtgtgaatttgaatttgagggatttctgaaacttggatggtaaaaaattacattataattttcatgaatttctaactgaaatttggcattttaaaatatatgaatttaggtcacatattactctgtcaccaataacaatcaaacatattctcatatatttcagctgttgaagtattacttcaataatacatttcttaaatctgctcctagatcctgttatttaatgtgttaataagcatactatttgaatgtgttagtaacttacatttggtttcttgatacttttataaatgaatttcaatacaataggtttttaaaaaactctatgtattatattttatgcatgtaataagagcattattctcagtattttcagaaatccacagaccactaaacgggtccatgacaccaaaaagtttaagaacccctgtaaatcttaatattactaataactgcaaatttttttctttaattttgattttaaatactgtgttctctgaccactgattcttctttttctagtttatttccttaaatctcctcccaactccagcagttcttctactttcccctacccagactaccagtgatcttattgcttatttcttttttttttttttttttttgtccttcattcatcctcatgtcctcagctcctgccttgaatgtcagctcagattccacggttcatattgaaaacaactgccctatataccttgtccctttccctctttatgcttctcacttggccaaacccaaactcatattaaatataactgttcacattttatgtgtccacatccaggcagaaggcagaagccatatgcccctaccaagatctcccctttgcattcccatcccccttgcattcccatccccaacattcaccctctcaccagcaccacatacctagagactctgagatataatctgttcatgcccttcagccttgtttatgacagtcacctacagaaacccaggagtctctgattaacacggatccaggtgcccattttctgacatctctattcatactttactcttaaaaccttcccactgttccctctaaaactcaccatcagttatcagtagagtcttctgtaacttccatctactcactgagtgcttccttcaccttttaactttatctgaagtcttgctctccctgatgacattgctccttctgcagtctattcaaaagtggtggttctctctcataccccttgaaggctgcacctggtggagggtagttgaccttcctttttgtcacttctacagtattctctttctctcttgcctaaaaagctctgcttggaatcataccatcaccctctcccacccatttccccttcttgtccaagttttctactagcctctagggccactcttactcattccatggagactttacttttcagataattttcattctttccaaatgacattggagagaatgccattctcttttatacttctttcataagttctagtgatacaatgtaggcataaatgatttttgcattactctgtcctctccatttctttctcttattgatgttcttcccacggttctaccctagcccttttcattactatctacataatctcaaacatcctatcctctgcccacttcctatctttactcttacctctggtactcagactcccaaaagtttttgacctatcaggaaggacaagccattgatctgaccactgtctgtgtcccttaccttccttgtatcctcactctttccatatccagcttaaatcccacagccatataatataattattcccttgcatagaccacccattccacccagaagttcccttttgctactctaacttcaccatactcacttggctaaaggagtggattaaatttaactcactacttgctccaagcctacactttcatggctaaaggtggccagagaagaatgccaacacgaacactggtttcaccttgaattcatgaccacaaaacttcaagtgggcccatagtgctgctgggccattccactagattttcctagcacatccactctttctttcacctagaaacctatttcacaccttctttttttctttcctttaatttctaacacatctttaccatcttctctctttagtcaatgaccttgcttcctatttctctgagaaataaaagcaatctgaagcagtcgacacctacacatacgcccatgtgacctgcctttctttctaagatcctggctgaatgttctatgttcctaaggacacccctccacatggaagccagattctaacacctctcgttaattcaagaatattgcttcaactaccctttccttcctcttctacatcattatatttctttttttctatttgatttttctcatcaccatacaagtattctgcaatattgcccacttttaaggggggaaaatacaaataagacaaaacaaaacagagcaacaattgaaagaaagaagaaggaaaaaaatgaaggaaggaaagagggaaggaaggagagaaagagaagaaggagagaaagagaaggaaggaaggaaggaacgaagaaaaacaaaaaaagaaaatctcttccagtaactaacgcatgttctattatcttctttggagtaaaattcaacaaataatttatcatcttcaccacctaattcctcttccaaaattctatcttaaatttgttccaatcagattttcaccacaacaccctgtcaaaacagctcttgtcgaggttgctaatgacctccatgtttctaatttaggagtagtcctctccttactcaagctctcagcagcactgatgcatatggccactttctctttcttggctttctgggcaccagtctgttttgatttttcttttccccttaagagctgccattctcagtctccttttctggtttctggtaatcattccaacctttgaactttaaagtctcccaggactcagtacgtcagtaattcttttcctcttagcccttaggtaatctcatgcagtctcgaggctttaagtgcatgacatgtatttgtagaaaacaatcaaatgtcagtcttctctgatttattcagctgcctgattgctatctccattcagacatctaatttaaactcttccccatctccctttgtttgctttttctgcagttttacccatctcaataaagtatctccaatcttctttgaagtaatttttggcatcattttctttaacacaccacattcatttcatcaagaaatcctgttggttttaccactaaaataaatgtattgagaaacatccacctctgctgctaccatcatagggtccagtcactgtgccttgtctccaggattgttgcactaaccatctaattgtgctcttcgcttggtgcttaacacctacaattcattcttaatataatgaccacagtgattattttaaaatatgtcagctcttctcatgtctctgcacaaaaacctttaatggcttcctatctgagaaggggactagatcatattcatatttgtattttgcctgatctctgccaatctgggtcactaccattaactccccagctcatgacatataaaccagtttctggaaaacataagcctgtttattttatttcccaatgtcctgcaaaatttgatttaactaattaagatgtctgtaatttttttgttttgagatggagtcttgctctatcacccagtctggagtgcagagtagcacaatctcggcttactgcaacctccacctcccaggttcaggcagttatcctgtctcagcctcccaagtagctgggattacaggtgcatgccactaggcccagctaatttttgtacttttagtagagacagggttttgccatgttggccaggctggtcttgaactcctgacctcaggtgatccgcctgcctcggcctcccaaagtgctgggattacaggtgagagccactgcacccagtcaagatgtctataatattattataaatttatgtatgtttttattatttatatgttgcattagtccattctcatactgctataaagaactacctgaaactgggtaatttataaagaaaagaggtttaattgactcacagtttcacaggctgtgcaggaagcatggctgggaaggcctcaggaaacttataatcatggcagaagggtaaaggggaagcaagcacatttgcacacagtggcaagaaagagagaagggggaagtgctacacacttttaaacaaccaggtctcatgagaactcactcactatcacaagaacagcaagggagacattcatccccatgatccaatcaccttccaccaggtccctcccccaacactggggattacagttcaatctgagacttgggtggggacacagccaaaccattatcatatgccttgattatttaacataggtatgttctctttttgcataaatgagaataatggtgtctacctttgatatgagccataaatgaataaattaaacctgtttttatatatcttaaacctttgccacccaattataaccggaagtatgagtgggaaagacaacactctatatcagcatttctcaaactttcttcattattgcctccctaggaagcctcgttacatattatttttccaagtgttaccacttatgaaattttaataccaaaaatctactgtatagctgtttatgttatgtggccctttagagatccaaaactattatgagatttcagattttcccaccccacaagaaccaactttcacttagttggaggccatgttggccctattgagaatgcatgctcggtggagattctcactcattccactccctggagacacagtaaattctatgaatcaatcagtccaaaccttcagtgagctgtgtttttagaacatattgctttgtgatcttttttttttttttttttttgagacggagtcttgctctgtcacccaggctggagtgcagtggtgagatctcggctcactgcaagctctgcctcccaggttcacgccattctcctgcctcagcctcccaagtagctgggactacaggtgcccgccaccatgcccagataatttttttttttattttttagtagagacagcatttcaccgtgttagccaggatggtttcgatctcctgacctcgtgatccacccacctcggcctcccaaagtgctgggattacaggtgtgagccaccgcacccagcctgttttgtgatcttatataattaattttgtattgaattgtactttagtcttatgctattggcttagactgagggcaattaaaaataaagtagagaaacaaaaccaaaaaaaatacacaaaatctactattatattattctacaattgttgaggatatatttctataaaacacatacaaaaatgtcctctttttaaggaactgtgaatgaaagttctctcaggtaggggtgaacctatagaagtgagcaccctggtctaggccaataaataaatatttaatgtctaaataaaataatttaatattaacattaaattagtcttgaaattcctgcatactatgtatttaatggagaagatgagatcttgtaagaggaagaatgcaaggaggatcacttctgtctaaactctggaacagttcatctcctaacatccaccccacacaaacacacacacacacacacacacacacacacacacacacacacacacaaagaaacctacagttaaataatccattctctgtgagcagtgtagatattacttattggaatgtattaaatagcagactcactctccacacacacacactctaaatagcttatcagcatcttccttcagtagagaactgtgggggtagaatactgtgataaatatgctttcccaatttcttgtatttctagtactgtgttggcatccagtacagtttatatcccggatatctgcccaactagactgttccataaactttgtctctggtcttaagaccagaagtagataagctcttcctgagacattacttgtttttatcttttggataaagacattggaaactcaatggctgatgtatttccgtgtttgcactgcatggccaaagctcagagccaaatctgctacatgcctatagcaaaatatataaagtattgtatattttactttaaaatgtctgaatatatatgcagtggctttaaaaagtgcctggaacaacacagacacaataaatattagcaatatttgtactagctttagttgatgttgctgctattttggtattacctcttattttgtatcatgtttcctaactttatcttttttcctctcaattttcttatttgttttctttatcatactttatctatctttgtaaactatcagaaagtctttttagaatgaagtagcctataacttataagtaaatatttatattttatcccccaaagaacctggcaaaccattttgactcagtgtttgttttttcaatttaactagcaaaaaaagttctctagataaatactgttggattacaatatctggaagacttcaatagtaaatgtcttaagaacatttatttatcctcaagaactacaaaacatgaatcggatttccagtatatgctttataattaaatttaagccaaaaagaattcttgaaatattatttaaagttataaagaatgcatctaaaatgtgagagccaataaaatctaaagagaaaattcttaaaataaaatggacacaagaagaaaaatgaattaaaaagcacttacatatttagtaaaataaatgtgcttagaaaatagagaactggcatgtgtgatcctaagactacatagatattataatccaagcagaagtctaaaatataaagcaaaccaatttgatagagaaatatttgaagtagaaaaaataatgatgccatcacatttgaaaaatatagtcttcataattcttacattctttcaagtatcccaagtgctttcgtgacattatatagtctgagtttatttttagaaagccttggtttttataaataaaaagacattctttctttttatagagtcactatgaatggctgactaaacttctaaacatataaatacactgccatggatatatgatacccaaaatgaatttgatgtagaggaaaaagtagttcacagacaaaatttatttagattttgtctctttcatgttttcactaaatatatatatatatatatatatatatatatatatatatatttgccaataatgcagtgtcagttctttataaggtggcttattcctggaaactcttgttattttgtaattttgttaattatgttgccctttatattgatgatttagatgtttgaacatatcttttgtagctctctgcagccacatgttattctttttgcttttgctcctgggactgaaaactgtcgtcatcaagaacttttaactaatctttaacagattttaaaataactaacatatatttaaatgtcattacaaataatataatgctagctcatatttattattatacttgttgaactttggattcagttaaaggaataaagaattatttaacttagcattttcttactctgactttttaatccttttttacccatttttaaaataaatacagtgtaccactaaggcaaaagtccccaaaactctattgtcttcttgttctttcattctttaaaaatatatattgtatgccagctcttaattgtgttcatggaaacttgtaaaacactaatcaatattctataagccagataaaataaatataaaaggaaacattttatatctgaattttagaggctaattccctttcctcaaagaaagagaagttatattattctcaaattaaagtgaaaatgagtatgctttcttattgctacttgattatttaggactatatagtgccttaaagtctctatactatcctttctggtataagatttatttttctaaaatttgagaatgataaaattagtaataaattttgctaggagttatagcatcgatattgggaaaaaataaggcaactatattacaggcactagtaaacatagtattatacatatttcctagaacatatttgactataaacatttttctacaaattaagtagatattgttgtcaatgcctaatatcttacctatttttcatggaacataacatgtatgaggcaaggttagttatacacaagatgaaaaatcatggtgaaaatatgattagagtatctgctttagcaaagagagaaatggtaattctctcctcattttaaacataaacaagtttcctatctttataattaacctattgataatataaaccaaagcacttatcacagaacatagcagttgctcaattattttattgatcttcagcagttactaatacattctgtaagctagcacacaaataaggtacttcacatagaataatgtctttaaattacactatcagttgccatgtcacatttaaagaactcattctctagttattagatgtacttgaatgtacttatgtgatttagagaatgtcaagtcatgcaatatatttttgcaaatttgatgaattttcatttatatgtgttaattttaaaatattgtttcaatcatttaatatattttctacacagctctgctgcatggtcaatgaacagtatgtcatttgtggtttatcgtcagccatttttaattagacgaaatccaacattgcaagttttaaaactgaagattaggcatcattccaagtagcaaatatttttgttttggttttcttctaggttaataacttctctgacatttgcacaactgtgtttgaaatatagtctaatagaatatgtatttgccttctataaaattaatgtcctagacgatgataaaatatgttgaagttttaagggaattattttttttattatcttggattggtctatgaattaatgaaatggaaattaatatacatgagaggatcaactataactttacattaatttagagtattataagcagtggcttagaataagagtttactttttgtgaatatccaggataactttcactagcttctccctttttcacaatgcatttcttggtaaatattttgttatcatcacgacagtgggtgtttctaaaacccattcatatattttgccccatctcttcttccttagtgtgttttcctcctcctccaggaaaccccttttctgctgccacctggaagtaccctcctttttgctcccctcatatctttggcattctaagtgcaattgtgtttaccacaccgtactacagttgtggtttactatcattcaaccaagatctcttgagaagaagaaaggccatttctgcacccagtactgaccacagaagtagtgggttcttattaaattgaaattcatgaatggaggtttggcagttaagttttttcctgttatattaaaactgagaagcaatcctaaagaaagaaaaatgacttggatagaaactcacattttaatcacatttagatggttcctgcccacttagttaaaacaactagcatctttatctataagttggatcatgtcaatgtacctttctcagcagtgacttcctctctcttccctctcagcttcccacacagggacattacagccacggatttgctcttactttgaagaagcacgggtacctcagtacctagatcttcttttgagtttgcacaaccttggagatgcagagtagttaagttgtagtcagaagagccctgattcctcccggcttggattaagtggtaccctaaatcctaaataccttctaatgccctttagtctgggcctggccagatacttctttcctgagtccattaccagaaatctttggaatgtggcctgcagagaccacagacaattggcactcatttttcaacaaacaaagtaggttagaaaataattttccagctataataatacaaagagccaccaatcatgaaatatttatttataatagcaatgcactctgtatctttgttaaaataacacaattagctaattgttactatcaccattttactgatgaagtcactgaaattcagagagtttatgtaacttgtccaaagtcctacagctggttaagctaggagccagaattcaaatgatttagttctaacactaaagcatgtgctcttaatctgtatactatgttaggatgggattagttccatatggcaatttttagcaagaacctgatattgggacatgacatagcaacaagagaagagaaacagagatacccagaaatacacaggtcattctataagtaactactatattgcagaataaatagtgaatgccagataggcacagctaaaatttctagcactccaactccaaaccaaattttgttaactatttgggagaggacctgacatagcttctgccattatctaaacagacagaatccacatgattcttggaggaggaaaaaattaaataaactcagattactttcttttaatcttctagactccatccgtacaagtggaaaattcatctgactcagttaaaactaacatatttaaagcaccaattatatagtccaattaaagtattatctaaatataacatttagatcataatttattatattataaatatttggatatttataaatattatatttagatatttataaatatttataatatttagatatttataaatatttataatatttagatatttataaatattataaatatttagatatttataaatattataaatatttagatatttataaatgatatttataaatattataaatatttagatatttataaatattataaatatttagatatttataaatattataaatatttagatatttataaatattatatttagatatttataaatattatatttagatatttataaatattaagatatttatattataaatatttagatatttatattattatatttagatatttataaatattattataaatatttagatattatttataaatatttagataatattttatttcctctaaagaaagagccatgtattcctggtccaagattatattctaaacacaggcttaacttaaaatagaccatgatcactacaaaaaggaagaaaggtgataaataacacttaaaaatctcacatgtacattagtagaccctttacaaggaaaatattattaaagtttaatgtgcaactaatttagctcggtgaaatatttttgatatgtattaaaaaatcaacctatggctagctaacaatgtaattctcagaatatgcaatatcaacataagactctgttcatatttctgaattaagcactttagtggatattggtttagatgggctgattgcttgattttaaatcttatttgatgaatttggaatggaagattaagaaataaaggtagagaggtatgattggagtataagttatatttagactgtgaaaagggagaagattaagtttgtggtctttgctttttgttttctggcgttttggcgtgattttttttatttttatattttgcttttcttatacataagcatgagatgatgagatcctaaacttctaatgcacaggcaataaaggtgaagagtcgtgagagattctagagctatactggagatcaaatcagttggacttggcacccaagttgatatattacaggcgaggaagaaaaagcactttgcaaatgacggcattttctattatgaataattaagtgcatggtacctcatgaactgaactaagtagtgcaggaggatggacaatttttataggagtagtggcaggaatagggagtatagagggagagagaagtggtcctgtgacaaacgcaagaacctcaacatggaaaaacaggtaaagtgaacaagagataaaacaatccaggtaagacatagtaaatccaaaatgagtcaatgctcccaagcttctttttaggtttcctaacatttctctcaacacctagaaaattcattatgaattacttcatacatgttactatatcatcattgacaaacacctaaaagtccctgtttccactgtcaagataaatgagtataataagacacaagtcttgaaaagagaaaaagcaataataaccaaaaattgtatgatggaatgaataaaagaagcctggcaatactgatagaaatgctggtattgaaggaatttcagttccattcacttgtgggaatttgatttgttcaatgtaaacaaaatggtttcttaaagaatttcccagaattccaaatggttagaaagaagtaactactctgctgattttataaataaactcctgcaaaagtgatgaaagttaatctttttttcccctttttttaacttaaaaagaatttgaaaagaacttaaaatttcaaggtttaacaccatgaaactatgactaaggatgagccttttcagaaaagaaggaagtctgaaaaatatataaacagaaccaaggaaattctgtgcagatacaatccaaggtgattagaattattttatatcttcaggttgagaaactgaacaagcacaatctcttagaaattttttagactagtcaatgtccaattctagccagtgactccttacacacttcagactatagttaaaatagctgaaaaattatttctgctgtgaaagtacaaagagaagattcagcttgttatgatcctcttaatagtttcagtgattcaatgaatttggacaatttcttataagaacttcatgtgcatatagcaaaacagagagacaccaattaatcctttttgatagatggatgacactgaattgtgaaataaggtcccaagatctaacaaacaaatgaattcaaggtcataaaaagaagaaaaatcttaatagcaaataccaaataccaatacactaggagaaaaatcttaataccaaataccaaatcttaatgcccttaataccaaataccgatcttaataccaaataccaaaatacagcctcaaacaggtgaatcactcatttgtcatagcctcaaagccaaagatgactgaagaccaacagaactttttgccccagttttatcctgagaaagtttccagggtagttctgtctctgcatcaccatttgaaaccagtgagagaatgggattattggctgtcattgctattgaggcttttagaaacctctagtcattttcaactctcaactcattacattaaggaaggcggcatcactgcattctctagtaatgtttaaagatgtttatgaagcagccaggatgtagaggaaatagtactgggcttagattctggtttatgttcaatacctaagtttactgtcttttaggtatgtaaatataagccctaggtccctaatctgtaaatacaaataatgatacatactttaactgtatcttataagaatttagtaaaataaatgttgtaatgtgtcctagacaaattaggcacttactaagtggtttaaaagaattaaaaaatccattgaacaggccaagtgcagtggcctgagcctgtaatccgagtactttgcagggtcgaggtgagaggattgcttgaatccaggagttccagaccagcctgggcaacattgtgagaccctatatctacgaaaaatataaaaacttagctgggaatggtcatgcatgtctctaatcccatctactcagaaggctgaagtgagaggatcacttgagcctgggaagtaaaggctttggtgagctgtgatcgcatctttgcactcactcaggcaactgagtgagtttgtcggaaaaaaaaaatgaacagatatttgttaatgacatattatggatcaggctgtccagaatcttatgaataaatgaaataattttaaggaaaattgagtctcatggccagttagtttcactctttctctttattgtcaatacccacaaacaccagccagtctccacaaaaaaagagaagcaaagcaatagaacgagcaatttttgtggtgggggatgattgcaagggacagtctttctttgtatgtaaataaacccacagggccatgtatctgttgaaaatgtccaagaagtcctagtcacagtgctcaactggtccttcaagacttgcactgaagaggaaccattaaccttggcatagtggaacatgtaaattttcaaactttctctctggttctacttgtctctttgcctcaaaaactaatttggagaaggcaaggtagaggcagtggaaggaataatttagcacttgtttttataagtatggcaaaatggaatgggcatttgaagttgccagtctttctaactttgattgaggctgagaaaagttactcctggtgataactcagtgtatttcacaaagttggggctgtaaatgtgagaacattctgtcaaatagctatttccaaagccaagtgcacagattacctaataaactggctctggttgttggttaattaatcacaaattaaaaacttgaatgttatttataaaatattttgtatacgttgggaataaaacaaacccatgaaacccattatacataattctatgtattctatagaacagaacccagataccaaggtctgagtctcttctgtcttattccagactgagtatgttctcactaaatactcactaaaaaatcaaatatctttttaaatgaatgaactacatttaatattgcaaattcacaattcatagatggtttttactttgcattttaaccccattatgtaagtattagactcccaattttacaaataagtaaatggagcacagagagatttagtaccttatgagaggccacacactcaagtgagtggtaacagtatgcagatagaattgtctcacctcaagtctcatgcttttgtgtaaatgtcaccttgcatttctaaagaagtaggtaagccagttttaaaagtcctcataattatggtctcaccttgccccaaaatatcaaaattgggcttgttgagcatgtgcttattggccagcttcttataaaagctagaagttgcttttatatttcccagcaaatcaactggtcatcactctattggaaatgctcactcctttctcaaagaggaaatgcatcctggtgatctggtgttttctgacagggaaagggccagagtcaacagtaaggaacaaatacaactgccaggataagctgccagaaaaccatgtacctctgccaaacaaacaaagatctattttgcttggcatgtgggtttgggttcacaattgccaaacgaataggagcagaaagattagtgggcttcactggatggaaaaacccaccgaagccactagcacttagatgatcaagcacttaatgtatatttataaactaatatcaactttgattagcataaataagggaaaatgtaacaaatatgtttgcaaattttatggctcaatgcttgatattctcaaatatattatggtttgcctagaattacagactcagggctgtagtaggaaccttaaaacttataacattaaaccctatcattttacagaaggaaaatccacatccttgagaagtaaaacagccaaagatcacagaagcatcagaaccatgtcttgagcccaaatattctctgttgctaaagttatataactagctattgacagaactagaggtaggtcttaagctgtcttttttcttctctacctagcttagtatttgagtgttgctatctcaagtaggcaaagggaaataaaatcatcaaaagcaaaataagcaagctgatacacagacaatatcataaaatagatattttagggaaaaaacaaaaatcatcaaatgtgcaaaaattctgctgaacctcaaagatcaaacccattttattttctgatttctctttgggtctcttctttagaaactcttaaaaccaattagtgtgactatccattactttattttgtcaaagtcatgaagttaatgcttataataatctaaaattgaaaattacattaacgttttccccaagaaactggtttgaagccaattcagctaactttctaaaaagacacctcctttgttaacattagaccattcataaaaataacaattttgatatatagttcaaagaaaatgttaacagtaacctcactgaattacagcagtgttactgaaaattgtatgctagtttccaggcaagtacaacttttctaccttacagatttgcaagttttacatctcaactctagtctatacttgcattgttgataacatttagacaggatggaaacctggaaagaaaaaaattatgcaagagaaaatgtgcaaggagaaagagacaaagatgagacagaaatgctaaaaatgaatcaagcaataattcaaagattcctttgtttcagacatttcataaaatctcagttaatacatttaaaacatttgtttttacctcaatagcttcacattgaccaagtgttaattcaaggaagtaaatgggactgcatgaattttttaaaattatcattgtcagaaaattaaccatacaataaagtagatttcagtgtctcaaagtaaaacatacctcttcttcttttaatgtttgtttttatatatttctgccacaaaatttaataaaataaatacctaactgatttcctcacctagttctgacagcaatccaatggagaaacaaacacaattcagtaatttgcagaatggaacaccaccagtaaaagaaccccagaaaattcccaactgattagactaagtccaaaacaaagctcttcaccataaatttaccattttttcagacaaattcttatgagtgactaaatttgcaaagtggcaaactcacaccaggcctttctgtacaaataaataagataaaaaatgctgaaaaattcgaacgctgcacctaccttgactgcgtcccagtggttactcataaaaatggatccagtactctgacaagttcactgaaagtgttgtcttcagtagctaaagagagcacttgcttttcttgtgttgattagcctcaagcaattgggaaaatagctaaaagctgagaaaggcaaattagagaggttttaaatgatacaggtgagcaaagtcctgaaacacgtttttccaattaccacaaatttaccagaaaacgtacttttccacagctatgggcagaatataattcctgtgtgatggtccttgatagaaagttactgtggtcaacaagtttgggagatactgattatcctctgttgctttgatgattctcaacatgcatttatttgcactttttagatgagagtagtctcttttttgccccagaactcctcttttgctcctggatccacacagccctttcactgggcaaagtaccgttcctcctgagataagaatgaaagctaccatcttcttacatggccctgcttccttggccagagtgattggttgagtgatggaaagcttctccaaactagttcaatcaaagaagccactaactcagccacagttattggtctggggataggtgtgtgacctgatgtttgcaaagcagagcctttccttaagaatttttcattagtgttggggtaaaacgatagcccagtctgtttgttcttaagaatacgtgatgtgagctaggagctcatatctctcttgagagaagtcagtctgagaatgtgaggcaacaggccgggcgcggtagctcacgcctgtaatcccagcattttgggaagccgaggcgggcggatcacgaggtcaggagttgagaccatcctggctagcacagtgaaaccccatctctactaaaaatacaaaaattagccgggcatggtggcgggcgcctgtagtcccagctactcgggaggctgaggcaggagaatggcgtgaacccgggaggcagagctttcagttagccgagatcgcgccactgcactgcagcctgggcgactgagtgagactccatctcaaaaaaaaaaaaaaaaacaatgtgaggcaaattgtaaaagaacaagaggtgaaagccagagacttggaagatgcaggcattcaattatctgctccagtgtgcctgtaaaacatcagctgttaggttggggttctgtttcttaaaaccaaagatccctgactaccatgctacacaaacactggagctggaagctagactcttacagaaaaactcagtatgcccagcttatgccattgtttgctttattttatccaactacttttccagaaatacagtgcaggtctagaacaagaaataaacttcatgaaatgtagtaggaattgctaccatttactgggagttatctattaatcatgcatttctgaaatgctttacataaagcagttgttttcaaaccgtgataagcagagtcccacatgttccatggggtgatagagttgcgggaagtacaggtgccagcatgaaaatagagaagacaaaaatctggtggtttcctgctcttaaacccatctttgagtaaagcatccccctttcacccagttcaataatggatttccacatataattacttctgaagaaaggttatgctacctctctagatagatagatagatagatagatagatagatgccatgagacatattattatccctattttatagttgaaggaaaaaggtttaatttttttttaattttttcaaattaaaaaaattaaagaacatgctcaagattacccagattatgcagccagtaaaaggcagaggtagagtttgaactttgctttgcctgtttccagaacgtctgactcagctgccatgtgatactgttcccaatatatccttgtggctcctactaggacaggcactcattgcttgctttattttatttttttatttttttgagacggagtctcgctctgtcgcccgggctggagtgcagtggcgccatctccgctcactgcaagctctgcctcccgggttcacgccattctcctgcctcagcctcccgagtagctgggactataggtgcctgccaccaagcccggctacttttttgtatttttagtagaaacggggtttcaccgtgttagccaggatggtctcgaactcctgaccttgtgatccacccgcctgggcctcccaaagtgctgggattacaggcgtgagccaccgcacccggcctcattgcttgctttattgatactcatattagccagcttgtcctgttaaaattaaatagccaaagatcaaacagaaacctgtagtccgacaaagccagagttattgactggatgtagcaaggaaacacacaccagagcaatcatggaataccatgcaggtgcgaaggagaagtgtcttatgtaaggtttgagttcctgctgaagaattctgaggagggtggaaataaactggcagtcagatctggattagttctgtttctgaagtgggaataggagaagcaggaattaactagagctggggctgtcatgaggggagtgcagtccagcaattgggtattcccactaataggtgggacaagaagagcagagctggggcatcattggtaacagcaccatccacttggtgaggaggtcatgatggcattctacagcagctctgtgatcttggtagtgtttcctgtgaactttacagttggcattatccatgtctgtcatacgaatctgaataaaggttttgttatttttctgcctcagctgattttcactctaatcatagggatgtttttactctttcagttctcaaacgtgctgtcccagcaggagttttattgaactcaacaattttcaacgcaagcatccattcatgtgtacctaatatacctcatatatattaggcacacctctaggcagtggggaatcaaccatctaataaaaacactttcttccatatggccagggccattaatagacctcggaagaataaaaaataatgtcggaccaggactagttggaggactcctggactgagtagtaaaatcattgccttctgatattatattatgaatttttaatattatctctttaataggaaaaaactattttctgaggaaaagtaatcataggaaggtataacccctttctttgtccaggttcctagaagttagagagattatgcaatatagaataaaataaaaagaaatatcaggggtcacactgaaggtcacagtggtttcctctaaccatcttcttccttagaccccctgtgctctgtaataagaaaaaattcagggcctacaatggaggcataactcaatcatttaacattataggttgagtactttctatgcactaggcttggtattagtcaacacagctaaaacataatttggatatcatctctgtcttgaagttgttcataatatagagatattagcagttgtggtcacaaaatgtgacaccacaaagagaaaattctaaatgttatggcatcgtcagcaataggcaagcagtagaaacaaagactgcatcacagtgtccagattgaagaatcagaaaggaagtttgtattaaaaaccaagtagagcagttttctacttatcagaaagcctgcagtactgctcaacttttaattgaaatgtctgttttcagcatcactctccatatagcgggaattctccctgaaggaagtatgaaatcaaagtttagatttaaaaaaaaatcaagaattcccatggaagagatatagtactccaaattggttttacatttcttctgatagagaaaaattattcacaagatcaatgatttgttcaggtttaacattcatcagctatgtgaaaagcaaaatatgtgtttactatataacacataagtaccagaattatgattgatagcagtattctgatatatatgttgttagattcaaaaccaatatatattgaaaaactcctcaagaatatatgtcatttaaaatgacattagatagtacttcaattcggtctctaatttctgtttggaatgtgggatagaagtaaagatgaagaccaaaattacataagcttgagccattagagaaattaaatataacacacgtaaacatggagagtttatttcaaatatcctgatgtcaaagccacaaattatgaaattgtatttggttttcatactagtaccaaaacatcaagatggcatccacaattcactaaatttctttcgagcagccacagtttgtactttgccaacccacatattcagccaagtacataaacatgtccccatgatagatgtaatttgtggtcaaaagacagagcattgtggagaccctgcagtcatcctcagacaaaaaaggcttcagaatgatgatttccaattcctatcacaagaacaaaaaaccaaacaccgcatattctcactcataggtgggaattgaacaatgagatcacatggacacaggaaggggaatatcacactctggggactgtggtggggtgggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaaaggcttcaggatggatcatttacactgggtcaaacattgacgtttaaaggttttactgtgtgattgaggtttattattgggcatcttatcagaataaaataatgtgtggtctgtggcatattttaaaaaatttgtagaaaagtagaagataaaaaaaattacaagaatacaaagatctctttgaaacagtttatgtgttagcttttttccatatgacatttattattttccttctgtgcccttgccttgatacattaagtgcagagcgcagtttccttctgcatttctaaaaccagtcccttgctaaagctacctgcaagaacacggcagagaggtcaaaagtgcatggcctttgcagctggacaaatttgaattctaatcccttctctgccctctagtgactattggacttgagcaactcattttacctgactcagttacaaaatatataaaattagggtaaaagacctaccattgtaggttgttgtagtcatgtcataatctacataatgagccaacatagtcttgtagctggctgtagggcagtaagtagcatctctcaaagtaatgataagtttactattgttattgatagtgtccttaggagctctgctacttgagggctgtttatattccccttgttatctgccctcaccttttgaccctcactttcctgctcatttctaagaactactttatctgtatccgataaagctttccctcttatgtttccaggcagctccaaaagccccaggcagggcaatgttgaagacaagcaagcagacagacactattatcttccaccttatagggaacatgaatgtgcttttaatgaccagagattcaggagaaatgcactaaatctccctgaatataaaaggaccatgccaaagaatgagctgtttatggtcacttttaatgtgatagataataataatttatttggtggtttcaaatttagagagtaaacttccaaaaattaatgaaaactgttatattagtaagccattgactaaattttttaggtcttcactcattctagcagcatgttcattgaagatagtgccagccaggcatggtggcttatgcctgtaatcccagcactttgggagactgaggcaggaggatcacatgggcccaggagtttgaggctgcagtcagctatgactgaaccactgcactccagcctgagcaatagaacaagaccctgtatcttaaaaaataataattaatttatttaaaaagaagatagtgcctaatagttgtggacattgggaagaaagagtatgactttttggtcctactttacaatagtttctcaaaaattctcatgtcggcaggacacggacccataaacttacttgactacaggagtagcccttctaagtgtcacccaagacgtaaattaagtccatagcatattataatacatcatttcaatttttaattcacagtgtaatatctcagggcaattgttctttagataaaaattgaatgagattatttaatatcagaaatacattacttaagtcattctgtataaatgtataaatgtcttaaaaccattgggatgtgaaattatgcaagatttacctagcatacctatgttgtcattgtttcaggaaaaattattagtatttttactgtatctctttttttacattttattattattatactttaagttttagggtacatgtgcacaatgtgcaggtttgttacatatgtatacaagtgccatgttggtgtgctgcacccattaactcgtcatttagcattaggtatatctcctaatgctatccctccccactccccccaccccacaactttatcttatttttaaaacttacttttttaatgcatgtatatatgtttcttgacattttgccttctggtaggaatttgggactgctggatcatagggacagcatacacatttgtgatcatattattttaaatgattaatcatgttgtgtaaacagttcacatggtctcacacagaaaatctttgatcaaaagcttttgtttttcttaaatcatgtaagaataagagattctgttttgtgaaaggacccatttgttttccagggctatgcaatctcgccttagctgaagcagactaaatgagcaatagtgacatgtatcaatgaaataatatgcacacttttggtttaccttgcaggtgcacccaccctatccccaagtcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcgggaaccccttcatccaaaagaataaacttttaaatggatataaatgatttttaactcgttccaatatgccttataaaccacttaacctgattctgtgacagttgcatgatttaacccaatgggacaagttacagtgttcaattcaatactataggctgtagagtgaaagtcaaatcaccatatacaggtgctttaaatttaataacaagttgtgaaatataatagagattgaaatgttggttgtatgtggtaaatgtaagagtaatacagtctcttgtactttcctcactgttttgggtactgcatattattgaatggcccctatcattcatgacatcttgagttttcttgaaaagacaatagagtgtaacaaatattttgtcagaaatcccattatcaaatcatgagttgaaagattttgactattgaaaaccaaattctagaacttactatcagtattcttattttcaaaggaaataattttctaaatatttgattttcagaatcagttttttaatagtaaagttaacataccatatagatttttttttacttttatattctactctgaagttattttatgcttttcttatcaatttcaaatctcaaaaatcacagctcttatctagagtatcataatattgctatatttgttcatatgtggagtgacaaattttgaaaagtagagtgcttccttttttattgagatgtgacagtctttacatggttaggaataagtgacagttaagtgaatatcacaattactagtatgttggtttttctgcttcattcctaagtattacgtttctttattgcagatgtcagatcaaaaagtcacctgtaggttgaaaaagctaccgtattccattttgtaaaaataacaataataataataataataattagttttaagctcatttcccacttcaatgcaatactgaaaactggctaaaaataccaaatcaatatactgctaatggtactttgaagagtatgcaaaactggaaggccaggaggaggcaaataatatgtctttccgatggtgtctcccaagtgttggtgctttgggtttttataagttgtgaaaaggaagatgcacatttcttcattctccatggtgtgcatggaaatgtgtttgagtgtggatgtaaaagaaatcgagtaataaagaattagctggcttgtgaaatagtgcagtgttggatgcttcaagaggtataatcctattttattagcacaaacttgctagctaattagagtttatctttttagaaaggacaccgtataggttcgtaaaaaatatttacaggaagcaaaatagatctattactactttaccgactttaccccctttctttaatttgtataatttttgtactatatatcgatgtgtaaatgtttagagtcttcattatgaaaatatcaataaatatttcattagtttacatttaactctggtataaaatgaaacttttaaaaataagtgaaatggatgatttcccagtggaagtatgtcaacagtcttaagatcattgccagatttcataaaatatttaagtatttgaaaaagaaacaaaatgtcttcatactttagggaaacgaataccctgtataccttctgtacaaatgtttgtgttttcattgttacactttggggttttacttttgcaatgtgacccatgttgggcatttttatataatcaacaactaaatcttttgccaaatgcatgcttgccttttattttctaatatatgataataacgagcaaaactggttagattttgcatgaaatggttctgaaaggtaagaggaaaacagactttggaggttgtttagttttgaatttctgacagagataaagtagtttaaaatctctcgtacactgataactcaagcttttcattttctcatacagttgtacagatttaactgggaccatcagttttaaactgttgtcaagctaactaataatcatctgctttaagacgcaagattctgaattaaactttatataggtatagatacatctgttgtttctttgtatttcaggaaaggtgatagtagttttatttgatactgataaatattgaattgattttttagttattttttatcattttttcaatggagtagtataggactgtgctttgtcctttttatgaatgaaaaaattagtataaagtaataaatgtcttatgttacccaagaaagaacaa

SEQ ID NO: 364 - DNA, 23070 bp, Homo sapiens
agctactggagccccaggacgcagccgagcggccctcgccgactccttcccgagcctggctgtggcgtcacgtgacccgcggcgcggccaatccgcgcagccctctatgctattcaaatcggcggcggggccaacggttgtgccgagactcgccactgccgcggccgctgggcctgagtgtcgccttcgccgccatggacgccaccgggcgctgacagacctatggagagtcagggtgtgcctcccgggccttatcgggccaccaagctggtaagacagctcggatagacgggaccggtcagcgggctgacggcagtcaccactgttcgcagttttacctcgaccgttcgcagttttacctcggtcggagggatgagtcccaggatccctaggttcagtgaaaaggctggcgaggagaagtagcgggtatgcaacccttgccagactcaccgctccctctattttgagggtctgggcctcaggtccgaaaggaagcgccgcgcgtaggccgcaccagactcgctatgaggagcgactcctgtgcctggtgtggccggcgtcccgtgggggcgtcttagaatattccgatttggccgctcacctcgcctgattttctacccgcctcagaattagggaacaattgggaatgaggtccaaagctttgtagggttaggtggggggcaagcccgaatgtggcaattttgtttattgaacccatagaatttaacgcaggatgtatcggccgaatagcactaggataacagctgcctgtttcaaaacggtatttctgagtacccatcagtaaccactgctggtggtccctgaattgcacgtacagcactcctaacgcgttttgtgcagttgggtcttcggttctataggatactgtggtgctggttatgtgacgttaggtgagtcccctaccttctgtgagcctgtttccacattggtaaaggttactaatacatgcttgccttaaggggtttcccaggaggatgctgttttttaaagtgtgttgtgatctgcagaataacaagcattttcctcttaggaatgcccttcagacgagcatgtattattagccctactttatcaggtgcacactgaggctcacagacgttaaatgccctctagagtcacatcaacagcaagtggcagagctagaattcagatcttcctggtatggcgatcttacatggattctgctacttagtaagttattggctatatttaccaatatgaaggatagaatttaggacaggaaggaacctcaatcagtagtcctgccacattatttaaaacccattagatgaaagtagtataagcacgctgaaaaagaaaacatgcactgaatgcttactagtacttcacatatattacatcattttatcattccaataagcccattcgttaggtccttttgtccctgttttgtggttaaggagattgaggcatagagattgaagataggcccaaaaagtcataaacaatagtggcagagctagagctgggaaaccagccctactagtctaactccagagcctgttcttaaagccactaccctgtactgcatctcaggaaagccgttctgtaatctcccttagtacagagtccctttctgtcatttttattactgtgtcctcaggccagtacagagtgagcagctcaatatcagtttctagagtcaatcacacctgggtttgaatgcctaggttcatcacttagctgtgtgaccttggtcattttattaatctctctgctttattttccttatgtgaaaaatgagaaattaatagtacctattcatagaattggggtaattaaagtgaaataatgaatgtgaagcacagtgctaccaacattaatattaattgaggtaaaaaacagggatgaatgttttctctattgattgtagttcttccttatttccagatttcttaaataagctcaggatcttaaataaggatcttagatcagccaatgaagttcttctaataaaaaagctattacataaaaatattactacagcactagaattaataaaaagaaagcagtgtaagatataatttttttttttttgagactgagttttgctcttgttgccaaggctagagtgcaatggtgcaatctcagctcaccgcaacctccgcctcccaggttcaagtgattctcctgactcagcctcctgagtagctgggattataggcatgcaccactatgcccagctaattttgtatttttagtagagacggagtttctccatattggtcaggctggtctcgaactcccgacctccggtgatccacccgcatcggcctcccaaagtgctgggattacaggcatgagccaccgtgcccggccagatataaaattttatatggcacaaataagatgaatgattcttcaagaatttttatgatataatcagatgtgaattaaagaattttctttacctaatgtacttcaaatcaatatgagatttaatttttcttcaattttttaaaaatattttccttctttttacagtggaatgaagttaccacatcttttcgagcaggaatgcctctaagaaaacacagacaacactttaaaaaatatggcaattgtttcacagcaggagaagcagtggattggctttatgacctattaagaaataatagcaattttggtcctgaagttacaaggcaacagactatccaactgttgaggaaatttcttaagaatcatgtaattgaagatatcaaagggaggtggggatcagaaaatgttgatgataacaaccagctcttcaggtaatgaacagatatgtaactgtaaaactgaattactgtaaagttttatctctacttatattatacttttactataacagcagcttcttcaaagaagttttatttctttggaaaactattaatgctgttagttcaactaaaatcatttagaaaaattgtaatgtgaaagttaattgctacaaaatttaaagtttttaagtgttagcatatataataaagtagggaattggaagggaaatactgatgtattatcacttccgcatattctgaacactttataacattttaaggacatattactgacctttagttgcatagtttctagattataagttcacagatccttcccttcaaacatataatttaatttaagaatacatgtaataggataatagcaaatcttacataataaataacagacaaataacaggaccaggtaaagtggctcatgcctgtaatcccagcactttgggaggctgaggtgggcggatcaacttgaagctaggagtttgagaccagcctggctaacatggtgaaaccccgtctctactaaaaatacaaaaaatgagttgggtgtagtagcacacacctgagactgaggcacgagaactgcttgagcctgggaggtggaggttgcagtgagctgagattgcaccactgcactccagcttgggcgacagagcaagactatctcaaaaaataacaatgataacagaagaaatataccacaggttaaagagaatatttattaagcagttaagatataacagaaactctgtttgatgatttacatatgtgttcttacttaattgctatagtagccaagcagggtaggtattaaccccttttaacagatggggaaactgagaccatgcttcaacaaatcttgttctgtctgcctgaaatgtttttccaccgtgagacactgtacacatttgtcaggctagtaaacttatacatttcttttaatctcagctcctttatagcctcttctgtggagcttttctgattcccacaggtcagcataattgctttttctcttatgacctacggttctttgttatgtatccattaaactaggcctgtggaatctaatgcccatgctttttttttcctacaacattaggtacttttcaaatgaaatgtctaagaatttattgtttcctatgtaccaaaaatgatttatgtcatacaagtaaactacaataacaatcatatgaataatccattttgtatagcactctacaaatcttccctctcttaactactccccagttatctttgtgggctcctttactgctgctcatcctttaactctcccatcttcaagttcctgcccttgtccttacttcaccttctccctaggcaatctcatgccatgtcttcgcctacttttcttaagactttcaggcctctcctgaaatatctttcctgagctttcggcccatgttttttcatctgcctcctggaaaggcacttcaaataaaccatatagaaaaatgactatcaccctctaacctaagttttgtcttcttaggtttcctatctgaataaattgcattgccttccctatagttgccttgattctttccctttcttgtcctttaaatatgatttagtctattgtgctccctaagtagttctctgatctgtacacatctctctccaagatgaatcttctttttgttaggctataattcttacctggatttctctttatttgttttgcttttgttttacctggatttctgcataaatcctcaactagtctctctgcccctagtcttttctgcctcctgggttcaagctatcctcccacctcagcctccaaagtagtggggactacaggcacacaccaccacgcccagctaatttttgaattttttgtggacacggggtttcactatgttgcccaggctggtctcaaactcctgagctcaagggatccacccaccttgaccttccaaagtgctgggattacaggcatgagccaccacgcccggcctctcctagtcttttacgatcgtaacaaaactataaagtacataaaaataaagtttaccaaaaatgtgtaagaccttattggagaaaagtattaaattgtattaaatagaataaatggagaaagataccctgttcatgaatgaaaatacttagtacatgtatatacaagtcaattcctcccaaattgaaatagaaattcagtgcattttcattcaaaacttcaatatagtttctttgtggaacttgataagcagattctaaaattcatttggtaaaagtctaagagaattttgaagaccaaggtcaaacttctgaggtgttcaaacttttgaggtcactacaaactttttgaataaatttgatgtatggggccaggcagagtggctcacacctgtaatcccagcacttttggaggccaagacaggaggatcacttgaacccaggagttcgagaccagtctggataacatagggagaccctgtctctacaaaaaaaaaaaaaaaaattaattagccaggcatggtggcatatgcctgtggtctcatctacttgggaggccgagcccgggaggttgagactgtagtcagccgtgatcacactactgcactccatcctgggtgacagagtaaaacttggagaagaaaaaaaaattgatatatggtaaaagatatgataaagtgaaaaaacaccaaaccacatattgtttatatacatttattaaaagtataaaagcatggaaaagaaatacaactataggtttattttatgaaactgtaagtttatattttactctcccttagagggagatatgaatgagcaaagaatttcattttttttaaaaaaggagttatttacactcccaccaacagtgtataaacattccattttctccgcaaccttgccagcacctgttatttttttgttttttaatagtgtccattctgactggtgtgagatggtatctcattatagttttgatttacatttctccaatcagtaatattgaacttttttcatatgcttgttggctgcatatatgtcttcttttgaaaagtgtcagttcatgtcctttgccccctttttaatggagttgcttttaaatttaagttccttgtaaatgctggatactagacctttgtcagattcatagtttgcaaaaattttctcccattcgataggttgtctgttgactccattgatagttttcttttgctgtgtagctccttcatgtaactacagtccatttgtcaatttttgcttttgttgcaactgcttttagcatcttcatcatgaaatctttgcccattctaatgtccagaatgatattgcctaggttttcttccaggttttttatagttttgggttttacacttaactctttaatccatgttgagttaatttttgtatatggtgtaagaaggtgtcccatttcaatcttcggcatgtaacttaccagttatcccagcactatttgttaaataggaaatcatttcccccattgcttgtttttgtcagctttgctgaagatcagttggttgtaggtgcatggccttatttctgggctctgtattctgtttcattagtctatgtgttggtttttataccagtaccattttgttttggttactacaggcctgtagtatagtttgaattctggtagcatgatgcctccagctttgttcttttttcttaggatagccttggctatttgggctctttttggttccatatgagttgtggacaacagtataatgattcattaaaatcctaaaaccaaaactaccatttaacctaacaatccctttactaggtatataccctaaggaatataaatcattctgtcatgaagacacatgtacacgtatgttcattgcagcagtattcacaatagcaaagacaatgagtcaacctgaatgtccctcagtggtatactggatgaagaaaatgtgtacatatacaccatggaatagtatgcagccataaaaaagaatgagttcatgtactttgcaggaacatagatggaggtggaggcaaactaaggaacagaaaactgaatatcacatgctctcacttacaagtgggagctaactgatgagaacacatggacacatagaggggaacaatagacactggggcctattggacaatggaaggtgtgaggagggagaggttcaggaaaaatgactaatgggtactaaatacttgggtgatgaaataatccgtacaacaaacctccacaacacaagtttacttatgtaagaaacctgcacatgcacccctgaacttaaaataaaagtttaaaaaaattaaaggagaagtctggcaaaatgtcaacaattacattggttgccagttacatacatgggtattgttttattatatctttgaagtattttatattaaaataaaaggaggccaaaacattacaatcaaaagaagcaatagaaactaagttccagaaatgaggacaaacacaaacaaaagagggaatatacaaactagataactcatcaaagaaatttagaaaatgtagcattctagagccattttgtgtgtaagcaatacccctctaccagaattgaccctaataataaccctgaattatccagaaataaagttaaaatatacacaatatactaaagaaaaaaggaacctattttttttaaaggtttaatgggaaaatttatttgtctagaatctttattacttggtagtattaataagtcaggctctttatgtgaattttaaaaaaaaaataggctctaaaagtttgtttctaatctcacattatttaattgcttattgtttttaaaccagatttcctgcaacttcgccacttaaaactctaccacgaaggtatccagaattgagaaaaaacaacatagagaacttttccaaagataaagatagcatttttaaattacgaaacttatctcgtagaactcctaaaaggcatggattacatttatctcaggtaacacatccttttactaattactagtttaaatataattatgatgtactcaatgatagaatcattaaaagtaaattattctttaatatttaaagccagaactgaaacctcctaacctacattacattctaaatatgtatatataaaattgtttgtaacccatagaaagaataataaaaatgatagtgagacataattgaaaacaacagttatataatttaagtgtgttttggtttaaattgatttgagggtggtagggacaactgcaaaattaaaaactccattaccatattacattatttctttgggagatactttatagctccacaatggactgatagtaatagaattattgttgctttcaatatttaaaaaatttgagcataacagattaaaccaaaataatccttttttcaggaaaatggcgagaaaataaagcatgaaataatcaatgaagatcaagaaaatgcaattgataatagagaactaagccaggaagatgttgaagaagtttggagatatgttattctgatctagtaagataaaattaagctttaatgaagttcctgatgtgttctgattattaatttgacattttcatcaaaatatgcaaatgaatcagaacagattaattctgaaagcttagaatgcaacctgtatatgtgtttttaaataaatactcttgttatagctctagtagagtagaaattgaatgtttcggtatgattcaccttttctttgaatcaacattatggccatagtttgggatatatattggaatccttttaagattattgagataaatgtatttgaaaggggatactaaatataagtcttagaaatttggttaaaaaaataaaatattctgatggctttgtttactagtcatattcatatgtataatctatttatgaagaaaaaaagttaatattctttcttctatttagcctgcaaaccattttaggtgtgccatccctagaagaagtcataaatccaaaacaagtaattccccaatatataatgtacaacatggccaatacaagtaaacgtggagtagttatactacaaaacaaatcaggttggtattaataaaataattggacttttaaaaacttgccaacaaggttgcagctatagtagtgtaaagagagacccaaatattgaaagtagaatactttcatggagcatcagaggggctatcataagttctttagtaataacagtggaataatttttaagtgagtattattcgtgctagtataagaaatattttgtctgctaagataaattcatgcatggtatttaaaaaaatgacaaagttaagcatccaaaaggtatacaaatataagaaaagttttgattaagcacatttttgttgagggcctccaacacgtcagagattgtgctaaagattaatgataagtaagatagaaatggtccatactctcatgaggcttacatgagtagttatgtacaaattaacaggagtcaaacatatatacaaaactgtaataacacaacaaaataagctcagactttcaagatgaggattctaaagggactggcttttttgttttatatatttatatagttgattgatttcagatttagatacaaaaatcagggaaataattcaagctagatagatgtattagaaaacttagattatgagaaaggtatccataaatctctcaaaatcgtagctgatgtttttatgataagtttctgtctgtggaattaactgacatatgctactttggttttctttttatgggcaagaactttgagtttttaattgtaggagcaaaaggtaaatgttaaaactgatgagtttgctatgtggcatatgtatgtggctgtagaccagtcccttcttccattacctaaaataatatggttaacagtatattccctcatttaagatttctattctttgtaaccctgtgtaaaaaaaatgctagatttctatggaacatattttatttagtggcactcgaaagattttaagcaaacttcactataaaagcagcataatagtgagatacagttcatttcaatcttaggtctcacccaaatcagtaatattcaaatagcatagcaataggcagaatagaaacaaggatgaagaaaagatagtggtagtagataaaaatgaacgtggagtttatatctaaacactccctcaaaataatcctcaatttggcagtatttaattgttatgtgtaatatgaatcaaactcagaatccataattttttcagactttttctattttaaaatattgacttgatcctgtgtcttattaaacatataatactttttaatcctggtaatacacacatatacaaatgtaacatgtatgtgtatgtgtatatacatatatataattgcacgtaagtgtgatattttaaaatatactatcataaaaaatgtatggtttacttagtaatatttttctttttgtgtagatgacctccctcactgggtattatctgccatgaagtgcctagcaaattgtaagttaaatatatgtgtgtgtgtgtgtgtgtgtgtgtgtgtgtgtgtgtgtgttatattgatagtatttaacaagaaccaaggaaatttaataaagtcctgataaaattaaagtatatcatttctctttatttataaatgaaagtctagtggaatttattacattatggagcccttaattttttctgtttagaaaggtggcgattttttaattcaagcatattatttatggtttagttcacatatattataaagtcatagcctagaggatctcaaaggattttttaagtgaaatccacactaattgcctcagtgaggctcagagttcaaatggcttgaactccttggtatttctatagtgtagaagcatagaatactagatatattaatgtgactttatgttatgaaaaaaaaagattatctgtcattgtattagtttgttctcgtgctgctgtaaagaaatacttgagactgggtaatttataaagcaaagaggtttaattggctcatggttccacaggttgtataggaaacatggctgaggaggcctcaggaaacttacaacttacagtcatggcagaaggtggaggggaagcaggcatgtcttacatggctggagcaggaggaaggttgtgtgcagaggtggtacgcacttttaaacaaccagatcttgtgataactcactcagtatcacaagaacagcaccaaaggggaaatacacccccatgattcaatcacctcccaccaggccccacctccaacaccggggattaccaatttggcatgagatttgggtgaggacagatccaaaccttatcagtcactaatccagaaatttttttagcatttaattgatcaagcttttcgtagtgatcagtgataattgatttttgtaacataaaaccctagtatgagtacaaaatcctaattgctttcaaagttaattttttaaatgtacaaagatataagctaaatcatcaaaagctaaattatgttttaatagttacaagtataattttctagttcatacaaaattagcattttctaaatgctaatagggttttattaatgttcagggtaactttatattcctttgttgtccactgggtgtcaatatgataaaatgacattgaataaatagcaataaattaaatatatttacagaaacattttatcaaattaagattaaaatctttattatgaacttaagacttgaatttgtctttctactttccaggtatagttagctattcctctctttcattcctttgctcatggttaggaattcagataggcatactgacagggatttctctgacatctggtcttcagggattctgtcttccttctcgtttcagtctatgtaatacctaaacgataccaattatataacttactggattccaaattagcaacaatgtatttagccagaggcagtgttaagacttactttacttgttattcgatcccccagagtaattctgtgagatgtaggaattagtaatcagtataccatcccaatttttccaacagagaaagccaaagcttagagtatcttcttttagtgcaaatgagctagagctcaaacctagattctctataaattctatatttttaatatttttaattcctgtaaacatgtattttctgtcttagagaactttctaatgattatcaaatcttttattccacatactatttcttatgtccttagaaaaatatctattttgctctgttgttaagagtgtgtgtgtgtgtgtgtgtgtgtgtgaattgttttctttaattctttttcagtgtgtgctcacatttgtgtgtccatacaaaagtttggaaacagagaagtaagaaatattatttggacttgggaagagaaacattttaacttgaaagatagtataatggctctaaaacctagatgcataccacagtcactaaagagactctccagagattctgtaggtcaggaatctttaaaaaatatatatatatatatatgcctccagaagattactatagtgaagattctcaggttagtgtttggaaaacactcagtgaaccagaagcaaacatttctaggtcagtaaatttctggccccgccttcatggattatggtctccatagaggactttgtatttttaataggcacattggatgattctgtgatataatctatgaaccacactttaaatgttgttgtagctttaaaagtcctgggccttgtgcttattttacactgctctaacttctaattcaaactttgctaccagagtctttttcatcttgggcaaggtactctcagcctcagttttcttatctataaaatgagatcagatcttatttttgaggaaaacacaaatgagtaggtatgattatttcaatagttgtgtcaagcttaagaaacaacaatgtaaagatattatttaaattcattaaggctatgcttcatgtcagacaaaatatattcatgaacatgtaaatttacaaaaagacaatttgaaggaattatttgtgttgtccaaatattctttcctttacaaaatgaattacaataaaatcttattaaactaagcttccctaatgcttttaaaatgatattaaaattttgctttatgtatgatttttcaggtatacaaatgttaaacaaaatactagcaattgactgcttccagtggaaagataatgaggaagaatgaaatacaccctttaaatttttgaactgtggcagaatttgttgttaaacctagctccttcatgaaatacagattttatactttttatgtttaaaaattgtatttaaattaaaatatactttacctttttctcttgccttctacttcttagggccaagaagcaatgatatgaataatccaacttatgttggatttgaacgagatgtattcagaacaatcgcagattattttctagatctccctgaacctctacttacttttgaatattacgaattatttgtaaacattttgggtatgtatagattttactgattttagttcattttgttaaagttttcaactttcttataatttagaagatctaaaaccataggtaaatataaaggtggcagcctacaaattattttaaaattcagtgaaataaggttccgaggttactcatacttccgcccagccaactaccaattcgggacttccctcaaccccctaccagactcaataattcactacaatgattcacagaactcagaaaagcactttaactatgactattagtttattataaaagctagacctcaagaatagccaaatggaagagttacacagagcacggtatgagggtgggggtggcacagagtttctctaccctttctggtcatgccgtgatcccagcacatccatgtgttcactaacctagaaaactccctcagcctgcatgttttagagttttaattgaagtttaattaccaaggcatgactgaccaaatcattggtcactgttgtcaattgaactcaatctctagcccctttctcctcccacaaggttgtagttggtgatgaaaattcaaaccatggccggccctcagttaccttagcatgaactcagatacgctgaaataggcttgttatgagtaactaaagacttctatcattcaggaaatttcaaggattttaggagctccataccaggtaccaaggacaaagatcaaatatatgtattttattataccacaattatcttatatttatgaggtttctagtacttgcagactgagaacagattttttaaatgtattctggctcaatccatttaattaggctgttgaaataattttttaaagttatattacaaatgggaaaaccactcatctgtcttgcacgtttgtaaccgaatgttgcatgtgtcctatttaagtggcttctgaattaagcaactactgtgtatactatactaacaatatatactatagtaatgctttattttttaactttactattgtttttgttttatttttgtccactgtcatacagttgcatcttaatttttgtttcatttcctggtagttgtttgtggctacatcacagtttcagatagatccagtgggatacataaaattcaagatgatccacagtcttcaaaattccttcacttaaacaatttgaattccttcaaatcaactgagtgccttcttctcagtctgcttcatagagaaaaaaacaaagaagaatcagattctactgagagactacagataagcaatccaggatttcaagaaagatgtgctaagaaaatgcagctagttaatttaagaaacagaagagtgagtgctaatgacataatgggaggaagttgtcataatttaatagggttaagtaatatgcatgatctatcctctaacagcaaaccaaggtgctgttctttggaaggaattgtagatgtgccagggaattcaagtaaagaggcatccagtgtctttcatcaatcttttccgaacatagaaggacaaaataataaactgtttttagagtctaagcccaaacaggaattcctgttgaatcttcattcagaggaaaatattcaaaagccattcagtgctggttttaagagaacctctactttgactgttcaagaccaagaggagttgtgtaatgggaaatgcaagtcaaaacagctttgtaggtctcagagtttgcttttaagaagtagtacaagaaggaatagttatatcaatacaccagtggctgaaattatcatgaaaccaaatgttggacaaggcagcacaagtgtgcaaacagctatggaaagtgaactcggagagtctagtgccacaatcaataaaagactctgcaaaagtacaatagaactttcagaaaattctttacttccagcttcttctatgttgactggcacacaaagtaaggctgttgctttcaatgcatgcaatattaactttgagtgtttactaactctgtgttttgcttacctggcttttcttccttgaagttgcttaattttttttcctccaagaggaattatttaaaaagacttttgtctgtgacataaccaagatttattctgtttacctaaggaacttattttcttttttgcaatttcatttattctgagtcactttatttgtaataagtgaagaattttaatacttagaaataagttgtaaagaaaataatgagaatcttaccatgctttagaggaacgtaatttctagaaatagttaaaagatgaaatactaagatattattttaccttctttatatagctgtatatactggtagtatgaaagcaactagtgtcattgatgatttttgggggggtatttttgtattctaggcttgctgcaacctcatttagagagggttgccatcgatgctctacagttatgttgtttgttacttcccccaccaaatcgtagaaagcttcaacttttaatgcgtatgatttcccgaatgagtcaaaatgttgatatgcccaaacttcatgatgcaatgggtacgaggtcactggtaagttgatttcttatagaaagaataagtctgattcataaaccaaaataacaaaaccaaactacgtaaaagtactactcaagtgatgtcttagtcttaaagtgctagattcttaggttggaaaggctctttaacctttcctagcagcagaattttggtgtattaatcttttgtgcacactctgttatactttcacatgctgatgttaatcctggctaaggactttgcctgctcattcatcctgaatcacttcatagtgattgaccagtcagaccacgttatgttgccttgtgccaattctgtttggtggataaggaagaagaaatgtaggtactgttgaaagcctaaggagactataactgtggacgcagagaactaatggaacttaatacagtaagtcagtgtttcagagaatatagtaatggaaaagtaggtcatcgtggacaagaagttgggaagcactattgccaaacagccttaggctccttgtgaaaatgaggataagggcatttatatgcagacaattgattggaaatgaactcttgaaatagtatctttaatctctttctttttttttaagtcaccacttcctcaaaatgcaacttcaatttacaagaggttcttatagcaaggaatccggagttatgctttcttccacgcgttattaaagatagttctttaacaatgacagacctaatataaagaagaagaattattcttgagtaattatagcactattaaaaagctaggaagtttatagaggaagatgttttcagagacatgactgggaaggtgataattttggttttgcacttttaagatttgaagtcataggacctccaagagaaattgaaatttgtccaacagaatgttggaaatatgagccaggtgaagaaagatcaggggagaatgcaaattgatttggtcatttacatagggatagtacttgaagctatgagagtagatgagctctacaaggctaagagtgtgaagaaagagcaaaaggctgaggtctgagccatggaaggagacaggaaaccccgagtgatgtgtaggaataaaactaaaaatgtatcaattctataaatattctgatcatctactatgtgtgaaatatttaaaacaattctgatttctaagtattttagaatgaggggtgtgtgtgtgtgtgtgtgtgtgtgtgtgtggtacagttagagggttgcatagatataagtgaaagtaacgagagtaataagtgagagtaatcaattttatcccaggatttgaagatcccataagatggaattgaaaaatgtgtgttttaaattgctgtctaaagactgacagaataaacatttttaaaaactattttccagcatttcaaaagctaaatggcatcagctttgcaaccacttatgaatagaagtgttctatatgttacacattctcctggtttgtgtttttctgtgggattcatttaatgtaattagttattgttctctgacaatctttaagcttaagcaacatatatatgtggtattaatagaacctatggtgtttactgataaaattgtgacaaaattgtagaaaaaccaaagccttttataattcttgggaattacattaaggatatactttttttttttttttctggttacacaggatcacgctctgtttcccaggctagagtacagtggtgtgatcatagctcactgcaccctggaattcctgggctcaaaaaatccttctgcctcactctcccaagtagctggaaccacagtcatgcaccatcatgcctggctagttttttatttcttcataggtatagggtttcactatgttgcctaggctggcttcgaactccttgcctcaagtgagcctctcacctcagcctcccaaagtgcttagattacaggcatgaaccaccatgctcagccatggaaaaactttaaaaaggatttatgtataatcaaattcttacatttctaactgtataaatcgttgtcctcatttttaaactgagggctgcttaccactttttcccaatacttcacataatgctacctggaaattaccgatattctagtttgtatgcaaccttagctttttaaattcacatcttttaatatttttctagatgatacataccttttctcgatgtgtgttatgctgtgctgaagaagtggatcttgatgagcttcttgctggaagattagtttctttcttaatggatcatcatcaggaaattcttcaagtaccctcttacttacagactgcagtggaaaaacatcttgactacttaaaaaagggacatgtaagtattgtgagtcttaaaattctctgcaatagtcagttgcaagtggcaaactcatctcaaaatagcttaatcaaaaagggagactttatcagctcccataaacaacctctaaaagtcaggaatgtagacagaatctgggactcaaatagctatatgactctttccatccctccatctcttatttctgtgttgatcctgtgtttgacaatggctccttcacatgatgaggaatgtggctagttgaagttcatgagttagagccttacatttgcaattcaaaggaaaaagagccattcctccgtctccaatttaaaagctctggatgtagactcttagcatagttgaggttaaatatgcatcgtttaggttgttaagagtgagtaggatggagatagggccttactctgattggttctacacaaaggagaatttattcttcacaaaaggtgaaggtagaggggtaaaatgggaaggaactattaaaagaaggagagaaggaatactgagcagccaaaataacagacatctactgtattctgtctttggctgcccaacacatgtttatgtttttcccatacataccattctaatattgccctggcttataattataactatctcctagaatttctttctcttatcagaagatgttagaagctctgcctatgtccctaggcctcaaaaaaaaaaaaaatacatgaaaactaaaaatatttcatttcagtaaatatgctgatcatctactacctgcactgtcagaacattaaagtcttaagatgaattagaataacacttagattgttattttatagttaaaagaataaaatccatagttaatggtaataattataatacctgtctttatttaatgcttattgtgggctgagccctttctatacattttcttatgtaatttccattttaatgatgaagaaacagaccaagaaaagttaaatacattgttgaatgctacaaaccaagtagattatggagctggggtttagaacctactgacttacatacctctactgcataatacatagtttttttaatggctgaatgtttgattggtggtaaattaataggtgctagatcccatcaaaagaatactttatcatataagaacatgaccagaattaacagagttatatcattttgatcactacagattgaaaatcctggagatggactatttgctcctttgccaacttactcatactgtaagcagattagtgctcaggagtttgatgagcaaaaagtttctacctctcaagctgcaattgcagaacttttagaaaatattattaaaaacaggagtttacctctaaaggagaaaagaaaaaaactaaaacaggtaagagaatgagcaagttctcaatcatgtaaacattttctaatgtgctgttcctggttgttaataacatttagaatctactttcttattttaatattttagattttaagtttgagttatatagactatatattatgatgtcttgtatatgtgcgttaacctaaaacatgtgagtacctacctgattttgctctttatcctgaattttaaaataataccaacagtaataatatatactctcctttttcactggtattttgtataattatagcttggattagcctgggaaagcaatttataaggtatggatatgtatctttgagtgacttatcactgttttagaatttttagctctgaaagcccagtagccacatgattttggcatgtctaattctaagtctgagacactgaaagaaatatgaatactagatgcctatgcccttcataggttttatcagtgggaaagaagatctggaatttagggggagaattaacatcggaagagaaagaatcctaaaatgttaatgttaatgagatctaagagatcttatagtattcacatgagaagagagagggaaaggcaaggataaaatgaaaggatactaatctctatactacgtctttgagaaaaacactgaattcttataaaatgttgagcactgcttcagcttgggaaataatgttaaataccttctaatttctcacctcatttttaagtttcagaaggaatatcctttgatatatcagaaaagatttccaaccacggagagtgaagcagcactttttggtgacaaacctacaatcaagcaaccaatgctgattttaagaaaaccaaagttccgtagtctaagataactaactgaattaaaaattatgtaatacttgtggaactttgataaatgaagccatatctgagaatgtagctactcaaaaggaagtctgtcattaataaggtatttctaaataaacacattatgtaaggaagtgccaaaatagttatcaatgtgagactcttaggaaactaactagatctcaattgagagcacataacaatagatgataccaaatactttttgtttttaacacagctatccagtaaggctatcatgatgtgtgctaaaattttatttacttgaattttgaaaactgagctgtgttagggattaaactataattctgttcttaaaagaaaatttatctgcaaatgtgcaagttctgagatattagctaatgaattagttgtttggggttacttctttgtttctaagtataagaatgtgaagaatatttgaaaactcaatgaaataattctcagctgccaaatgttgcactcttttatatattctttttccacttttgatctatttatatatatgtatgtgtttttaaaatatgtgtatattttatcagatttggttttgccttaaatattatccccaattgcttcagtcattcatttgttcagtatatatattttgaattctagttttcataatctattagaagatggggatataaaagaagtataaggcaatcatatattcattcaaaagatatttatttagcaactgctatgtgcctttcgttgttccagatatgcagagacaatgataaataaaacatataatctcttccataaggtatttattttttaatcaagggagatacacctatcagatgtttaaaataacaacactacccactgaaatcagggcatatagaatcattcagctaaagagtgacttctatgatgatggaacaggtctctaagctagtggttttcaaactggtacacattagactcacccgaggaattttaaaacagcctatatgcccagggcctaacttacactaattaaatctgaattttggggatgttgtatagggattagtattttttttaatctaggtgattccaatattcagccaactgtgagaatcaatggcctaaatgctttttataaacatttttataagtgtcaagataatggcacattgactttattttttcattggaagaaaatgcctgccaagtataaatgactctcatcttaaaacaaggttcttcaggtttctgcttgattgacttggtacaaacttgaagcaagttgccttctaatttttactccaagattgtttcatatctattccttaagtgtaaagaaatatataatgcatggtttgtaataaaatcttaatgtttaatgactgttctcatttctcaatgtaatttcatactgtttctctataaaatgatagtattccatttaacattactgatttttattaaaaacctggacagaaaattataaattataaatatgactttatcctggctataaaattattgaaccaaaatgaattctttctaaggcatttgaatactaaaacgtttattgtttatagatatgtaaaatgtggattatgttgcaaattgagattaaaattatttggggttttgtaacaatataattttgcttttgtattatagacaaatatataaataataaaggcaggcaactttcatttgcactaatgtacatgcaattgagattacaaaatacatggtacaatgctttaataacaaactctgccagtcaggtttgaatcctactgtgctattaactagctagtaaactcagacaagttacttaacttctctaagccccagttttgttatctataaaatgaatattataatagtacctctttttaggattgcgaggattaagcaggataatgcatgtaaagtgttagcacagtgtctcacatagaataagcactctataaatattttactagaatcacctaggattatagcactagaagagatcttagcaaaaatgtggtcctttctgttgctttggacagacatgaaccaaaacaaaattacggacaattgatgagccttattaactatcttttcattatgagacaaaggttctgattatgcctactggttgaaattttttaatctagtcaagaaggaaaatttgatgaggaaggaaggaatggatatcttcagaagggcttcgcctaagctggaacatggatagattccattctaacataaagatctttaagttcaaatatagatgagttgactggtagatttggtggtagttgctttctcgggatataagaagcaaaatcaactgctacaagtaaagaggggatggggaaggtgttgcacatttaaagagagaaagtgtgaaaaagcctaattgtgggaatgcacaggtttcaccagatcagatgatgtctggttattctgtaaattatagttcttatcccagaaattactgcctccaccatccctaatatcttctaattggtatcatataatgacccactcttcttatgttatccaaacagttatgtggcatttagtaatggaatgtacatggaatttcccactgacttacctttctgtccttgggaagcttaaactctgaatcttctcatctgtaaaatgtgaattaaagtatctacctaactgagttgtgattgtagtgaaagaaaggcaatatatttaaatcttgaatttagcaagcccacgcttgatttttatgtcctttcctcttgccttgtattgagtttaagatctctactgattaaaactcttttgctatcaa

SEQ ID NO: 365 - DNA, 110475 bp, Homo sapiens
atcggagcccatgggagatgtgggaggccggcgtggccccacggaggagcggaaccttgggttggcctgtgcgggctgaggaggagttcaacagagtgacggggtattctgggcaggggacagcctttgctggaatttttcagcccttgcgaaggcctcgggacgtgcctgaatgggatgtagtaagacggacagagtcagaggtaagtgagaacgtgccgccaccacccattcgagggtcagcagccattgtccccatgtttttccgcgtggggagcaggcacaggtggggacacaggcctggaacccgacagttacacacaaggagatcatgtgagacaggcccagcaaatggcccacaggtccttgaggggactgtggcctgggtgctggctctggagggcacctgtgatgatgtggacacagcgggtcggagcccaggggacgctgggggcaccgggaagctccctgtgctttctgctacgaatcaccaccgccaccgcccagatacgtttagttgtgaaataacattctgaaaagtgcaggacagaaacgaactgttcatattacctgaggtcaggagttcgagaccagcctggccaacatggtgaaaccccgtctctactaaaaatataaaaattagccgagtatggtggcacatgcctgtaatcccaactgccagggaggctgaagcagaaggatctcttgaacctgggaggtggaggttgcagtgagccgaaatcacgccactgaagtccagcctgggcaacagaatgagactctgtctcagaaaaaaaaaaaagacaggaaggggagggagggaggaagaaaggcagaaagggaggaagggagggagggagggaaggtggtggaaggaaggaaaaaaggaacgaaggaaggaagaaagggagggagggaaagaggaagggagggagggaagaaagggagggagggggccaggcgcggtggctcatgcctgtaatcctagcactttgagaggctgaggcaggtggatcacgaagtcaggagatcaagaccatcctaggtaatactgggaaaccccttctctactaaaaatacaaaaaattagcctggtgtggtggcgggcgcctgtagttccaggtactggggaggctgaggcaggagaatggcgtgaacccgggaggcggagcttgccgtgagccgagattgcgccactgcactccagcctgggcgacagaatgagactccgtctcaaaaaaaaaaaaaaaaaaaagaaaaagagggagggaaggaagggaaggaaatgaaggaggaaacctccctcctttcctgtgttactcttgccaagaaataacgttaacagcagggacgctgggggatatcagggagccacctgcccacctttctgtcatgctctcatccctccctccattccccctcccttctttccctccctccctcccttcgttcctccctctcttcgttcctccctccctccctcccttccttcctcccttcctccctcccttccttcctccctccctccctcccttccttcctccctccctcccttcgttcctccctccctccctctctccctcccttcctccctccctctctttctccctccctcccccctccttcatttccttcccttccttccctcactttctttcctccttcccttccttcctccttccctccctccctttcttccttccttccttttttccttctttccaccttccctccctcccttcctccctttctccctttctgcctttcttccttcttcctccctccctccccttcctgtcttttttttttttttttttttttttttttgagacagagtctcactctgttgcccaggctggacttcagtggcgtgatttcggctcactgtaacctccacctcccaggttcaagagatccttctgcttcagcctccctggcagttgggattacaggcatgtgccaccatactcggctaatttttatatttttagtagaggtggggtttcaccatgttggccaggctggtctcgaactcctgatctcaggtgatccgccagcctcggcctcccaaagtgctgggattacaggcatgagccacggcacccgatctcttcctttctttcttcctcccttccttccttcctctctccctcactttcttccttcatttctttcttcctctttctctttttcttttgcttctttcaacagggtcttgctctgttacccagaatggagtgcagtggcacgatcacaactcattgtaacctcaaactcctgggctcaagcaatccacctcagcctcttgagtagctgggactacaggcatgcaccaccacacctggcttattattattattttttttgtagagacggggtctcactatgttgcccaggctggtcttgaactcctgggctcaagcgatccgcctcagcctcctaaagtgctgggattacaggcatgagccaccgccttgcttttcttcaattttctagtttttcatcactcagtgatagagttaattttatctcttcttgaacataatataaatggaatcataccatatgtttgctgttgtgtctggtttcctttacccagcgttgtgtttgtgagattcttctatattctgcttatctgtagttgactcatttttattggcgtatcatggtactccattgtatgaatatacacaatgagttcatgcactgaccttttgatggacatttgggttgtttccagttggaggctattatgaataatgctgctatgaacattcttgtgcatggtttttggtgaacaaatgcttatgtttctatagggatatacctggaaatagaattgctggacataggtatgcgtatgcatgggtttggctgtctatactgtttcttgtaactgctataacaaattaccataaacgtgctggcttaacacaatataaatgtattttctcacagttcaggaagccagaaatctaaaaccagttccactagactgaaattaaggtgccagcaggactgcactccctcctgaggcttaggggagaatgtgttccttgcctatctcagcttctggtagccaccaccatcccttggcttgtggcagcatcactccaatctctgcttctgtggtgccttctcctcttctgtctgtgtcaaatcttcctctgcctccctcttagaagggtatatgtgattgctttaagggcccacccaaataatccaggataatctcttcatttcacaatctttaattacatctgcaaagtcctttttgccatttaaggtaacattcacaggttccagagcttcagtctggacatctttcgcaggaaatttttctttcctctttttttttttttttttttgagacggagtctcgttctgtcgcccaggttgcagtgcagtggcccgatcttggctcactgcaagctccgcctcccgccattctcccgcctcagcctccctagtagctgggactacagtcgcccaccaccacgcccggctatttttttttttttgtatttttagtagagacgggatttcaccgtgttagccaggatagtcttgatctcctgacttcgtgatccgcccgcctcagcctcccaaagtgctgggattacaggcgtgagccaccgcgcctggcttttgcaggaaatttttctgcacactacactctccaactatttttctgaagtgtcagtaccagtttactctcccaccagcactgaatgagagctctctttgcttcacattgtcaccaatactatgtgttgtcagatgctttaattttgctgatctgatggatgtgtagcagtttatcattgtggtttacttttcttcttcctaataattaaattctgctctttcttgaatgaggagtaggaggtctttgagtgtatagagtgggtgagggtattccaggtagatggaatagcatgtatgaaggtctcaggaaatatttgtttaaattgaataagaggtttaaaagaagcattaggttacttaaaataagaagaattattattaccaagggtaaatacgatgcagaggtagacttttctgtttccctcaaacaccaagtcattcaacaagcatttaccagcttaaacacctgtcctaggtactacaagatgagttagatccaaccccacccttgataaactctggcttagtagggaacatgatcactggggacatctcaaagggatgtaagagggactgaggacccagatttccttgaggcttatgtcctcaggttccaccaccctctatcccacttccctgttgacatccgttgactccctggtcacttcacctcgttcctgaagactagcacctgctcatagacttcctctccaccccaacccatgctctcctgctgggatatttaactgtccctgataatccatcctcgtaatgatctagcctcacagtctctttccacttcatctctggtgaccttcatcccactttagtcatccactcccatgaccacaccttgggtttagtcattaccaggaagtgtaacatacatagtgaacatttacagagcacttataccacatgccaggcactttgccaaatgctttacatgtgtttacgcctgacacaaacctggaaggctggtgttagtatcctcattttacagatgaggatatacactcaggaaggtaaagtcacttgcctgggtgacacatttagtaaaatggcagagtcggaattctaacacatgactttctgagttccaaataaaaaatccctgattttaaccacaacccagttcaaaatccagcatcctgctctctgatcccagcacctgcctttcagatctgacagcccctcactgccatcacacctgtggcgtcaactcaaagagagctctactcccttgatccctctgttttctgccagtctgccagacccctcctggcttctctcccttccttgcccagccagagtctcatattggaccatctgagctctttcactagctctctaatagtcaaggtcccagcaggaaacagaaggcaccacagctgggattttgaagataatttaatgaagggactctttgcagaggtgtgggcagggttgaggtaaccaacaagggaggtgaaggcagcaggaagctgtgaccacccttaggtctgaaggagtgaggaaaggattggtattactggagtgctgtgagagtcatggaacatgcctgagaggagctggagttgtggaggggcacagccactgtcagaaccaaggtgctgacacagagctgggagttggagaagaagtatccagaatgctttctttttctgttctctgatgccctgctggtgcttcttttagggaggaacctaatttgaagtcagagagcaagggggggtccgatgatgccacccatatgggtagagaagaatggagggtggacctggagggcaaatggaaaatgaccagcatatgctctcaattcccttacaatcctacaaccctagccttttttttttttttttttgaaactgagtctcgctctgtcacccaggttggagtgtggagtgcaatggcgcgatctcagctcaccacaacctccacctcttgggttcacgtgattcttgtgcctcagcctcccaagtagctgggatcacaggtgtccactgattccccattttttcaggttacacacttaaccagacctatgctaaaatccactttaccgttacatctataggtgttaatttaacctttatcccacagaacttccttggcctaccaggtatgcctcgacgttactccgactatcctgatacatataccgcatgaaatattatctcatccataggctcatttatctcagtaacagcattcatactaataatctttataatttttgtatttttaatagagacaggctttcaccatcttggccaggctggtctcgaattcctgacctcaagtgatcagcctgcctcggcctcacagagtgctgggattacaggtgtgagccatcgtgcccagccccttatacccccagccttctgcctcatttgccagcatatccctaactgtggtccaggtggtagaacttggctcagggaaaaatggtggcagagtagcacatataggtgtcactcaaacttcttagccagccccctctctcacttacccttctcccttgagcatccctacaaccctaccctttcagtctcaacaaataaaattgaggcaaatggaccatgatttccttcaacttgttatcaaacatatatatatatataggtttttatacatatatatacacacatatatatataaagatttttttaaacaaatgaaacaacccttcatgtagccacacccatatttatttcacttcttcaagctctgttcttgtcctcctctccacctgtgtattgctcatcccagcatgactcccagcatgactcttactccatctttcttcccttccctgtttccacaccttccctcttctctgtcttccttcttaacctatagatacatccatgtttctaccaccttagaaactaactaaaagaaaaaaactcaccaggtgcagcggcttacgcctgtaatcccagcactttgggaggctgaggcgggaggattgcttgaaccaagagttcaagaccagaatgggcaacatagtgagaccctgtctctgctaaaaataaaaaaaaattagccaagtatggtggtgtgcacttgttgtggtcccagctactcagggggctgagggaggaggattgctggagcctgggagattgaggctaccatgatcccaccactgcactccagcctaggtgacagagtatctcaaaaacaaagaaacaaaacaaactccccccgccgcactcaaaaaaacctctaccttcctccaggctatgctcccctcgtgcttgtccttcattgtcctcctcatctcatcccaaattcttgaaaggacaagtatgagttagggttctttggctgcagcaacagagaccgactcttgctaacttaagcaagaaagatatttattagaaggagattaagatggcactcacaacagagggagagactgaagaagcagccttcagaaaagactagaaccagggcagtagcagggattgaagtagcaggaaggaatggcagcttcctcagggccctgggtacaacataaatcagctgcaatcagatttgggcctcctgtcacataagctcatgattcaaattccagggagagcttctgactggtgcagcttgagtcttgtggcctcccatgactccccttggcctgtggacagctgagtgccctaacagtctcatggaagcatatccagtaggacgtgggtaatggttactcagtgaaaagtcagggagccattacagaggatggcgaaatggatgctgggtgggcagaaacattggtatccattcctgcttaccagccccggccttcaccttgcatttgagtcacaactcactgaaaccactcacattgagcttgttaaggactttctcttgccaaatccaagtacatttttcatctttatctaaagctttaactccatcgaccagtacctctcttttagaaatctttccttccttggcttctgtatattaaatcaacccaaaactcccttccttccttccttccttccttccttccttccttccttccttcctctcttctcttcctcccttccttcctctctccctttctttctttctttctctctctttccctttctttcttttttcttcctctctctttttctttctttctctttctttccctctccctttccttccctccctccctcccttccttccttcctccttccctcccttctttccttcttcccttcctccctccctctctctgtctttctttcactttctttctttttttttttttttttgagatgaactctctctcgtcccccaggctggagtgcaatggcgcaatctcggctcactgcaacctccgcctcctgggttcaagcaattctcctgcctcagcctcccgagtagctgggattacaggcatctgccaccacgcccggctaatttttgtatttttagtagagatgggatttcaccatgttggccatactggtctcaaactcctgacctcaggtgatccacccacctcggcctcccaaagtgttgggattacaggcgtgagcctctgcacccggccctttttttctttttttttttttggagacaaggtctcactctgtcacccaggttgcagtgcagtggcaccgtttcagctcactgcaacctctgcctcccagacttaggtgatcctcccacctcagcctcctgagtatctgggaccacaggcacgcaccaccacgcctggctaattttttgtatttttggtagagacggggtttcactatgttgcccaggctggtctcgaactcctgagctcaagcgatctgcctgccttggtctccgaaagtgccgggattataggcatgagccactgcaccaggccatagtcttttataacctaatctcagaagtaatatcccatcacttttgccacattctattcatgagaagtgagtcacttttgaaatgaaatatagaatgatttaaaaaagtcaaaaggttcagcccacgttcaagcagagggcaccacacgaggacatgagtatcaggaggcaggggtcactgggacctcttaggggtggcctaccacagcctccataatgaagcaggctcatggttctcttctcttctccctgacagcttcttctgtggtccatttagggacttcatttctctgcccacctgtttttttttttttttttttgtgatggagtctcgctctgtcggtcagaccggaatgcagtggcatgatctcggctcactgcaacctccacctctgggttcaagctattctccctacctcagcctcccaagtagcttggattacaggcgcccaccaccatgcccagctaatttttgtagttttagtagagatggggtttcaccatgtttgccaggctgatctcaaactcctgatctcaggtgatctgcctgccttggcctcccgaagtgctaggattacaagcttgagccacctcacctggcctgtttttttttttttttttttttgagacagagtctcacctaggctggagtgcacaatctcagctcactgtagcctccacctcctgggttcaagtgattctcctgtttcggcttcagcctcctgagtaactgggattacaggcaccctccaccacgcccgactaattttttgtatttttagtagagacggggtttcgccatgttggccaggctggtgttgaactcctgacctcaggtgatccgcccgcctcggcctcccaaaatgctgggattacaggcgtgaaccactgcacctgacctctgcccacctttgaaatgtggcacttctcctgggctcttttctgggcttagagctcttcacattcggcgtattcttcttgagggacatcatcgactcgtgatttcagctatcaactctatgctaatgatgtccagatcttcagcccagagacctctctctatgacactgcacacaactgtatcccaatatagactgaagaactaatataactctttgctggatccaggacatgtctcataggcacctcagatataagaggttcaagaaagaactttgtcgaataagttctgtgcctcctcctattttctcctgtctcaatgaatgtcacctccatccatccgggcatccaagtgagaaacgtgggcatcatccttggcaccaccctctccctgacgctcatatccaaacataaagccctgctgacttgagttacctccgggttttttaaacctgttgcctccttcatgtccctgataccaatgtcaatactggccattagcatctcttgcctaggctattgcaatagcttcctggtttttcctgctttcattcttgtcctctcagattcatattctcaaaaatgcaaagctgctcttgatgaaaacccatcagcggctccccatggcctcctagatcaaaagatacttaatgattgggccccatctagcctctccagcagcatttttctcttatggtttatgctttagcaatcccaactgcctccctgcacacaacctactcttcctcacctgtgtgctcttgttcatgcttccctccaattttaatgactccttcagaaggactatttcccctttaaaattctttttttgtttttgtttttgtttgagatggagtctcgctctgtccagccagggtagcctggctggagtgccgtggcgcaatctcggctcactgcaagctctgcctcccgggttcacaccattctcctgcttcagcctcccaagtagctgggactacagacgcccgccaccacacccggctaatttttttttttgtattttcagtagagatggggtttcactgtgttagccaggatggtctcaatctcctgacctcatgatccacccgcctcggcgtcccagtcccctttaaaattcaagaaaatgccgggtgtagttgtgcgcacctatagtcccagctactggggcggccgaggcaggaggataacatgagcccaggagttcgagtgtgcagtgagccataatagtgccactgcactccaacctgggcaacagagtgaaacggcatctcaaaaataagtaaaattcaattttcccagtctagttttgtgtcctagcacactatagtgttgtgatttatatatgcatttgtgtctcttactggaccgtgagctttcttgatggcaggaattgtgtcctattcccctttgtgtccccggtaccttctatggaggtcatacaagtatagatactcaagctgtgtgtattggatggatgaatggatgaactggaggtttacattaacatatgattttaagttggttcttggagtcaaatagaagttagccagggggacaagagtgagaagggcattccagttatagggaactgcaagtacaaaggccaagaggttaagggcagattcaaggaagtggtggtggtttggtgtggttgcagtacaggatgcatagtggtgctccctgtagagggaggggagccagttactgtgaagggtctgaaaagctgactaaggagtttggcttttgtcctgtgtgcaacaggaagtaagagtttgaagcaggggagtgatttgatcagagccatattgtagaaacattaccccagtagccagtgtggaggatagactagaaagggggcaagaggggagactgggaggccaggtagtaaggagattcatgggccaagcaggagatgtggaggcctgaactaggacactgggagcagggaagagaggaggagatggatttgagaaatactcggttgaactctatgaaattcccattttgtaagaaaaagctgggtgatattgtcaatttcatatggtttaaaattttaatattaatgaagtaaatgaactggatgggatttcaatcctgattggatgtgaatatgaggaagaggaaggtgtcaaggacagggacaatttttctgacttgaatgctagattggatggagtatcaccatggggagtgggaaccaaggtctaggggcatggtagagaagatgacatgattagattagacatgttgattttgaggtatttttggaacctctaggaggtggctgggtatcctgatgtgaagcttaggagagagggctaaactggagacaaatttagggattaccagcatagagaaagcagttgtgggaggggatgattcaccctgggagagcagcccagacagagctggagaaccaagagagtgaggtttcttagatgccaagaggattttgaaaagatatttgtggctgcatgctgcagaggagagtcagataggactgaaaagtgcttgtaggatttagcaaggaggagactgtcagggacaagggtgtgtcttggggggcagtagtgggagtgccttggactggcctctggaagggcatgctgggcctggacttggaggtgtcccttcgtccttagtcatgcatcacttcagccaccagggggcagtggccacatggaatccaggttggagggattcactggggcccacaaactcttggagatgtgggcagggttgggggataggtccagagcagaggctgcttcctaatggagagagacatccccatgtgaaaagagcagggaggaagttctgggaagggcggcaggaaggagacctttctgtggggcagacaggaggccaattagaaatccccagtcttggcccagagcggtggctcatgcctgtaatcttggcactttgggagatcaaggccagtagatcgcttaagccgaggagttcaagaccaggctgtgcaacatggcaaaaacctgtctctaccacaaaatacaaaaattagcaggttgtggtggtgcacgcctgtcgtcccagctactcaggaggttgaggcaggagaaggtcgaggtggcagtgagttgtgattgtgccactgcactccagcctggatgacagagggaggagagagaccctgtctcaaaaaaaaaaaaaaaaaaaaaatccccagtcgtgtctcatagtttccttctctctgggccttttcaggtgcaggtgggttttattcaacatggtacttcgaatagcaatggatttgtattttgaaccctgattttctttgcactcacttcttgatagtcttactctccattctgtgttcaaaacatagtgaacttttttcagttctcacctgcttccatgtgaaagctcttcttccatgggaacgctttctccatcctgcctcctgtttatccttcaggtcttatctcaggcatcacctcttctcagaagccttccgtcactgccccatccacctcctcttggctcccatagagccctatcttgagtcttgaatattctggctggtaattatttatttatttatttgcaatcagctttattgtgatataatttgcatgcaataaaattcaccagttgtaaatgtacagtttaatgagtttacacacacacacagttgtgtaaccaccaccacaatcatgttacaaaacatttccattaccctaaaaagttccctccggcgcctttgctgtcagtcccctccttccactgcagcccttttcaaccactcatttgcttttccgtcacagtagttttgctgtctagaatttcatgtaaatggaatcctacagtgtgtggtcttctgcatctctcactttggttttgaggtacttctgtgttgctgtgtgtatcagtaactgtgtatttattgttcattccctcccccaccaacaacttcagatgagggtctctatgagggcagagttgtgtctcatttgcatttgtttcttcagcttacagcatagtgctaattcgtgatagtattcagtatgcatgtcttaaatggaaccaaactgaatgcttggggagagtcagcctgggagagcttctgaacccgggtgtgcataaggcaggacccatctgcaagatgcctcatggccttttcatcccactccagctgctcctccatttactttggctggttctgctcagcaggccctcacttctctgcccttctctaacctgcttccctttacctggtcttcgattccccgcttgtggtctcagggccctgctccattgcctgctccagcctcctcctggtctttggaagtctccacaccactgagccctggcctccctgagcctgcaagtctctccactcctcctcctgcctgtcccaggaccctacccacttcagatgactccacatctcagtccagctctgcatacctctctgtctgtgcctccgggtccctgtctctgggccccttctaggatgatggagacagctggctgccccatcctagggagctaggttgtgattcctcttcctttctctcttttgcttcaccttcatcctccgactcgaacaccttcccataggaggccactggggcaacctctaaatttcattcagaccagaaaagcctctgtctgtttcttatttctttcccttcggtctttatctccttctcccatctcctttctcctctccccagtccccttcactcttcctgataccctcactctgctctgctcaccattcacctcccttcctcctcctagcttcctcttttctctcacacccattctcctcctgtccttgttctcttccttgctcccgcaccacatctccctctgcctgtgtcctcagggcctcctcccttccttccatacatccagttccagttccaggtctctctctctctctctctctctctctctctctctctcttttgagacagagtcttgctctatcgcccagggcagtgcagtggaacaatcttggcttactgcaacctctgcctcctgagttcaagtgattcttgtgcctcagcctcctgaataacaggtctcttctttttgctccttgtccttgcaccacttttttccttctccccagtttcttcccttcctgctttgtgtgccttcgtttcccttatcttacaccctttatcctcagagattataagggagccccaagacttgtaaccaagacaccaagatgtacacacacgcacacacatggccacagatgcgcgaacaaatgtttcattaatgaacaaatgcatctatctaaaggtatgttcaaggccgggagtgttggctcacgcctgtaatcccagcactttgggaggccgaggtgggtggaccaccaggtcaggagtttgagtccagcttgaccaacatggtgaaaccccgtctctactaaaaaatacaaaaattagctgggcatggtggcatgcgcctgtaatcccagctactcgggaggctgaggcaggagaatagcttgaacccgggaggcagaggttgcagagagccgagattgtgccactgcagtccagcctgagtgacaaagcaaggctctgtctctaaataaataaataaataaataaataaataaatgtatgttcagacgcacacactcaattaaggtcatccatagcttgcaatgttttgtacttagtatacatcaggtactattatttgtatacatgtttctgaaagatgaacaggcagaatgaggagggaataagagctgagctcattcgtacaggaagagccatgtacatgcacacctgtacccagagatggccctcactcagacatgcacacacacacattcctcagaggaatctggtacttctggaattatgctatttcagaagcagagagagcacacatgtttttgctgtgttgtgtacagtgtatggtgtacgtctttgcatgtgcctggtgtgtatacatgtgctgcatcagccttcgtggaatcatgactcggggctgggcggagccctagaaatcagttaggacaacctgcatgtgcggattgcttaagtctcctattggatctgacttttgtaagtccatgagggatgtcagcttctgcttaatatggatattctggataattaagataccaatcatgcataggttgtggaccacagactcttaacatactggcaagtaagcatatgatatggacttagcacatatcaaaccaagttttttggatccttaaaattggtgctttagcctggggaacatatggagacctcatctctgcttaaaaaaaaaaaaaatagatgggtgtggtggtgcatgcctgtagtcccagctacttgggaggctgaggcaagaggggattgcttgagcccaggagtttgaggctacagtgagccatgatcacgctgcggcactccagcctgggtgacagagggagaccctgtctcaaaacaaacaaacaaacaaacagacaaacattggtgctgtgtgcttagtgtatactcactgtatacacaattattatgtacttggtcattcttaggaaggatgaccgccccccaccccacccatgtactggtccttgtaggtgccagggccaaggcagggaacaggacatccttggtctctgccctgtccctgcttcccttctagtaggtactcaggctgtccatagctcctcctaggtctattgtacacgtacagatggagggacctgggagtctgctgggtagattcattgcagggtccagtattccttgttgctccttccagaatggatagtgtgtgggttgtcattatatacacccttttttgagttctctcctcactattgggaccccatgtgcctttgtatgcaagcggagtgggtgtttcttatgttcagttttgttatgtgcctttgtggatcaccagaacctgctcatgggtgtctcttatgttcacactagctaagtctattaggttggtgtgccagctttgtaggcatgggggatagggtacttcctgcattcatttatgttgtgcccacacagtatgggtcccagggaggctggttggtaggtggctatggggtggttccgtgtccactatgttcatgccctgtaggcccatgtgcctagtttgtgtgcagttggagtgggcgtttcctgtatttatttgtgttgtgaacacactgtgtggatcccaggagtctgctctgtatgggggtattaagtggtcccatgtccattatgcatctgctgcataagacccaaatacctactttgtatggacagagggtagtattccttgcatttatttgtgttgcgcacacagtgcgggtcccaggaggctgctccgtacagggagtagtaggtagttctgtgtctattatgcacacgctgcacaggtcctgggtacttactttgtacgcccacggggtaggtgtttcctatatttatttatgttacgcacttccagtgtaggtcttgggagcgttctccatacacgtgggcagttggtgattctcgtgtttctcacacacacatgagggtcccgcgtgtccactcagtatgcatggggtagccttgctggtaacaaagcgaagggcggttgcagctgctaagccaagaccgcgcagcgcgtgcctgcgtcctcctcctcctcctccctttccctccctgccttccccctcctgttccctccctctcacaccccctcccaggtctgggtaccacttgcaaccctatcctcctctttgcaccactgcacccccgcctgcagggggcgggagccatgcaccctcccaagaccctgtgcccaccttcccctggtcggagccccttcacccttggccttcctttccttcctccctgtctccaagccataatgtgcctggcacaggggaggtgcttggtgactgggcactgccctcctctctttcttcccctcctctcccttccccactcctctcctttctgctgttcttccctcccctcctgtctgccctttcccccttggtgcttccctggaccctcttgtcaccttcctactttctgctttcaccccagcctgtcccttcctcctttacctgggctctgtctctgccccccatccccagccttgtctaccagacctcattctctatttctgactctccatttgtctcttcttgtctctgtctcgcatctctctgtggatctctgtccaactgaaagcctcttccagtgcctttctccatctcactgtgtctctctgtgtgtctcctgaggtttctctgttcctgtcactttcttgcagtctctgtccatgtctctgcatttctctgcctcactttgactctctgggtctctgtctttgctttctttctctcaccatctctgtatttcttttcatctctttttatgtcttgatctctgtttctctctttgcacatttctttctgtctctgtttcttaggttctctctcagaatccctatgtatatttctctgtgtttctgtctacaccttcttgtttgactctgtctccttgtttgactctctctgtgcctttttctctgtctcagtctcagtctctgtatcttttggtctctgtcaatgtctgtctttctggctttgcatctctccatctctgtttctctgtctctttcaacggctctttcaacggctctttcttaatctctgtctgtttccgcaggtctatatctcttacctctgtgtgtgtctgcctctgtctctatgtcttcctatctctgtatctctgcaacactgccttacatcttcatttgtctctctttgcgtgtagctttctcctatctctgatttgtgcatatctatctctcttatttctgtgtctctgtctttgtgaattagtctctttctctccccatatatattttttcactatctctctgtctctgtgtgtctacttctctgtggctatctttctgactctgcatctctgtctctgcatggacctcttctccttatctctttgtctctgagtgtctctgtggttcttggtgcccctttatgtccccatctgctccctcctccctcctctccccccactctgttcctgtgtctctatatttctgtgtgtctctggacatctctctgcctccatgtcccctatacttcctgccctctcccttctccttttcctctttgtctctgggtgtctctttgagtctctggcttttagggcctctccctgcctttgagtcccctgtgctccccacccttctctgtctcttttctgtgtgtccccgtgtctatttgtttctgtgtgtctctgtgtctctgagcatctctctgcctctaggagtctttctctgcctctgcatcttctgtgctccctgtcctgtcccctctctcttttttctctgtctctatctctgggtgtctctgtgtctctgagtatctctgttagtctctggacctcagtgtctctccatacctttgaatccctctctgctccctgcccctcgcccttacccctctgtctcttactgtgtgtccgtgtgtctctgtgtctctgtgtgtccgtgtgtctctgtgtctctcagtatctctgtgggcctctgtcggtctcaaggattgtccttgtctccgtgtccccttctattcctacccctctcctctatctctgtgtctctgtttctgcatatgtctgcatctctccgtctctgtgtctctctgtgtctctgtgggtctcgggcctctccctgcctccgtgtcccctgcgctccccgccctctccctctccctctctcccccctcgctctctcgctcgcgctctctctctgagcatccttgggcccggggttgccatggggacaaggtgggagccggggatggcgcgcgcctgggctcgcgccggcagctcaggcgaggagcagcggccagagcagcgccagcagcaggcagcgagcgggcgcgggagcgggagcgggagcgggggtagcgttggcggcggcggctcctcctcggccatcccctcggagccgtgcagctgacgcgcatggcgaagacagcggcgcctaccgatgggagcagcggtaaggcaaggcggcgcggcgcagccgggcgggcgggcggcgggcagcctcctcctctccccagctcgcctgcgcgcccgcccgcctgccctcccttcctccctctcccctcgcagcccctgcccgcccgcccgcccgcgccgcgcttgcccttccatttaaaaatctttaaaactttgcatattaatatctgcgctttgcataatctgacccgcgctttattgattgcaagaagcttaatgcagccggctcggcctattgcagagagctctccgggcgggagccgggcgggagccgggcgggcgccgctcactccgcaccgcgctccggctgtcagccgccgccgcggccccggccctctcgcctccctctcggcgcccggcgccggggctttgccccctggctgggtatttttattatttggggatggggggggtcagcttgctctcgatggcagtgagggaaccaaaggagaggtgtacgtgggggcggggggcagggatggaaagaaatggggacggagaggaggtgaagagggagaggaaaaagggagaaggggcaagaaggatgaggaaaggagaggcgtggagggggaagcagtagagagaggagagggcagtcggctgaggacggagctgaaaggacggaggagcggaggagcggaggagcgagagccgaggcagaagagaaaggagggagtcaagagcgcagactagagaaagagcctgacggccgcagagctgaggaaagaggcaggcagtgggcgcttcgccgctgctgcccccgggccaaaaaataaagaaaagaaaaagagaaaaaaaacaataccaataaaaagacgatgaaaataaaacacatcgcaaccagggccactgaacacaaaaaggagcgaggacagagaagagaggcgaggtggcatctgctcccggctggctgcggcgcttcggagaggctccccgggctgggcgggacccccattttgaccctgcatttgaggaaggggcgactgtggagaaaatgaggcgagagggggtcagggctggtggcggttccgcctgtttttttttttttctctctctctctcttttcctggaggtgtgggggccggtttagtacgatgatggtgaggatattggtcggtgatgctgtctgaagctccgaagcaagcagggtgcaatggggggggagaggtaagagggcacagggaacgagaaagggctgggtggtgggaatgaggggtgagagaaaggaacggggtgccttggagagcagaaacggtgagaaataggaaaaagcagccgggatggggcactcagaggcggtggcatctcaggcaggaggagaggtggaaaacggagctccagggccccagagtgaggttggggagccgcggtgcacccctcagctctctggacaaagtctgtaacttggggaaccccttcgactgcctgctgcctctttggtctcttttctttcccttttcatgtcctttctcagctcctttatttccatctcctttactgttttttctttctcactgtttttcagtttctatctcttccttttctcaataaaagctctttctcctcctccccaccccttagtttttctttttctacctcccttatctccacctccttcccttcttttttctccgtttttcccttccccctttccccctttcttttattcttcccttcctgccactcatttcccctgttgccagctctttctaccccctccctcagtttcatttattcatcactcttgctgctctggccttcaacagggtgccagggaaaggggctccatgcaaaggcaggaatccccaacttcctaccagagcctaacccctgttctgaaaccccatgtatttctaccctcttttttaccctgagtgggggtttgggtctgtcccctgggttctagtgccaccccctacttccttgtggcctcctggagaagtcctgctggatgctcactggggctctgggagggggaggggaagatcttaagtgagggctcatggctgtcgactcagccccactgagaagggtgtggacagagaagaaaatgacatggatgcctagcgggaagtgaaaacgggaggaaattggggcggaagtccatctgagagagtccttagagcttttgagtccaggtaaaagatcctgagagaaagcctttggcctgatgaccactccccactttctgcctccttcctggggcctgtggagttggggagtaggtcctggatttagagaaagacccaatcagccgcttcgctcagtagcttttagtctcttgccatcttgtcaggtggatttgtccttccaccccccaggatataaggggaaggtacagagtcagtgtgcagtggggggctggtgggtacagagtcagtgtgcagtggggggctggtgggtacagagtcagaccatgacggcagcatgcatgtgtataaggcctgcatgtgtggtgagatgtgttcaggaaggactaactgtgtgtgctgggcctcgaagccttggcagagtgaggagccaaaggtgtagaatcgtgacatgtgttttcagtggggggttgggtactgggggtccccatcatgggtgacatatgtgcagaagggagtcagtgcatatttgtactgatctctccctcgtcctgatgtttatgtatcactcgctatgtgtgcattcaggaggccctctttggctctgtgcgtggaagccgtccacgcgtgtgcaggcccatgtgccgagtctggcttcagcagtggacacgtgacactttgtatgtgcagcgtgtttggagtgaaggctctgtgtatgggtactaggtctgaacatagtgtgtgcacacaagggtgcacatcaaaaaaagtcacatatgtgaaagtaccatttctgcatggagatattattattgttattgctcggggtctctgcgtgtcctgggtaagagggagggtgggtttgtgaagcagggtctgggtagagtgatgagagatgtgtgagtgcacagaggtcgcgggcgtatggctgagtttgacggcatgcttgcacagcagccttgaagctgggttcaagaaaacaaaacaagaaaagatcccctctccccacagtctatcagcccatgaaaagcttccctggaccttctgtagtaacaaagcgtcccatgtcagggggtgacaggcaggccaggagtaaagccgatcagggccataggcagcatctccagttgctgataatgcgattccacatctacttcctgatttatgggtaatgctggacagaggcccatccttgccgttggagaggtccagacccccatttccctgaggctgtgctggcatgtgctggtgaactctgtggcaggttgcagtgtcatctttgggggtcttggttgcgctcacttccctctgctagtctttgcagggaaaatggaaggtgtctgtgtcagggctgtagtagggaaagaactcagccacagtgtgtgtgtatgcacacacctatacccatgctgtgtgtgtagaggttgttagcctatacgtcctagacagcatgctggccaggtgttttttttttttttttctagcaagtccgtcagtggccactccaggccacctccattctggttcatatacactcccttcttgtatgcagggcctataagccagaacttcttcctccaccaatgtgacagcaaagcaagggccccaaccttagcaccccactgggtagagcttttcatagccctggtgcataatcataatgtgtagaggcatgacttgcaacgaggggagcagggacagatggccacaccaggggctacttggacatcgatgatggcaagggagaagtttccatctctggcatgtgctggttaatttccaagatatttcaggatggagatggttgagaaacccaagtgtgaagagttgttagaagacagagtgggtgtaaggcctcctcagatggatgtctattcctccttctaaatatatttcactcatcatttttcccttgggctcaacacctcttgatctaataataataatgaccatgatgtcccttacacccacctcgctctcacagcagccccagtggtgtccctctcacagatgagaattctgaggcccacatcatttgctcagcctgtcagcaaccatgctggcgctagaaccaaggtcctcctcataccgagccttgtctgtccttataggtctgtcctatcccattagctgtcccagcgccatttcctttcactggctctgtctcttcccccacttcctccctgccccctgagatgtccatccacagacctgtctcccaggacctgtcgggtggatggatgccttatgtggttcagtgagggctctaaggatgtgggtctcgctttatatcctgaagggagagccagcaaatgagcatggttgagctcgttccatcagtgatggtttggggctgggcctgttcaaacacaggggtttgcatgagcttatggtcccccctaccccttttggtgagccctgtgtcaccttttcagatccacatggtggccttgggaggcaggtgcattttccctcactcgatcaccaccccaacttcattagatcctcgggacaggcagctttcccagctctgacgcattcggaaggaggctgaaggtggtggctccacatgcaaggtccctgcattcaataggtatttattgagtggtgtgaatcactgaacaaataaagtccagtgagttccctgaggtaatcgggcaatggtggtatgatcactccttaacctgaaaatgatcgctaggcactgaccatgggccaacaaaggcctagactctgaagcagaaccaatcccagccttagacaggattctgggcgcctggactgtgagcacaaagggagtttccaggtcattaggaatctggggaatgaagatggtgtgggtttagacagggaggtgagtctttaaggatgctcagatactgagaaaagcagactggtggcagggcataaagatggcagaggaaagtgaggagaaagcagcccaggttggaggtgtagtctaagagtagaggttggcacaatgttgcaaggccctgtctgtggaggctcagctgctgctctgagaagttggaacttgatctggctggcagcggggagctattatgcctgcaatcacacacacatacacatatacacatgcatctcgtgacaacgtactttggacaatacggacttgtctatgagcatgagtgtgcttgtgcacacacacacagggacctttattctggcatccattcagggtctccctcacagaaaccaacaaggttgggggttactttagtccacactctcaggatcctataaagtatagggctgtggcccacacacgcaagtataagagcagactggggaccctcccccacccggggtgcagactcatgtggcattcacagacttaatccgccgcagtgaggccagggaggcagcatctgtcactttcacaaacacaagcaacggagtctgagagaggcacattccacttgctcacaactgcttgagaaacagatgcctgtaccgcactgccccccatgcccaaaacagacacggcccctcatggccccccacgccaagcccaggccaatacaccaagtcactcctgcattaaagtgcacacacacacacacacacacacacacacacacacacacgaagcgcagcccctgacattccatctccccatatatacaaccatatactcaggcactctgactttaagcacagctgctgacttcctatccccttattcacacacagacacagacacacacgcatacacacacacactcattttgacttaaagcacagctatagccatcccaccacccatacacatatacctacaagcggacttccacacatactcaaacacacagcctcacaatccaccagaactactgtggccagcggtcattgaagaatgacagcctgagcagtgtgctgaggggagggtcgccctgaggcatgggccgagggtcatacaacagggtacatcggaatcccttgaggaaaaggtcaggccgactccaaaagggttccattggtccggacggttctgccaggtaagggagattcaacaaatgcaggccagaggcaggagccgactaatggccgaggccgctgatggccgagatggctggtcagcgaggaggggaggctcgacaactgatgtgactcagagctggacaaatgatggcgcatttggctgaagctggctgggggcccatgaccagagaccaggcagccattctcgcctcagcggggaaagggccagatccggctctgttgcagcagggtgggtttcccagcctggatccaccatgcatcctgcctgccgtgtgtgtcttggggtctttgtatgtgtgcatgtttgtgtgcatgtgtgttcatacatttatctgcagttgtcagcatgtgcctaccttcgtagaactttgtatctttgggactcctggtgtgcatctatgtatgtgcctttgtgtatgtgtttgcttgtgcgtctatgtgtacatgcccacccacaaagtgttcagggacctttcttgttggactctgcatttttgggtccgtgtgtgtgtttgcgtctattgaatgtgtagaaagctttcttactgtgagacactatgcactcttgagcattttttttttttttttggcgttgggttgaaggttggggtggggaagaagcgatgggtctggctctgcactctgagccttccatgtatctggtggcccatgaggccgtctttgtgcatctgtttgagcctctgtctaggtgtcggcgggtgtgggcttgtgtgattgcctgtttcagagtttgaatatctgtgtgtccacagcagcatctccctcggagcatggatgtgggtggagtgggccagaccaggatgaggggggcatctccctgaatctcatcagacctctggaggggggtcacacaacccatgctgagcctggctgggacccagcagcacagcacagtgcagaccacccctcctcctccttttccccccatgacctttgagcacagcagccccaaatacatatttatcagaggggctgtggggaccagcccctcccccaccactcccctcagggcccagcctgcctggctgtggagaaattaaccttgtgacacaggagctcgctgacaccccggccccctccccatctgcaaggcacatatgagcaagggtgtgtgtgtgagagagagagagacagagaaaaggtactcatccagactgggaaggcgcagcagcgaggggaagaaagacacacaggtacacacgcacatgtgtttatatcaccccgacacacacacacacgcacacacacacgtgtgcgcgcactcattcgccaaactagagaggccacgtaagtcttgaacggatgcacaaggcaaatactgaaatacataagcatgcagacacatgcaatgatcctgcaagagacatacacagattctgaaacacatggtagccatgtgcacccttgggtcctgggagccagatacccatacttttggtcagagattccctaagaaaattcatagatgctaaaccctgcagatgcacatagacgtttgtatatttgtccacagagatgccaaaatggacacaccaggtttggaaacaggggtaaacacatactcagacacaggtatgaaaacccagatgtctgtgcaggcacataggtgctgagacctctcagggcaagacagacaccaaaacaccagggtgctcctcgtgtggagatttgtttttcaatagaaaatgtacgaatagaaatactaaaacatggcagcatcccagcctatatgcctgtgggtgcacacaggccacattcagaaatcccacagggaggccacacgtggtgaccgaaagggccatgccctgagttatagcacacaaacaccccccaggctagcctcatccccctaaagcaaaacaaaataggtagatgttcaagtgtgaaaatgtgtatagaattaattaactcatcacataggtactgagcctctataggagtcaggccctgtcttagaagctgaggaaacagtggtttacgagacagacctgggccttgctctctaagagctccaagccaacaggactggcactgatcagacctcagtgtatagttagttataaatacacctggtaaggagaggaaaaaggggctacaggagggcatcacggaagaacctggtttagattggtaggctaggtgtaacatctctgaggaagtgacatttaagcttgacatcaggcacaacacacagattctaaatgtgtacacatatccctcctgaaactcacagagcccacacaggcataaataatgcagcactcagatgcccctacccttaccccactatgccgcacttttccctctagaaaactcctctggcatgtccctaggtgggaaatgggatcctttcacctggggcccagattctgggctctggatgaggtgcacaaagcattctggggcagtgctgagtggggagcccaggaagattcaccaaggaggagacatggagagggtgataaggtgcagagaagaaggcagaagactgtctaaatggagatgcttgcctgggcaagggcatggacatgtgaacaagcctagactgttcccagcaatcatgtgaggcccagggtcacgggaccttcaggaggactgagaggagactttacatgactgggaagcactgtgaggcttgggatttattcagggcgcaccacataaccacaaaacagttttgagagggactagacagagcatgtgagccaggtaccaagtctgatctctctgagcctcgtgtggggacaggacaggatgggtagcccctggaggaagggatccagtgagcaggccaccagtcacaaggacttctgctctacctgtccagtctgggaaccctggccaaggtctggtgagggaggtggtacagaactaccttccccttgctcccagccccatatcttggccactgctacgacttgcccccaaatggagatttgctagggaatggaggtcaggagctatagtcacccttactttctactgacgttctattgatttctgagcctcctgtggccaggcctgagctgcatgcccagtcacccagatgaggcagatctttccatgttctagagtagtcctcagtctggggaggttgaccctgacaaagccctgtcaagggactccgagggcttactgagggcttcttgggcttgttcttggagaatgaatgggtcagaaggccccataggcaatatgggcaatgggtgaggctggagcctggttttgtgagggtgagaccaaccctcacctgccacagagagagcctgtcatttctcccatcacacttagaacatctttcttggcttgcaaaccctgtatgagctagcgcctgtctgtctattcaacttttactccctccctcctggctctggaagctcaagccattctggccttcttgctgttccttaaaccttgttcctgacccagggcctttgcacttgctgtttcctttgccaggaaagctgtcaaaatctaccttctctgataggcttttcctttatgtttaaaatagcagcttttttttttttttggagtttggggggacagagtgttgctctgttgcccaggctggagtgcagtggtgcaatctcagcccactgcaacctctgcctctgaggttcaagcgattcttgtgcctcagcctcttgagtagctgggactacaggcgcacgccaccatgcctacctaatttttgtatttttgtagagacggggtttcatgatgttggccaggctggtctcgaactcctgacttcaggtgatctgcccgccacggcctcccaaagtgctgggattacaggcatgagccactgtgcctggccaatagcagcatcttgtaagccactttctccctgctttattttccttcttaggtcttaaatatattttcttgtgtatcatatctcttcctccactagaaggtggattccacgatggcagggactttgtgttgttcatagttgtatccctagtgtgtagcacagtgcccagaacacgataagtgctcattgaatgttttgtcaaatgaactgaagccggatcccctgtcacctacttgcccaatatatcacctacttgcccaatatatcacctgcttgcccaatataatggtggaggtagacgtctgctgtgtcagacaagggtggcagagctcaccttcagggtgagcacttaccagtgctggaggggtacattggcaagtgagtccacctcctacctgagcctcagagcagccagactccaaaaccatcatcatcctgggcctgtatgctcccatcctgcaccctcatctccctcacgaccctcccctcactccaatcaactcctccttactcccattgtcagatctgctcaccccctgacgcacactgctgcccttcccctccttcacctccagcatacactctgatggcccctgcccccagacacaaaggaggggagaccacagactgtggagtcagacacacccggctttgagtcacatcactccttttaagcctcgagtttccttgttggcaaaataaggtttttgttgggatgaagagcagtggcacgtgtgatgatgacgctaataatagctgctatttattgagtacctgccaggtgttaggcattgtgcaaggtgctttgaacttttttttgttgttcattttaaaaaacggaggaaaaaaaaaaactctgagcatagagtgtccccagagcatgagacctggtgcccagtgctgtgaatgacaaaagtgaacatagtccatctgcacagagcttactattccagtgtgtgcacacacatacccaaagtgtcacaccagtcaggtgatggggagcttgtgctcctgtgctcgatccttttctgcagaaggcccaagagatagtttgggggccattgcggcagcaactgtcagagataaggggccatccccagccatccttaattcccctttaccaacctaatgggagctctcattgttcatatctggattgcagggcccagcatgggatctggcctagaattggcctcaggaaatgcttactgaatgaatgaatgaatgaacaaaggaatatatttagctgagtgtcttcattgcatttgttcatttgctcaggttaccaagacaaaccttctcccttacctacccaccaccttcacttactactcacagcatttatggctgctgatggtaatagtattaatttctcccactcattgccccttttttgtgtgtaaggccttttgctaagttccctataagcacggtcttgttggcttctcacaccagcaaaatgaggcagctgttattattatcttcatgctatgtttgagcaaactgaggctcagagaggtgaagtgacttgcccagggccacacagtgaggaagtggccgaccccatgtttacccactgtgctcttctgccccacagaagtgcacattatctcaggagtctgcatgcacacttgttcttgcagttgtccccctcccagtagttggatggcactactctgatccaggagcccagatccccagcttctggtcccagctgtgtcatgaccagttgagtagctctgggaaaatcccttccctccctctgggtcttcgttttccctccagcagttcctcctgtctgtaagccctcagccagtttcctgaagaggggacaggggactgtatttggcttggtactaccccgcccactctattgagagcagaagccagaggagtgagctcttctccattcagcagacttcaaattcattcacattcttgagggcactgaactctgctgggtttggacataagggaagacataagacaagcctggctgggaaagggagagggaagcagagaaacagcactagaggtgcctccactaagtacctagccacagtctgtcaattacagacaaatggtgtgacacatgttcattgtagaaataacagaaaacagaaattcaatgagatgagaagaaaatgaccatgataatctagttaaacgaacaacaaaaaggacattaccttttgctatctgtctttttttttttttttgagatagcctgtcacccaggctggagtgcagtggagagatctcagctcactgcagcctctacctctgaggcttaagtgatcctcccatctcagcctcccgagtagctgagactgtaggtatgcgccaccacacccagctaatttttgtattttttgtagagacagagtcttgctatgttgcccaggctggtcttgtactcctgggctcaagggatccgcccacctcggcctcccaaagtgctgggattacaggtgtgagccattgcaccctgactgtcttagctttttttttttctccaaaggagattatggctatgagtttacccaaataatttattaaaatttagatacctgggacccaaactcagattttttttttttttgagacagagtctcgcactgtcacctgagctgaagtgcaatggcatgatctcggcttactgcaacctctgcctcccaggttcaagcgattctcctgcctcagcctcccaagtagctgggattacaggtgtctgctgccacgcctagctaactatttttgtatttttagtagagatggggtttcaaactcctgacctcaggtgatccgcctgccttggcctcccaaagtgttgggattacaggcatgagccactatgcctggcctttttttttttttttttgagacagaatgtcagtgtgtcgtccaggctggagtgcagtggcgcaatctcagctcactgcaacctccacctcctgggttcaagagattctcctgcctcagcctcctgagtagctgggattacaggcgcaccaccacacccggctaatatttgtatttttagtagagatggagtttcaccatgttggccagactggtccaaactcagaattctgatttctgttccaaatttatttatttttggtgggggaaccatctggatgtgtattttgtaaaaacgggatgatatgctacatacttgtttataacttgccttttcttcttcctaacaacagattatgaacatggtttcgttgtcaatgattttatttcatggtatgagctgagagaagtgtaaaaaaaaatttatttcaaacatgttttcaacaactctacagtccttctttgtatggccactatactatcatttattgtaccagtccccactcatatgatatctaggttggtttttgatttcccctattataattatccccagtttacaaatgaagacattgaggcttggatgtgaagcctctcacatgtgtgaaaagctaaggcacagtcagaggggagccggggaccacttgggtgccagcaacagtccctggcctccctcagggagggactgagggatcccgagaggagagaaaagcctgggtagaggaagccaccaagacataagacatgtgccgtgtcagcaggggcccttgaggaggagaccaccctcttccaggccccagagccaggcgtgatgccggcctatgtcctgcccactcaggcttccctcatcccttccgctgcccccctccctgagcccactcaccgcctgctccatccttgccagcttatcaataggttaagtggtcaggtcagtgatattgaccatttgattaggaccttgtcagatcaatccctggctcatctcgtgggcctcctcctctgcccacacactccctcctgttcttctgctccagggagcaggtggccacagaagcctctctctcccaacacagcaccccagaaccgggagccccatggccctttgtgggccattcctggttctctgtttaggtgcccagttcctgtaccttctccttgcatccacctctcttgctcatagtcgttagatcttgtttgctgtatgtcccatgcccctcggagtccaatcagatagaggtgcccccacttggctgtgtgaccttgagcaagtgactttacctgtctgagcctccattttccacagcagtgtcatgggatgacactcgccgaacaaatgtgagatgctgagagatcacacctgcagagcaatgacccacccctggtgcatgaccagcactcaggaaatgccagtactgatgtgtctgtgggtgccagtgtttccatctgtctatcggtggggttgtatgtgggcattctgtgtctgtgggggcaagtggcgtcatcattcttaggcctgtcccaagccctggcttggggtcattccctgtgctgggcaatgcttcggacccccaaaggagccaggccctgccttgccctcaaggagctcacagtctgccatgtacatggcaaactgaccccaggacacagcaaaccattatatacactggctgtgaggagacttgaggggccaggaccaaaccctgagcttgctttccctctgtgaacactggaatctaccctttatgtgcacagctgcaggaaatgtaggctttggagtcagacacatcaggttcaaattctggctcccactcttcctgtgcctggtaactgtgggccagctgctgcccctctctgttcctcagggtccccatctgtacaatgggggaagacatcttctaaatagctcccagtcttaaggcactgctgggaatacagctcctagatcccatggactgtctctctacttggaggtgttgtctgcttgggagagggatcctctcccctctgtcggagggcatattggggtttgggaacccgggagatgggatgagagttggaagcagatatgccagggatggtgctgcctatgggcaccacagccccaggtagcagagggcagggagactcaagtgtgggccctgctggagggaagcccaaggtgggggcactgcctgggggaagaccccagccctaaggcgctgtctgactctggcccccccgaggcctggggattccctcgcccaccccatcacttacaccaatattgacggttaatgccgtgtcgccaccgtgttcaacactcagcgcggctaattgttttgactgggaatcggcaaggcgattaaacgccatcgattttgccctgcgcgctgcatcgatttttaaatttcctattgatcccggccctaaatctccttaaccaagacctcactgtggagatgacagccgctgattagctccagggcgggggctggggggaagcagcccctgagcggggagcaaccccagctcctccctcccctcagggaccaggggttctggtccccttctgcccctgaagatgaaggcccagggagagacaggacagatggaggaggaagtggggagacccttggccctttttaccccccttttgcttcttgtttgggcttttccctggtctctttgcccccgctcccttcattcctctctgtctatttctccccatctcttctctttctctctccccctccttctcagtccatctttttctttctcctcctcctccttttgaactctggtgcctcccttaattcctcactcctccttcctacagggctgtggagaggctcagcaaaccctctttggggatgggcctcctgacctcttgcctacttctctgttctctccatcttgtacacaggaggtagaaggacctttccaaaggcaaactggattgtatccctctccctctctgacgaagccctggctgcttggaccaggcacttgacgccctgcagggagcagcccctgcaatctggaagcctcgtctttccccatttttcttactgaaccctggacaggcaaagtcctggcattctctcgttccttgcacctggttctttctctgattaaaatttgtcttccaggtttggcttgggtgttgtttcctccctaagtcttctgtgatctcacccaggatgcccgcagcaccctctgcttaccccagcatgttggcattggctcttccttctgtctcctcaacttgcctgtgagccccgtaatagagcagagaccttgtctaattcatctctgtcccctgccacacttgattcagagccagagaaatctcaatatttgttgatgaactaaatgcacaaatgaatggacaaatgtacaagtcagaaatatcattatgacttttatttttaatctccccagagcacataggaacttaataatgagtaaccttttcaaatttctttctcatttgttcctcgtagcagtcctttgagatacaccatttaatcagttaattcctccatccacccatccattcactccgtcgtccgttatgcactaattgagcatctcaaatttgccaggccctctgccaaacacaaaagcttcaagacacagttacagtccctgcactttaagaagcttccagtctgatgggaaaaacagatgttccacagtggcaggcactagtatgcccatttatgagttggggacacagaggctcagaggccagaagtgactactgaaggcaacaagtggctgactggacctgagttccaggcacctgactccacagttagccaactgcagctcctgatgatgtgacaggaggagggttcctccactggaggagtgcatcatcctgcatgaggatggggaattctccgggatgttgactgcattctcctctctctccaggttctcgactggaccgggttggtggcctgaatgtattagcttcgctgcgtctgcccaagaggtaaggaccacggccttagagttttgcttattgatgcaccttctggtttctcacagaagtctctgctttcccatcctcgtctctggcctcaccctgggtgtgttgctgcccttctccactctgcccacccagaggttagaatctgactgctttgttctcaccctccatgcatcctgtggctttcgggccaaaccagtggttcttggtgttgatgactgtgggtgtttctgctgatcagtgttacggctcagtaggagagagatgggggtaactcggtggctcagatcacagctttgggttcaagcacacctatgttcgaatctcttttcctgacttcgagggacttgggaaagtttgagcttccatttccttgtctgtaaatgggaatactaatagaacccaccttaagtgccatcctgagagcaaaaggagatagaggaagaagagccaggtggctgagtgatcctgggcatggctcagtttccccatctgtcaaaggagggtaattaatagcatttaccacatggaggtggcgtgaagatgaaagtacttattccttgaaatcgtgtggctgcaggaagtgggagctcaaaatatggctggaagcgttcccctgaacaaagaaggttttatgaagcccctccctgaagcccactgagactcccaggtagaagccatagttctcctgctgctcacctctgtgggaagcaggggctctggccatttgccctggtgtttgctccagcttgcttggtgaggccctggcaatgagcatctagggaggagggtggacagggcttctggggtgggacagccctctactgccacccctattcccaccagagaagcttaacccacaggtctcaggaccccagggaggcctttgggtgcccttgtaggactcctgggtaggagtcctttgctgtaccaggaatcacagtctcattttaagaagcagatggaagctgtagcccagggtttgcaacccagcattgtagggactatgatggactgaaaaatgcatggggtgggggactgctttttagctccactgactgttctcatgcacagatgcaaccctgacttgccagggtttctgatttttcaagagaagccaggaacccagacttgtgtgtgaagtcttccaatctttaaatgttggcaactaatgcaaaacttgcaaaatctcctcgtggtccaaacaacatatttcaggcaacctttggcccatagatacctagtttcacaacagtatagagcttctcccaggaaaacacatacctacatttgcccagttgtgctacactttgggatgatcacagaccccctgaagctcattcatggacccctgttatcgctgagagtgtttgttccaggatgtgtcatttctctagagtgctttctccagggaaccgaagttgcagtttttccaggaatcctcacatcctcgaaaagagagtcaaggaatttccaggttgcagaattagtttgggagctagagactggctttgaggaacgtctgaaagttgggctgaagtaacagaggggtttaattatgtttccagttggtagaggtcactgttaggtctatgatttcaattatttgtcttcaaatagatgttcattaaatatccatgatttcatggacatgtgggtgactgacttggtaacacgtaacagggctggtacattccagtgaggaaactgatatttattaggggccacctttgtgcaagggcctgttctgggcactttgcttttaatcctcacagcaaccctgtgaagtgggtgttggcacctgttacaagacaaagaaactgaggcacagagcgtgaaggcaacttgcctaaggccacccaacatgtaagcagtagagttagaatttgaacctgggtttgcctgaccttaaagctctcattcttttacctcaccaaaacccaccattgtttttggtatctccacagtgtggcaaatttttgcactttgggagtgaatttgatttcggagaccacctgaagtctgatttagcagcagctctgatgaatttagcaatgataatactggggccacttgttggtttttcaatagaaactagagatgattatacactagagagatgctttgctgatggagtttgtaaactggccttgaaggctgttgccaaaatatcaggtggttcaagaaaaagttcggcctcctgaggagacatctttgaaggaagccatactcttttaggtgtatagttttgttacgaaacaacaactacaataaacatcgccctcacctgctctgtctttcctttatagccacacttggaaggtgagtgatgccccaaacatgtctggaggcctcctcaatgctctatgtgggagctggagccccaggatgagtgagagaccccctcccagccctggggttgtggtggcctctgctgcctatgctcccgtgtgactccccctcctcctctcccttctggcccttcctccaaatctcctcccacccacagcagggccttctctccactctgggttggcttcacttctctacctcctcagctccccatctaaggctcctcaactctgagggcctttcttgacccatgggctggatgatgcctccttttccctcctgagcactatcaccgtatctgattatattctatatggttaatgtctgctctcagaagcctctgggtgaggggacctctctgtttgtctaacacatctgtctatactcagtccctggcacagtgtaagtgctcagcaagcatgagctgaatgaataaataagtgagcaaacagacacataaacctagatccatccatttattccttcagccaacattttctgggattccttgtgtgctaggcctcgtgccaccatctggagatgcagagaggcgggagacccatgtggcctttgaggggctttcaggctcgtgggggttcaggcacagacaccaccaatctgaaccaggggactgcaggatgctgggttaggggagagagggataggctggctggcctagggggtcctcaggaagtctttgggggtaaggagagaactcctgaaaggtaaggagaagccgagggctaagttacatttcgagtggatgggaaggggtgtggactgactgggctcctactcactattggggactgtgtatgctggcctggccttagagtcctcacagccagctacagtcccctgggtatctggtgccctccaagtgccagggcaagaacagggctgtggtaccactttgtctctccttcccttctgtccttccatccttccacaaaaagacacaacggccttcaatgtggagcggtcccagggtcacagaggtaacccagacataagcaacaggcatgtgccccagggtgctcacacaccctgaggggagtcctgaatgcctcggaagcagaagctttgctctaggtgagcggctttcatcctgggtctggtgaggtgacgtggaaggaacagaattcaaggctgcatgaggaggatgtttagccgcacatgaggacattctcccatggccaagagtgtaggtatggcgggggggctgccctgggatgggaggcgcaggccttaagggcagttcaggttcttcagacaagccggagaagccagggcgtggtgtcagggacttgtccacatgccccaggcccagtctgcctccttctgaattacacccctgggggctttggctagtggaatagggtgtgtgctattccagatgtggcttgaaggatggctgggctgggacagagctttagtgtagaggcagctctgggatgctggtgggctatggccgtgtggtgggacctatagggtggtctgtaactggcagctgtgtgatctgggtggtgggcaggggcactcctcgctggatgtggagtccagatgtgagggtctgtttagcattctggggtgctgggaggtggcaagagattgcttgatccttttggctgcctgtgctctgtcactgggtgggtggagacagctgtggactgggaatatttgtcagccatggggtggggattatagatgtgtaggaggtaaaaatggcttgcatctctgagccagttcggggaccagtgggtccctggaatccctgacagtcccacagcaaatgaaggtcaagtacccaccatcctggtaagcatggagccccaggtgccgagagcaggcactcggctctgacttcaaatagagagacgttcctcagggctcttcgaagcactggtgagggctggtaggcagagagaaggcctcagagaacggccctgggtgttttcagctgcgcttgttagaaatcttgatgcgcgccccacccccaccccgtggttgttgggctcacgctgccctgccaggtctctgcccctggctttccttcctttcctcttcctctccctttggctccagccccagcatcatctttcttccttttcttagtcttcattatgtgtcttggcctctccattcctccctggtcagctcctttttttctgagctggatctctgtgttgagtgttgcctgtgggttgagtcttagcttttgtctccagagagagccacactgagatctggaggctggggagatccagagatccggcctggggtgggtgtgaggtggggtaggaaagagaggaggataaaaggtgattgagggaaaaacaagaaaggaagtattcacccactcctagcactccaggacagcttctgaggtcctttacacagtgatccacccttgcttttctcaaactttcaagcaatcctcctgcctcagtctcctatgtagctgggactacaggctaggaccactgtgcccaaccttgcttttcttggggacgaggtggataggagggccagagggattgtctaagaaaggggaatccagaatacaccagatgggagtggagggagagggagacccagggagcatgcacctcatgacagaaacacagagaggggaacagagcaacggagaggagcaaagaggaagaggaaacagcagaaaagtcagaggcaggaaagcagagtgagggactcagagacagaaaggaacagagagaaagagagggcgcgtgcatgcgagctgagcgcatgagagtgcatcagagaaagatgaaggcagccgggctgaaggcaggggacaatgagaaagaaaaaacagtgcggggcagctgcagctgaggcaggtgggcaggactgtggggcaggaaggaaggacctcacacctggccccccaccccccaggctggccatgcctggcagagtacgaggaaattggccaaggccctggtgtgtgtggactgtgtgtggagggtgaggtggcggtgtgtggtaaggagggatgtactgctctccctacccatgtgatcaggtcccagtcggctctggctggtccctgaagctacctgagatcatccctgtccattcaccctgtcccctccccaccgtggctcacaggggcccagaggaacgtggaaaaaggcttgagcatccctgacttctggcctggggaatggggagaaaggtgtgtgtgtgtgtgtgtgtgagagacatcactttggacgtgatcccctttcagtttctctctagctttgccatctcagagtctctagtgggttaccaactcccctccaccactatctgccgtctgccttttatctctctggtctcctttctctctcactctcactcagcctttctgttcctctctgtgcattgccccctttctagttctccctgcctctggcccccgttctctctttatctgcgtcttctctctgtgtggctccatcactgggttttctgctctgttgtgtgctctttctctgtttctctctccgtctctccagtcactgtctctgcgtctctctctgtcgtgctctctgcatttgcccttcctctgctctttttctctgcctttgcctcctggttttggtgtctgtgtcccttccagtctctttcatcttctgtctctgcttctctgtgcatctctctgcgtgtgcctctgtctctcactctgccgttctctttctcttgtcgtctctcggggtctctggctgtccatccctgcctctgtttgtgtctctctcgctccccctccctgtccccccctttttttcctgtttctaacacccacactcacatcctacctctggagtaattgcttttgtctgggttggactggacttgtggtggggggagggcggggggagcgggtggcgctgggggggttgggagggacggaggtcgcttggtggagttgaggtggcatccaccaaagcaggggtgttgaggagcagaggtacagcctgcccaaggtgccgggggagggacgggggcctgggcccatcctggcaggggtctggggtctctggcagggaagggaaagaaggcaggcaggccctgacattgggatttggagatgatgtagtgataaaaccggctagccagtgtctccgtggcagcccctgctgcctcgccaccctcccccactcagagactcagggttgtagcctctacacacatacaccgtgccgtctacaccaagtcaccatgacacacacagggacacacccagagcctccagcccacttgtggaaacacactcgaccatcggcacacagggacacacagcatcacatagacacacagagaaaccgcatggactctccgacactcatgaggagaacctgcttccagtacacatagagaccaccgcgcagatccctgaagcacacgcagctgcccacaggcacaggcacagatccacacgggacccatggaggctcacgcacagcagcatccgtgctcagacacactctgtcaggggcatgcgcacgccaacacacacaggcttcccagagcacatgggaacacatagctaccccattaactggggacagaggagatccctgaggtgttcctgggatacatccccaagggacagacagagacttagcgtcagggaaacactcatggaagtgcatacacagccacccagtgctcctgggacacatccatgaactcatgttcacacacagacatgactcgggccaagacgctcgggtatgtgcagtcctagaatcccccagcagagcctgaggacacatgcacaccctgcgtccatggcagctcgcacaccacagacctctcgctggaacctcctgtccgaagccgcacaagcttcccaccccaaccacacatgtgcaggccagaccctggggtgaggccaaggcaacttctacccgcagggacccaaaggcggggcagccagcagctctgggggtgggcgcaggccggcctgagggttcgccccactgttctttgtgtccattcaccgtagcctactccagcacccaccccagaccttcccctgcctcatgggctcaggacagtgtctctctgaacccacaggtgccccctgcccacctcccagagctctgtccgtcacacaccttcaaagggccccatctttctgagctgctcccaattgaggggatgcctgctttctcccagaaattgtccctcaatttctcccagcccccttacctgaaactatggcccccatccccatctgcttccttgcccactcccatactcaccccctctcccggctgtccaagctctcagcctccctaagctctcctgctgtaggggagtggtggggggtgcctggcccctcagaggcctgggtaaggggtacatgatggtgggggacctgggtgcggctccgggaaaaggaagcaaggcaagcaagggagagagagagaggcagaggcaggcagccagccagccggctttatatccctgccgtattgatccaccatgtcacagccccggtcgatagccagccgagaaagagagagggagagaagggaggggaggtttgggggagggcagccgggacccctatagtcctcggcccatctggggccttcttggcaggctgtgggggcatgtgtgagcccatcccaccccctccaaaagaggcccgccttattctccccctcttcttcttcgctgcggccctctccccgagagtcacctcagccttcataggagaatttaagcacagaagatctgcctgtttccttctgtctctttggaggctccatatccctgtgggcatgggggctcacagctgttcattgcctcagctacccgttgcgccccacagtcaggctgggtggatgggaggccctgacgcagtgtcatgggtggattgtgaccaaccagagtgtgaatcctcctccttcactgtagccatgggcaaaaggggaaaactgtctgaaggcctcttccccagccaccgctagccaggtactcaggagcaccctgtctatgttggtttcctgccctttctgacggacgttaagtttcttcccacagctgtgccaggccagtgctcaaggtcacatttagactttttctcttctggcttcctcccctgcccactggcttaagagaggagaacgcttagcctcactttttcctcagcctcctcttccctctccatagaaccttctaccatctgcccccaccaaacctcccctgacctgggtgggggagggcaggagaggaagatgtcttcccttagtaggaagagaagtgaggggagagactctgggacagcgctgagaaccctgggcctgggccgtctcccctctctgggcctcagtttccccccacccccatccgaccttgcccaagctggaaggtctgtatggctctgggatccgtagggattggtacagatgggaggcagggccatccagagggtgagagcagggccagaggggtgcctgttgcccctccctcagccaggactgccctggtcccaggtgcgtccccccagcccccaactccccagggctccagttctttgtctgtccagatcctcctctcctcccagcccagcctccgagaggttgaggaatcaccttagccttgacccgagggggagggcagaggaggggcaggcggcccccacccccgccttctgcccatggccatccccacagcccctctcctccccgcttccctgagtaccaggccatcccgccagtgtcaggccgatgctccctttgttaggaagggggaggggaaagagacaagctgaggggacgtggcctgacccccgacctctccccctccctcctcccatctgggtccccaggggctcagagccaccttgacagacagttctgaccatcagccaaatggctccgggagtgagcagggggccaggtaggggggaggggaggaaggcctggccagggccctcagcccaccatggatatgtgtgtgtgggtactctgaggttggaaggaggccccttggaggggtggcagggggagatgggcatccacagaggacaggctctaggaggagcctggttggattgggggatacagaagcaaagtggggctcatcccagagccagcagttctgggcaccctgtggataggggcctggcccaggcagatgcccccaccccacccccacccggcctgcggcattgggagtgcagcgagttttaaaaaaaattaaaagaataaaaaaacaggagcaggagaagctgggggaaaaatatataagaaaaaatataataagaactaagcggtggctgcaggagagagaaagggcaggaggcagggaggggggtgcaggggggagggcggctcgggccctggtcgctgcgaaggccggccgccggcctctgcgctgagccctccgcgtcccccctgccggccccctccagccccgatcgatccagtttcttggcaataaagcatttttattgtcagctgccctgaatgccaaatgtgagcctggtcctgctcccctccgaacctgcttcctcaccacccctcccccagccctctccaccccctcccctgccattccccccaccgcaggatcagcatcgtccatcaccaagaccccctcctcttcctcctcatccatgtcagccgcagtgcccgcacatcttcaataatccaccaagccttccaccccccatctaggcctctgtgctcccttccctaaccccaaacctgcagaggagcagaaaggtggccatgggatgggtggtcttggggggcacagggatgggtaggaggaggtacaggagggtgttggggtcaccaggcagggagacgatggccacaggttgagggaggcattggccaaagtcaggatagccaaagcctgtccctcagcagccagcaggggacaagaacaggtagggtgtctgtggggaccaggcactgaagaggggagacagactgcagcctctctgcccctggttacagcacttcagctctcagtcccccagggcctgtctctgccccttccacactgaacttggcccttttctttgggaggcagctgggtgcaggaaaagagagagggccgggagctggacaccttcccatgtgtcagtctcagctctgcccggagcagccccttcagggatggggacgacaccacacaccctgctggactgctggtgtgaggggcaggggagagggtgttgggaagcaatttacaggaggcccttgtggccccacctctgcttgctcttccccctccctccctctttcttttctctcctgttttctttgtctctctttctgctgttctctctctctacctctttatctgcatcttcctgtctctgtctctctatttgactctgactctctttcctttattgctgcctctccctccagggatttaaaaacccccatacacttctctgttctaccttgatagtccccagttactctttccttacacccctcttttctctgccctgctgtatgcttttcactctgtctttttctaccctgcctgcgccccacatcccttgtctagccccatctctcttggttcatctcccctcccacagccatagaaagaagtggaggctcaggtccttggaacatcagcagaacacgcagaaaaagggtcttaagcccctcttctttctcttggcagtgtcagtgtctagggaagttcaaacaagtctacactcgcagagatggagctgggaactgaggggtggggcccatctgtctgccacagacgcgctgtgtggctttgctcaagtcatgctggccctgagccttggtttcccctgaaaagcgagctactccaagggtgtttacggcctcccctgtggattatgttgccttgaaagcccagggtcctctgtctcctagggagggagttgagggcaggatcttcaggctggggaacatggtcgcccctcctctctccttctcatggtggcttgggaaggtgaagctgcagacgtgggcaggtctagggtgccaagatttttcctctcggtctgggtgggagcgaggcccaaccagggtcatgctttaaggaacatggggcgtggattcaagacgcctgggtccatgtccattgtcagctccccagagcaggggccgtgacatcactggtgtctggttcattgcttgccacacagacaggattcaagggacatttgtggagcaagtgaggaagaacccgtgcaacagtagaggctggggtggggtggggtggggaggagcaagtcctgagtgggaggcacagccggaggagcagagggattcagacatctttgggttgaattgaggggaagttgacagatgggggcatttggaggatgaggaggatctcaggatgaccctgggtgtcctttccaagcctctctccttcacctaggaccagtcacctccacccaacaccaacaaggtctacattagtgcagctttcacagttccccacctctggcctcacagctacctggtttgcggaggggagtgaggatctctgtgttagagagatccctctgatgtgggaagacggcatttgtgtttcaaaggcgtgtacagacccacgtatttacccacatgctatatgcttgcttatgcctgaaacagtgcttacttttcactagttatgaattttttggcattaccgtcaaacaaaagttttccaattagtacaaggccttcctaatagaagacagaaaggtccctctgggccatgtgggaaaggccaggatgtgagcacaagaaccaggtgtcagctggggcagggctgggtgggtcttggggtggagatgaggttggcaggatcagctgaggagtatgagattcaggccaagaccaggaaacctggaaagaggtgagggctttgggggcgaaggatgaagaggggggcaagagatcaggggatgcttctcctgcaatgaccattttgcctgcctcagtgtgaggggtacaaatcccggctcttccatggactcaccatgacaccctgggaagggggcttctcctgtctgagccttatttcctcctctgggtcataactactacctcataggggtcagggaaaggggaaatacaaaacacaatgtcacctgataaatggccatgccctttcctgttgctcttctctctgactcctgcccatcctctaggttccaggtctttaagcttttgtatttgcagaggattttttcccaacgcactgtcaatattcattgactatttggatcctcaccactatcttgtaaaggaggaattattatcttgattttacagaagtggaaactgaggcttcgaagacttaagtactctgcctcaggtgcttgtccctatgcaggatccatttaagtcattcattccacctgtctgttgagcacccactatgtgcccagcgtttgttgggcactaaagatgtagcaggcagcagaaccagcatggtgtattttcatggagttgacaactagagaagatgcagatctttaagtgtaaacatcaatcaaatacaaaatcaggaactgataagtctatcccaaagaataaactagaatagggagccaggagagagggcaagttatttaagccaaaccttaaaagacgagtaggatttaatggggcaaagagcacaggaacagtgttccaggcagagggaatggcacatgcgaagggcctggggttgcaaagagcatggtttaaagaacagagaggagacagcatggcttggagcagggtaggcaaagaggtgagtgatgggggaagagatgagaggtgtcagcaggggtgagatgacataggactttataggttgggttaaggtgattgagttttattcccaaatgcatgggaagctcctggagaatcttaagcaagggagtgacaccacctggttacgttttagaaagaccccctttgggggccaaggggagacgagactatctgagacaggcatggaagaagggacaccttcggggaggagaccactgaagtcactcaggccagaggtggtggtggcctggactgcagtgggaggagtggaggaatcagacagcgcttttggaattggtgacaatatcaaggctcaaagaagtggagagcagagagtgagagtctgacccttccaaacctgagcttttcctcttaccaggtcaggtgctactttttccctaggaggctgcaggaagcctccatgaggcagatgcctgggttgcttatatttaatgttctccatgtgaaccctaaagtgcctggttggcactgagaagtttcttgccagaccgggatcttgcacagatgtgaatgggggggccttcccttaggagactccacagaggaggtgagctctgagtaaggtggtgtagggagcgagtagatttgaaggtgttggctcccctcacagctggtctttctgtatgagctcggagaatctgctagggccccacaaagtggagctggggagcattgtgcaatctgcatcccagaattgttgtgaatcaaggtgggcaggtgatgtgaaggcactcagtgaatggttcatattggcagaaggccataactggggacggggatgggagatacatggatgtctcagacagcaaagcccaggtccaaggccagtgtttctgctgagccaatgggacagggtgggcaagggtttgagggagaggaagagaacagtggatggcaatgtggactttggagtccggtttcctgggtgccaatcctggttccatctgtgtctccagccaagtgatttaactttgctgggcatcagtgttttcctctgtaaaatggggatgttaacaatgcttttttgtagagtattgagaagattcagtgagaaaatgcttctaaatattaatagtaggtggagggcttctctttaacttgtctaaagcagaactcttttttttcttttttttttttttttttttgagacggagtctcgctctgtcacccaggctggagtgcagtggcgcgatctcggctcattgcaagctccacctcctgggaagcagaactcttttttttttgagacagagtctcgctttgtcacccaggctggagtgcagtggcgcaatctcagctcactgcaacctccgcctcccgggtttaagtgattcttctgcctcagcctcccgagtagctgggattacaggtgtgtgccaccatgcccagctaattttggtatttttagtagagacggatttcactgtgttggtcaggctggtctcgaactcctgacctcaagcaatccacctgccttggcctcccagagtgctgggattacaggcatgagccactgcacccagcctaaagcagaactcttgattccctctcccaagcttttccaagagcttgtgtccatctcagtaaatggttgtcacaacaacaacctagacttcttccttgatccctcactttccttcaaatgtccagagctcagagtttgcttcaacgatgacaggcactgtgtctcatgcgatctgggctaatacagttccgttaagttaaactcctctgaatcaatgtagagcaccttctgtaggcagggccctctgtggatgctgctcagggtccgcacagttctgagagaggcacagagaggctgagtggtttgctcaaagttgcacagctaggactcagcagtctttgcagaggctgagagaggccaaggcagcttctaattcttgagcctcctagtgtactaagaacgaaggaatactgaaatggatttacagacctgtgcttttagcaatgacaacaataaaatgccacgttaactgatatttataaggtcatttcaggatttattaaaacaaaatgcatactatcttactggtggtgtggtctggcagtgtcattcaactataaagtaaaaaatacacattttgttttaatttcatcccctcaggaatgtgacacatgggccaagtgacacataggccacacctagccccacagctgggacttaactacctatttatgtgactctaaagttgacaccttttcagccatcctcagttgcttttgcagagatgcaagaggcccaggacttcacagactttggaggaagagaaatgtgcatgggatcagtgtaacagcaaggcctggggcaaggagagctgggctctggaattggcttgcccatgactgagtctgggcaagtccttgccctctctgacccgccttggggtgctcctctgaaaagggggtggataataacagcccctgctttagtgaattgttgggaagatgccaaaagatgatgcaaagaatacacataacatatgcctgcacagagcaggtgccatgtagctgctcttgttacttagtagaatagtgggatggtctaggggcctggagcatcgaggcttgagagctcctcaggagcatggccaagctgagccaccctgtgtccctagctcctggcacaaggtctggcacagtgggccctccctgaagatgtggaactgaatcgtgtggaagaggcgcttgcccaggctgagcaggagtggagcaccaggggaggacaggggaactgagtggagggcctggcctttgccttcttctcccgccttgtgaggccaggtgggcactcccattagctcccttttgcagggtgtggaggtcattgcccctttgtcagcttcttcaataaatcaataccaagcacctcctgggttgcaggtgctggagacacagcagtgaagaggacagacacaggctagtatgattattatcatggttctaatctgaatggtgaatgtgggttcacattaactcattattaaaaataagtaaaacaataagtgaatggatagagaaagagggctccatccagcccagtgatgggagtacgctgtgaaccaaggattatgattaatccaattttgtgcacctgggatccttctaaaagacaggatgagacataatgggacacacatgctccctgtgctggcataaacattcagtttgggggaaaagaggtaataaacaagcacgtgacacgaggcttgaaggtgagacagcaaaaagtgctagaagaaagtgcaacctggtagaggacgtagtgatgagaagtgccatgtgagacaggatgtcaaaaggcctctctgtggagggggtgtttaagtgtaattctggagtaagtaaggggacgagccttaggaacacctggggaaggactgcactgggcaggaggaagggcaagagcaaaagtcctgaggcaagaagaagcgcgggcgtggattgcaggaacagaaaggcagacagcttggaggaagtgagtgaagggggtggggagagaggagttgaggtgggcaggggcccttcagaatgaggcatcttgaagctggctcgctttgctggccttctctgtggcctcccaggcttgggtcgttagtaccctggacagcggccttggccctcctgagcgcttgccgtgatgggcactccctactgagcacacaacttatattaagtctgtttctgggcagtgaaatggggatggggaaacagatgatattgcaatgattggcccctgcccacaggaagcacacagtcattggacaagacgttaatgtacagtttaatgaattttttctttttttttgaggcagagtcttgctcttttgcccagggtggagtgcagcagcttgatctcggctcactgcaacctcagcccccaggttcaagccttagcctcctgagtagctgggattacaagcatgcactaccacacccagctaattttttgtatttttagcagagacaggatttcaccatgttggccaggctggtctcaaactcctggcctcaagtgacccagcctcagtctcccaaagtgctgagattacaggtgtgaaccaccacccctggccagtttaatgaatcttgatcgagtgaacatctgtgcattcaccacttgggtggagatgtcaaaggcacccagaagccccaccccgtgtgtccctttccaaacatactccttcctctctgctggaggtaactacaattctcacttttgggataatcatttatttgattttctgcatgtgtatcatttaatatgttctaattttaattaaaaaaatgagtacaggccaggcacagtggctcatgactataaccccagcatgtagggagactgaggagggaggatcgcttgagcccgggagttcaagaccagcccatgcaacatgttgaaatcctgtctctaccaaaaagtacaaaacttagctgggtgtggtagcatgtgcctttggtcccagctactcaggaggctgaggtaggaggattgcttgctggggggtggcagttgcagtgagctgagattgcaccactgtactccagcctggttgacagagtgagacgaccctgtctcaaaaacaaaaacaaaaacaaataaaaaaccccccaaaccccaaacccccaccaaaaaacaagtacaatctcattattaaaactaaagtgctggccgggcacagtggctcatgcctgtaatcccagcactttgggaggcccaggcaggaggatcacaaggtcaggagattaagactatcttggctaacacggtgaaaccccatctctactgaaaatacaaaaaattagcctggtgtggtggcacgtgcctgtaatcccagctactcgggaggctgaggcaggagaatcccttgaacccgggaggcagaggttgcagtgagccaagatcacaccactgcactccagcctgggtgacagagtgagactctatctcaaaacaaacaaacaaaccaaaactgaagttactacaaaagaggttataattagttaccttccagaccattttttctgcatttgcttaatacttgtacgcccatagaaaagatacagtttttaaaaatagatgtatgtgttttacatcaatgatatcaagttgtataaattgttctgcaacttgctttttcacttaacagtgtcttggagaacttttcatgtccgcaatccatagatcagtctcattctctttcataactgcatagtattcctgagtatgaatgtattataatttacttagccactgtcctatcggtggcatctagactgtttcttatttttctcaacctcaaatcttgatgtagttagtgaacatgtttgttcttagggcatggtagcaaatattaaatttaagattaattaagttcctggccaggcgtggtggctcttgcctgtaatcccagcactttgggaggccaaggcaggtggatcacttgaggttgggagttcgagaccagcctgaccaacatggagaaaccccgtctctactaaaatacaaaattagccaggtgtggtggtgcatgcctgtaatcccagctactcgggaggctgaggcaggagaatcgcttgaacacaggaggcagaggttgtagtgagccaagattgtgccattgcactccagcctgggcaacgagagcaagactccttctcaaaaaaaaaaaaaaaaaaaaaaaaagattaattaagttcctgtcagccaattttactgcccccatttcacagatgaggagcttgaggcttagagagagaagtcacctgcccagggtcacacagcaaatgaatggaggaaccagattccaaaccctcatctgattgactaccaaactagtcattatgttcacctgtatagatggttaaccatctgcagggcagttgtccttacccaacaaacattcctggagcctcagctaaatgcaggcccagtgctgggtgctgagtctacaagaacatgtcaaactgagccctcttctcaaggagctcacagtctgtaggtacagcctcattgggaagtgattcagtgcagtacaattagtgctaaagcccggggatactacctggagctgtggcaagactgaggtcagggaaggcttccagagagaggatatttgagcagaggctggtgtgtacagaatttgtggcagacaaagcaggcatgagggatgggacacataggggagcccaagttattgaacagaggagaaaggtgagctctgagggtgagatagctgaggaggttgagaggcaccatatccacttgggtttggagagccagccttggattttattctgtggaccatgggtgcctggaaggatttattcattcaacaagtaaggttcaagcatcaactatatgccaggcactgttaaagcaccaagaataccacagtgaacaagacagaaaaggacacctgtcttcagaaagcttacattttagagggtgaaagagacagtaaagcaaataggcggcaattgaatttcagagtgctctgaaggaaataaaactgggaatggagtggagcatgactagggagggtttctctgaggagtggcctttgagtggagtcttgaaggatgagaggaaggggaggaggtggggaacagcattcaagggggctggcaaggttgaaggccccatgttggggacaaaattagcttcctccagtgtggctgaggtgtggtactcctgtggccagcggggaggtcctgtagggccctggaggccacagtaaggggactgggtttgtcctgggggcagcaggactggagggctctggaccaaggccatgggctcttgcttttcagcctttggacagctccctgcgctgggatgacagcggcggcctctgagcctgcagagttggtgctgcgcccagtgggagctagagaacaggaagtgcgcatgtgggctgtggaaagcctgggggcagcagcaagggggctagggactcctgggccaagggcagagcctcattgaggaagacccagggccaggcgcctgctcccacaggtcattcagagaccctggtgagcacatggcagtggatgccaagggaccctgttcctgggggatctgcagtctgaatgagactcacacaagccaggttgaggagcagtgagctcaacaaaacagctgaagcacaagctttggggtcaacaagcctctgggttcactccagcctcattgtgtgactgtgggcctcagcttcctcatctttaaagtgaggatgataatggtctctccctcataagatgacagtgaggagtaagtgggttgccgagtatacccagccagggcctctttagagtaggttggccatgctttacctccctatttgtcaatggccagttgagccgtcagtccatctcacccgttcttgtttctttcaagctacagaatgttagagctggggccgggccacagtggctcatgcctgtaattccagcactttgggaggctgaggtgggtggatcacttgagggcaggagtttgagatcagcctggccaacatggtgaaaccctatttctactaaaaatacaaaaattagctgggcatggtggcgcatggttgtagccccagctactcaggagactgaggcaagagaatcacttgaacccaggaggtggaggttgcagtgagccaaataaagtaaaataaaataaaagaatgttcaagctggaagaagtcttagagtgcttctccagcccatctcagacatatatctggggaaactgaggtccagggagttcagggggctggccctaggtcactagagggcgaatttcagaacagggactggttggtcttcttttatttgttggtttgtttttcagagacagtctcgctctgtcacccaggctgaagtagagtggtgtgatctcagctcactgcaacctccgcctcctgggttcaagcgattttcctgcctcagtttctcaagtagctgggactacaggcgtgcgccaccatgcccagctaatttttgtatttttcagtagagatggggttttattgtatgttggccaggctggtcttgaactcctgacctcaggtgatccgccctcgtcgaccttgcaaagtgctgggattacaggtgtgagccaccacacccggccagttagtcttcttttatcttctttgagccacatcacagtgcttcttttcttacatgaggcgaactgggaattctggtggatgtggaaaattggctgtggtggggagatatgatgaggaatgtttgtatccatgtgaatttgttaagcatctgctgacttctggtccacagaccttgcttcttggaagatgctgcttcctgactttccccctggaactgacccaagtgtcttccccctgcttcccttctcactgtgtctttcagtgatggcctcgcatccacccagccaccccagcccagcacccacttctcatatcctgttcctgtagactccagcttgaatatgtatcctcatcctaatcctcatggctcctttctcccctgccgccttggaccactgtcccagcctccccattggtcatcctgtctccagattccatgctaccagccggtccccacatttgtccccagtagaacttccttacacagaatgcttctgcgcagaagccttccacctgcaacttcaaatccaacctcaaaggaacttgaggacaaacttgggaaagccaagtttgtctccaccttggggtcttcaaccttggcaacccccttgaatgctgtttcccacctcctgcccttcctttcatccttcaggacctcaggtcctaccctgatctttcttacctgagcttaagctcttccacctgccccaatcttctgtgccaggaaagatactttaacatacctggacctcattcttgacttctccgtgactcccatgccccacattcagccaatcaccaattattgcttcctgtcatcatcacctgatggtgatgtggaattcatcagcttcctcacgctgacccccacactccatcctctggttcttcactgcggcctccaaagcagccaggattgtcacaaaagtgttcatagaaccatgccactcccctgcttgaaaccttctcaggtgtcccactgttcttgaagtcccaaattcttaccttggcctgcaaggccctgtgcgatctggccctggccgcctctccacctcacacctcgtctcctatcttctcttctttgttcactctgctccagctctataggcctcctttctgatcctggaattgccacactgtttgtttccatggggccatcgcctcctctgttcccattgcctggagtgtcttccttcacattctttgcctcgagaatactgtgtctaattgctatgtaaatgtcacttccttgggacagttttctgcaacatgccatcctttgtttacatcaggtatcctccttctactttttttaagagtcagggtctctctctgtcacccaggctggagtgcagtggcatgatcgtagctcactgcagcctcgacctcaagcaatcttcccgcctcagcctctcgagtagctgggactacagacgcacaccaccacacccagctaagttaaaacaattttttttgtagagatggggtctcgatatgttgtccagacaggtctcaaactcctggtgtcaagcaactctcccacctcagcctctcaaagcgccaggattacaggtgtgagccaccatgcccagcccctcctctacctattcttgaaatcacttttcctaacttagaattacatatttatttgatggctttttattttttattttatttatttatttatttattttagagattgagtcttgctctgtcactcaggctggagagcagtggtgccatcatagctcattgcagccttgaactcctgggctcaagtgatcctcctgctttaccctccagaggagccaggactacaggggtatgccaccatgccctgctagttgataacttttaaaaattatttctcccccaaagactataagctctatgggttgcttttaaccactgtattctctgagcttagcaatggcttggcacataatagcatttattggatatttattaagtgataaattaccaaggtatttttatccactccagtcttcctctcagactgttagctccttgaggtcagattttagatctagctcacctctgggtcctcagctcccagcacagggcttggcactgagggacatgaggaaatgtttgaattgaaggaaatggggaagggttggcccaccttcagccaggagctgatgggatcaggagtccagtgcattgccgaatatcaagaaactgactcgaaggctgtgggcgttggactgtgagctgcagaggtattccagcattgctgactggacaaggagtggctggctgttgctgttgtctcctgaaggatggggagcatttcacgcctccaagaaggagctccatggctcagtacagagagatcaagctgtcagggggacagacctgggcttaaatcctgactccaccactcatgctgtgtgacttggggcaggagacttcacctttctgaggctcaatttgttagtaaaatgaggatgatagcagacctttacctcctcagactgtcatgaggacttagaaataatatattggttcaaatagcacagagtagtccaggcacagtggctcacgactgtaatctcagcactttgggaggctgaggcgggtggatggctttgagcctaggagttctgagaccagcctgggcaacatggcaaaacccatgtctctactaaaaatacaaaactagctggatgtggtggtgcacgcctgtggtcccagctatctgggaggctgaggtgggaggatggcatgagcctgggaggcagagtttgcagtgagccaagatcatgccactgcactccagcctgagtgacagagccagacagtctcaaaaaaaaaaaaaaaaaaggaaagcatagaccacaatgctgtgggggctgctgctgctaatgaagacaaagaggaagatatattttaagtccctgaatgctggatactcctaagcagaacttgactttgacttagggctgctggagaagcaaaggggcacttcgggtctagagggcaaagcaggtgtgtaaacaggaaataggcttgaggtcatgtctgtaatcccagcactttgggaggctgaggtgtgtggatcacatgatctcaggagttcgagaccagtttggccaatgtggtgaaaccctgtctctcctaaaaacacaaaaattagcctggcctggtggtgtgcacctgtaatcccggctactcgggaggctgaggaggcgtgagatgcgcttgaacccaggaggcggaggttgcagtgagccgggattgtgccattgcactccagcctgagcgacagagtgagactctgtctcaaaggaaaaaaaaaaaaaaagagcctggactttaaaaataaagctaaagcttaatttaattttttttaaaaggggaaataggcttgagcctagaagccaggaaagtgggcaagagtggcaagcagtgtctcgggtgggccagagctgaggctgggcatggtttgagggtctctgaggcccactgggggaccacatggccctgcagcaggagcagacacacatctctttgtgtatgtgtttgtctgccacccctatcatcctgttttcctgccacccctatcatcctgttttcctgcttgtttgggtccctaggttagctttccctaaccccccagaggctgcccctggcctgggcgctgctgaagccccgtgtgcttagatgcagcaaggggactgggcagagggaggtgggtatcattgagtcttgggcccaagttcatctcctggcccagccatggactcagagtatggcctgaggcttggtctccctgtctcctgccaagctaggggtctgaggagcctctctgagctcccacatgccacagccctacagatgagggcagtgcctatggggaaagaacccttgggttccctcacagagcaaggatgatgctgggggctgagtagagagatcaccaaagcagcagacattcagagagaggctggggaactgagccacagagagggtccccaggggtggccaagaggaagaggccatggctggggggccctgaggggtgaagaatctcgctctgctgtccccggtgggctggctgctcccccccaccactccccgccgggcccccgggggacctcgctctaataatgtatttgatcgactcgccggccgcgtacaagcgattattgtcttgtcgggagtcaaacgtatcgatccggcgagaaatatgagcggagcaatggggcccgcgtgtcagttaccagccccgctggccctggggagccccctacgtctcctttaattaccgctcagccctgagcccagcctggcctcccctgtaccgcctccctcccagctccctgcacctcaagtggcccccactgctccctagctcccatgccctacctgcctccctcagcatggctcgaggcctcttctgtggcaacgaggccaccatctccccctgccttgagcctccctgttccagctgccagtgtgttccaaactctgcccctctatcctctctcaggcaggcccatcctccttcaagatcccctcaccaggcccagctctggtctgaggcactgagaatggagccagcatgggaggcgagaggtgtggggttgtttcatctctcagggagcgtatacagccttccccggctccaggactgaactgcagacctggccgcactggaagtgggtggtccttctctgctggctctagggggctggaatggggtcacatccaaaagcgtgttcctgacgtggatgatgttgagtctgtccagggtggagcataagggtggctggtgaggttttgcccccccccataatgtcctatagccccatttccaagccccccaaaacaaatcctaactgaaaacaaagcttactgcgtaaatgtcgctttgagacaaggctccagtgtccactgctaccaggctgctgtcgggaagaccctcatgtatagaaatcctgtggccagttgctgtgtggtctgtggatctcctctgtgaaatggcctttacgatacgggatgttgtggagtgtagatgccgggaaacggtcacctctcgtgtgcatatatgagaactgccagtccttcctgttgtgcccacctgcttgcctgggtgtgtctgggtgcacagggcacgtgtgcagtcaggggagggcactcctgtagttgtgcctgtagtataccctttctgagtgtgcctgtgtgtgagtgggtgcgagtggccaggaagtatgcttgggcacatatgtgtagaagtgcccttgtgcccatgggtccatgtgagggagtagaggaggtatcagtatatgggagtgaccatcgtcagcagggagggctggtgttggggcctgtgcacatagatgtgttcatgcacgtgtgtgtgcacacgtgtgtgtgtgtgaagtgctggggttcatctgtagaaatacttgtgtgtgtgagggtgagtccaggcgtctgtgcatgcacctgtggtttagggggccccccagccacggggcgcaggatgtcctgcggggcccaggcgggcatgtggggtgtctggagacgccaggcagccccacagcctcagacctcgggcaccaagaggaagagggcagcggactcgggcgcgcctttgtctgagctgcggtgcgccgggagtcctgcgcctttgtgtgaccctcgcaggtgtgcgagcggaggtgttgggagggtgttggggaggggagcggagggaggggctcccttctccgcagccggccccgccctccggcccattggctgggcgctgccgccctctggcgggcacggagggaagcgctgaaatgggagcgccgcagcgcgaagagccagccggcagcccggggacctggtgctcccctccactggagccgcctcgggcgcccgcatttggccggcgacttattgtagccccaggccaagtccccgacccaccgtccccactaccactgcccacgggcaccacttcctcccaatggtggcacccaacagctcacctgcagataggcgcagggcttgcttgatcttccctgccgcggcgtgcttttaagcttcaacgcttcttggctctgggcctttgggaaagctactgctcacctctctgatcctcagtcttttcatctgtaaaatggggcaaataagagtgaccaccacattggagatggcacctgtcaagagtgaggcacagggtcaggcatcggcaaagccctctctccaataagctgctggctagtgttttattgttgttactgctgtggacccaccttctctcccagacccccattccctgttccagacttgtttgcctccatgggggcgacagaagtcggggggcaactgttgcaggcacctcttggatcgcagccgtaggagtcggctcttccagcctgcttatcctctgccccactagcccccaccccccagcacacacacatgatttggggtgggccgggctgccggggcgggtctgtgggccagggtattttcccttctgaagggggcggaccggccctgtggtttcctccctgagtgacttccggcagggagggctcggcccccagagagggtggggagatgacacagttgttcccccagccctggcggggcgggcagcatggttcactccagcatgggggctccaggtaagggggctggtgcctgtgccactgctcagaggacaggcagcacatttaggtttgctctgcgggccctgcctgcccctcctcctcagctgtctccattgtccttctcctctgtactctagcaactccctctctcccatgccgggtccccgctaacccccacagctcctctttgccctctctttccacatcaggcaccggaacttccaacatcttctcttctctgttgccctgttccgaagggtctggggacgggagggagggagctgggtgttggtagcgggccctcatgtggagaaccagtggggtgggtgacatgggcaatccttggataagggctgcaaagggattggaatgccaagttgctggacttgggggatgtcattcccttttgagtgtgtgtgtgcacatctggtacaggtgtgcgtgtgcatgtgtgtgtgcagtagttctgagtgctctgagtgggactgctgtgtgcttgtgagtgtagggggctgttgtgtgtggcattgtggggtgatgattgcctggctcccttcttcacttcattcacctcagatgtcacctcctcagggcagccttccctgacctccccatctaaactggcactgatcctgtcactctcagtcccctcaccctgctttatcttttcttcacggcacgtatcactgctgggaatttcattatgtgtttgtttgtgtgcttattaaatgccttctccaccaaatgtcagttggctgagtgaacattgtgcaccaggcactgtacaaggtgatttatagctgttggctcatttagtagaatgtgtatatgtctgtatggtgatggctatcactcagcagtgttgatgggagtcttaaatgaggtaatacatgtagcatgcttagcacagtgcctggaacatggcaagcactcagcccttcatgcctgtttcatttgtggctgtgtaggcatgaccatgggcatgagtcttggtttggtggtgtgtgctgtcctatatgcgccattgtgtgcgggcacccgtgtgtcctccaccaacatgtatctattgagtagttctgtgttgggtgttggaagtacagtggaaagggtagctcaggtctgtcctcctggagctcccagtttattggagaagacagacctgtcaccaatgacagtacagacaggtcagggctgggatgggggaggtccaggcagagggatcagggctgggatgggggaggcccaggcagaggggtcagggctgggatgggggaggcccaggcagaagggtcagggctggggtggtgggcacaggcagaggtgtcggggtgggatggggggacaaaggtagaggggttggggctgggatgagggaggccccaagcagaggggtcagggctggggttggggaggctcaggcagaggggtcagggctgggatggggggacataggtagaggggttggggctgggatgggggaggcccaggcagaggggtcagggctgggatagggggacataggtagaggggttgggccaggacggggaggtattaggggatcgtaggagccctgaaaacatgtgatttagttggtagagtgtcaaggagggcttcctggaggaagggggtgtctgagcagggatatgaagaatgagtgggtatgagcaagcaaaggcggtgaggagaggggtgggatgaaaggaagactatttgcagggtgacatgtttatttgttgaggtgactgtgtatgcaactgtgtatatgtgtgtgtgtccatacagtgtagacacagagatccagggtgtctgctcccactgactcgttcctctctggggttaaatggggacctcagaggtgctgggcagtaggctaaaccctttacttgggatttctcacagaacagcccagtgtgggaagactggggtgaattttccctgcctggacatgaattaatacactgtgtggctgtgggcagatcactcaccctgcctggtctcagactccacacctgtgaactgggttcagaggtcagccctggccatcttccaggataaggtgactctgggtgtatgtgtgtgcacttgtgtttgtgtgtgtgactctgtgtgagcatgtgcatgtctgggtgtgtatctctggctggactgatgtgacttggtgtgagaacatgtgtaagtacatgtgtgcgtacacatgtctgagtctgtgagtgactgggtgtagtatgtagggggagggtgtatgtctgtgttcgactccgggtgtgtgagtttgtatactttttacgtgtgtctggctggctgtgtgtcactcagtgtgagagtgtgtgtgagtgcatgtgtgtacgcacgtttgggtgtgtgttttgcatatatgcccgtggcatcatgtctgggcatgtgtcgtatctgcaaacctgttcacattcctgtctggaatctgtgcacatctgtttcttgtattgtgttggccggggccttgcctggctgtggccatggggtgtgtactgttggcagctcttgcctgctgtcagcgcagctgtggggccacctctcttgttgtgtctgctgcctgtatctccatccctccctcctgacaactcagaaatgttcactcccttgaggccacccagggacagctgtggggtggggaggggtgaggtgctgcttctggggaggacgggggctcggccagctgggcccacagaggttcccggcagcaccaacctgcccacaggggctcccaggccatacccctaattgaagcaggctgcggaggcaggggacccaggggacaggacaagtggggccaggaggggtgaggggcagtccttgggccctctatatttagccccgttttcggtaagtgctaacgagaagctggcctaagtctgctaaaactggcggggggaaatgcagaggagaagtgaaagtccggggagggaggagtgggagggtggagaggaccaagagtcccaggcctggggcagtcgggcaagtgagtgtgagctcagggctgggcagccctggttgaggggtgtctgacctgaggaaggtgggattcaaggggcaacatggctccaaggggcctggtagggctatgcattgctttttctctttcagttcccctaaaatattacacattacctatgatgaggggtgggaatagccatacataaccaaccaatcttttgtgtgtgaatgaggctttgagaggggcttctgaaggtgccaggggatggagcacattagaatcaccaggagggggctgggtgcggtggctcatgcctgtaatcccagcactttggaatgctgaggtgggcggatcacttgaggtcaggagttcgagaccagcctgcccaacatggtgaaaccccgtctctaataaaaatacaaaaattagccgggcatggtgatgcatgcctgtaattgcagctactcgggaggctgaggcaggagaatcgcttgaacccaggaggcaaaggttgcagtgagctgagatcataccattgcactccagcctgggcgacagagtgagactctgtctaaaaaaaaaaaaagagaatcacctggaggggcttttaaatatctggatgcccaagtcacaccctgtaccactgaaatcagagtctagggtgggaacaggcatcaatatttttctagagttgagtgataggcgatgggcatctctgcctgggctcaggctgaggctgaggccgagccatttgatggaccctccaagtctatgattgctagtgccctggagtccctgttaaggcgtcatttggcttttagtccacggtggaaatggagctccctgttcattcctggtggaaatgatctgacccttctctcagattgagctctgacaggggaggtggaaagagaaaagacaaagggcagcagttggccattttgttgtgacccagccaagtgtggggcagggagtatgcagggatatgtaggagtggttgggataatttagggagaataagggtaacagaatggtgaaaaatttccctcaaaccactcttgtctttccagccacagtctctgcagaggaaatcataccttaaagatttaagttagggtttcttggggatgttgggtgacagtagagataggggtttgttttagacaggattgggccctggtcagttaggggattctttaatgcattcattcattccaaagacgtactcctaggcctgtgcagcaatgactccagcctgggctcctgaggagcccacagttggggtggaggtctctgcccaggatgatcaggatgtggtggagcacagtacagggtcagtgaagcccagaagagagagacactgaccatctggggaatcagagagtacttcacagaggaggtgacatttgagctggaccttaaagaggagcaagagtttgccagtagagaaggaaagggtcacccaagtgggagacgagcagaggcaaaggcctgggggagggagatcaggaccttggggccactgatccacatgtcttctgctggggagtgtttaggaacctgagatcagatctgcccttgaaaaattcctagtctgataggggagacatagtggggcccggctagctacagtcagcctctaagacagtgacaagggaaggtgctagggtatggggagctggagagagacctggctgggagctgggggcatcaaggtggtggtttcatagaaaacagagcttatggccgggcgtggtggctcacgcctgtaatcccagcattttgggaggctgaggtgggcagatcatgaggtcaggagattgagaccatcctggctaacacagtgaaaccccttctctactaaatatacaaaaattagccagtcgtagtggcgcgcacatgtaatcccagctatttgggagcctgaggcagggaattgcttcaacccaggagacctctggagcttgcagtgagccgagatcccaccactgcactccagcctggacaacacagcaagactccatctcaaaaaaaaagaaaagaaaacagagcttatgctgggttctgaaggatgagtccgggggtcgccaggtggacagattggggaacagtgttccagacagagggaacagcccatgccaaggcctcaggaaatgttttaaatggcaaagtgcaggcatggtggctcatggctgtaatcccagaactttgggaggccaaggcatgaggatcatttgagcccacgagtctgagaccagcctggacaacataaggagacccgtctctacaaaaaaaaaaaattttttttttaattagctggatgtggtggtgcacagctgtagtccctggatgtggtggtgcacacctgtagtcccagctactcaggaggctgggatgggaggatagcttgaccccaggaggtcgaggctgcagtgagccgtgattgtgccactgcattccagcctggccgacagagcaagactcttgtctcaaaatataaattaaataaaataaatagcagggagacagtaagacaagggtgagaagtagtaggaaacagagactgctaaagagagggacattcagcagttacaacccgttctgggcttgtgatgctggggacccagtgatgagtcagaccaggcctgtcgcattggtcttgtggggaaggaacctggacacagacagccacaactgggggctcagggatgggacagcaggagggcaggggctgtgagaggcttagtttgctagggcttccacatcaaagtaccacagactaggtggctgaaataagagaaattcattttcacaattacggaggctgtaagttaaagacgaggatgtcagcagggttggtctcttccaaggcctctctccttggcttgtggtccactggtcttctcctgggtcttcatatggtcttccctctgttcccatctgtgacctaattccctctttttcttctttttttttttttttgagatggagtcttgctctgtcactcaggctgtagtgcagtggcacgatctcggctgcctgcaacctctgcctcctgggttcaggtgattctcctacctcagcctcctgagtagctgggattacaggcacacactaccatgcccggctaatttttgtatttttagtaggggtaggatttcacattgttggttaggctggcctcaaactcctgaactggtgatctgcccacctcggcctcccaaagtgctgggattacaggcatgagccaccgcgcccgccccctcttcttataaggatgccagtcagattgtagtaaggtccaccctaatgaccttattttaccttaattacgtctttaaagaccctatctccaaatacaattacattttgaggtatcaggaattaggacttccgtgtatgaattttggtagatgcaacttagcccatagcagaggttaaggatgagtgtggactttctgggctggcagtggggtccgaggctgccctgttctgtggacgggagagggatgcccagctaggtgggagtgtagaacctgcacagcctgctgtcaagcagacccccaagcagggggagatgctcgacatgggtgaagagcactgtgcatgagctgcaagagaagagcagtacagggtggtgggccagcccctggaggccaggttgtttatttctccaggagatagggaggagccaggaaaggattgccctgaggcaatgtggagctccgctggagggacggaggccagaggaggctggggctgcagttttagggatgctaggaggggtgggatttaggaccgggttagagttagtggctgcctgaagtagggctaaggtctgggtgaactagagctaggatcaggcaggattcccgcctttactgctccaaagtcaggacacacttgctgcccagctcccttcttgtccttcttatatcttgtatcagtagccatttaatgccctgtccccagggccaggaaacaggacctgaactctggtagcgtcctgggcacccactccccacccccaccctcaacagtctacatctttttttttttttttgagacagagtcttgctctattatccaagctggagtgcagtggtacaatcacggctcactgtagcctcaatctcctgggctcgagcgaccttcccatctcagcctactgagtagctgggactgtaggtgcccaccaccatcatgtccggttaacttttttattttttggagagacggggatttcactatgttgcccaggctggtctcaaactcctagcctcaagtgatctacctgccttggtgcagtgtgcatcttaatgggactgtgtgctggcgttttgctttttagcttttaaatgttttcttgcttgttaaaacataacgtatatagagtaaagtgctcaaattttaagtgtatagcttgatgaatttttgcttatgtaaggaccctgtaaccaccaaacaagatcctttcttacctggtgcaggcttcctcatgccctttcccagtcagtacccccaaggtgctcactcatctgactgtgatcatctgctatcagcttgcccgtttttgaatttcctgtaattggaatcataaattatgtctgcctttgtgtttggcatctttcattcagcctcatgtctccaagcttcggccatgtgtatgaagcaggagtttgttctttttcattactgtggcatatttcattgtatggacataccacattttatttatccattcacctgttgacggccccttaggctgtttccagtttggggccattatgaaagactgcagaagaattctgcccatgtcctttgatgggcaggacacgtgtttcttttgggcagatgcccaggagtggacgtgctgcatcttagggagagggcatcttttcagcttttctgagtggtgcttgtatcaatttacactcccaccagcaatgcatgacctgtttttttaattaggaatttaaaactcaagcagcatttcacattgaataatactcaattgcaagatttctagacttttttttttttttacagttactgagttcttcctatttcttatcccttactttagctccattctttttttttttctttttttttttttttgagacagggtctcactctgtcacccaggctggagcgcagtggtgcagtcacagctcactgtagccttgacctcctggattcaagcgattctcctgcctcagcctccccaatagctgggactacaggtgcgtgccatcatgcccagctaatttttgtgtctttagtagagatggggtttctccatgttgcctaggctggtcttgaactcctgggttcaagagatctggctgcctcagtctcccaaagtgctgggattgcaggcgtgaaccactgtgcctggcttagctgtcttctttaagtatcttggtgcagagaacactagagttggacagctcctttagtaggagtggggtcatggtttaggcagggattttggagtgagttgtgggaagagtttggatcagggacaggatctcaggacagttgggagtcaaggtcagatgaaggacttgagccatctgggcacaacttgggattcaaggtgagtaagtggactaaggatgggtcaggctgaagcccagatttgtcctggggtctaggaccaggaagggttggattcagtttcaggatgagcttgggcgagggaactgttggagatgagatggctggaagtcaggactaggggacattagactagagtggatccgattagaagtaggagcccagcagtcatgaagaccaggggtccaatcagggcacatctgctgtcttgctgtgcttttggggaggtgacatcccttcgtggagcctcagtttcctcctctgtaaaacggggtaatattagcactaaccgctaatgtgagctgtgagtcatatctagctctatgcttggcactggtgagcactcgcctttctgtgaaaagtatcagagcgctttgaggacaggcatttgtctccgtgggtttatgtgcttgctgcctgccaccctcccttggccacctcctttcatttcctgggcctagggagctatagaatggggttgtattacaggggtggacttgagactgcagctggggctcaagcgtgaagtcccagatcaggtttagattggaggacaagctcaggggtagagccagatggagctgaggttacagaggatgaggttgggtctgctaggccggtgtgctaaacataggaagaaagtccaggtgggagtaagatgtggatggggaaagtggtggggtgggaagagggccagagggcggctgaatcacacatgctgagatctgacaactgcctcctttggggacgctgcagccccatcacatctctgaggccccactcagagtggaaaacatgtctcacccgaaacctggtagggcaggacgggagcctgggcggcccgccccaggaggaggcccaaggctgctctccctcctttgggacgtcaccagcctcctcctgggcagctgataccttctcacgaccaccttccatctcctgccctgccctttgctgcactgtgggtaacacccctgtgttactttctggagaggtgaaaggataaggcaagatcccccaaggcctaagtgctgtgtctcatcttgccagaggagggcagaggcccagaacggaggacatgtctcttgggaagagacacttccaaggtggctgggggtaaggggggaatttgggggaaaggcttggggagtgtggtggaatgggggcccgagagccctcctggattcccctccttcaccccacttccattcctcctctgtccccagaaataagaatgtctaagcccctggaggccgagaagcaaggtctggactccccatcagagcacacaggtgggtgggcagggagcaggggggcaggggtcaccgtgggcaggggaagtgggacagatgggaagagagctgggaggggacaggtgtggtgggggtggctgatgacaacacatcctttccctctctttgcagacaccgaaagaaatggaccagacactaatcatcaggttaggagggagtggataagcgggagggggtgggaaggaatggggagaggggttcagagggggctctgtgccgcctatggtaggagggcagggagcgggggtggtcagaagctgcttcactgcactattcccatccccttgctcctactttctctttgcagaacccccaaaataagacctccccattctccgtgtccccaactggccccagtacaaaggtaagcacctgtcagaacagccagggaagtgggcagcgcttggaagagggtcctcaggaggcctgcctcagtccaagggctgagagagcactgagccttggtaccttggtaacgaggttcctcccgccccttctcactcttgggctcccaccccaggcctgtgactcacgcaggctccttccccttccctagggggtgggggtggctagggaaatcccccccagagccccagggcgatgaacaacaggaagccaaaggcccgcccccatcccaacttccctgacccaacagaggcctgcaccaccgcctgtcccccaatatacacatttagcggccagctgaggtgggggtgggggggctggtaccagttgaggatagctgtaggaatgcaggagagaatgacagggaggccggaagcagccaggcagtgcaaattccacatccagatggggccctgtgcctggcattctgggcttcttggggttgcctgggctccagtctccaccctccagcctggtccaggggtagcaggcaggtccagaggcttgaaggtagcactggaggtgggggcagagaaggtgtgagcaggactccagaccctgaccagtggtggctgagggatggggtgggaggctgggaactgctccccaccctgctacagctttgctctgtgaccatgggaaagtcacttcccctctctgggcctctcagtttcctcttcagtatcattggtcaggggggagggggcagtcggatgggatggcctctgtggttgcctccatgtctggtgtacccccatgctaccatgagaggagaggataaaagtgctttgtgagcagatgtcctgcttctgtgctgagcgctttgaacggggtctaggggagacaggctctcgatcttgacctccttgaccctctgatggcaggtttggctattgccttagccctcagagcacagcgtgtatccattgcccccaccctgtcctcagttgaatcagatctttgcagtctgttctcaaactggcagcaggcttccttcttttggggatgccagtgggaccaagggaatgaaggtttctccctccccttcctggcctcgggctctgtccacaactcgccctgtacgccctgtttctctgggctttgcctctcaacttctctccatctcttctgtgtcagtctttccctaactgaagtgattcatgtgcttctgtcacagtctcaggcataagaccactgtgcgcaactatttacataataattttgttaattggctcaattttttaaaaaagcaccttattatggaaaatgtgaagtggatacagaaatagagagaaggttataatgaaaataaagcccctagatacccatcaatcagcttcaacaattaccaactcatgaactggcttgcttttcgacagctttttaaataaatgttttttaaatggaaatttcacaaatggaaaaccagaatcacttgccatggaaataaatatgatgattattaaaatttacccagagtctcttgtgtgccgaagggtctaaacctcagaggcctgttaaaaaagaggcttattaaaaagaggcttattaaaaaaggagattagggctgggcgcggtggctcatgcctgtattcccaacagtttgggagacaaagcgggcagatcacctgaggtcaggagcttgagaccagcctggccaacacggtgaaacttcgactctactaaaaatacaaaaattagccgggcatggtggtgagtgcctgtaatcccagctacttgggaggctgaggcattgtggagaattgcttgtgcccaggaggtagaggttgcagtgagccgagattgcaccactgcactccagcctgggcaacagagaaagactccagctcaaaaaaaaaaaaaaaaggagattaggccagatgcagtggctcaagcctgtagttctaacactttgggaggccaaggtgggtagatcgcttgagcccgggagttcaagaccagcctgggcaacatagtgagaccctgtctctacagaaaatacaaaaattagctgggtgtgcatgcctgtagtctcagctacttgagacagaggcaggaggatcgcttgagtctgggaagttgaggctgcagtgagtcctgatggtgccactgcactccagcttgggtgacagagcaagaccctgtctcaaaaaaaaaattaaaataaaagtggagattagctagtattggagagatggtaaagacattcaagcaccaatcagagactttaagataaccagaaacaatgaaaaaagcactgaaaagggaatagtgtgctcaccatggcattcaacattatttttttaaaactttttttttttgagacggagtctcgcactgtcacccgggctggagtgcaatggcatgatctcggctcattgcaacctccacctcctgggttcaagcgatttttgaggcggagtctcgctctgtcgcccaggctggagtgcgatggcaccatcttggctcactgcacctccacctcccggcttcaggtgattctcttgccttagcctcccaattagctgggattacaggtgtgtgccaccatgcctggctaatttttgtatttttagtagagatggggtttcaccatgttggccaggctggtctcgaactccagacctcaagtgatcctcccaccttggctcccaaagtgctgggattaaggggcgagccaccgcgctcagcctatttttaaaaaaactttgtattaaaatatgatacacattaaaaacacacatagatcttcaatgtatgactctgtgaactttcagaaacttagcacacccatgtcactagcaccagatcaagaagcagagcacgaccagccttccagaggcccttaatgcccctgccagggatagctgctaccctgacttctcatactcagtgtcatttcatgctgcatctctgcagcacttttttttttttaacctctctctctctcttttttttttaagagacggtgtcttgctctgttgcccaggctagtctcaaactcctggcctcaagcaatcctcctgcctcagcctcccaaaatgctgcgattacaggcatgaaccaccacacttggcctctgtagctcttaaactttctaatacttatattccataatttgggacatgccattcactgtctattatttggcctttccttggcctctgtttgtctctgtccacattccaaatatcacccccctgccaacacactgtgtcattttgcccaagttgctttctgtctctggacttccttttacaaaatggtgttgggctatcaggctgaaggataaactcactgtccactttaggcctgagggtgtgtgatccatcaggccatgccttctcccaccactgtgtgtgcttcagccaacaggcctttcagccaacaactgctgttgtctggctttttacctaggaatggaggaggccagggtggctctatgctggtctgttctgtgtgtatggtgcaaggtgtgtccatatcatattcagaaagacatggagaggcttggcagacctcaggagcggaggctgaagcctggtatttcctgggccacatctggcttgtccacagtgcaggacaaatgctgtgctttgcttattatgccagtatttttgttctagattttgaaaagagtggccagcaggagctgagtaggagccagataagatttccacttaggcaggcgctctctccagcccacctccatccacccctactcctgtcattcatttgtgcccatttctgtaagcatctgactttgtagcccaggttccaaggtggtggtttttcttagtacctgaaaaccttttcttccaacaaagtcttacttcattggacaaataagggatgtacctggctaggtgcagtggcttatgcctctaattccagcattttgggaggccaaggcaggaggatcgcttgagcctaggagttcaagaccagcctgggcaacatagtgataccctgtctctacagaaaaatttaaaaattagccaggtgtgtggtgggcacctgtagtctcagctgcttggaaagctgaggtgggaggattgcttgagcctgggaggtagaagctgcagtaagctgtgatcatgccactgcacttcagcttgggcaacagagtgagaccttgtctcaaaaacaaaaagaaaaaaaaagcaagagagatgtacctctgtgtgatacagatgaagggtgtgggacccagaagccacttatttgacctcccaggtgcccagtgggagtattttcctttttttttttcagaaatggggtttcaccatgttggccaggctggtttcaaactcctgaccccaagtgatccgcctgcctcgacctcccaaagtgctagggttacaggtatgagccaccgtgcccagccactcttttccattttacagacaggaaaactgactctcaggaggggaaaagtgctctgcaaaggcgacttctgtagggagtttgggtgcaggtgttgtgttagccctatctgattgatgaggaaactgaggccagaggagtggtttgaagctcccagcggtcagtgcaggaccacagactgcaccctcatgtccacaccccagtctgctcctcctgtgccagcctgattgccattgccacacacgtgccctctctttggttcacaggtgggcattctctctggcctccacttaacattctggggtcccggaccctgcctctctcccccccagatcaaggctgaagaccccagtggcgattcagccccagcagcacccctgccccctcagccggcccagcctcatctgccccaggcccaactcatgttgacgggcagccagctagctggggtaagtacttggggaaggatggggacgaggggacaaaccagccacccctcatctgttacagggctagtggatgaactgttccaccaaggccatggccactctctcacacctgcctcttgccctcttctgtcctctaggaggtcttgtccccttacttgcttggcttaggcactaacccctctctgccttctctgctcctcttcaaccccttgctccaattcctgctgtccccgacaccccgcagctcacggcactgatgccagctcagcagcagctcctcctgcagcaagcccaggcccagctcctggccgccgccgtgcagcagtccagtgccgccgctgccgctaacgccgctgccgccgccgccgccgcctccgcctcctcctctacttcctcctcctcctcctcctctgcctcctcctcgacctcacagcccccagcctcctctggggggggtgacctgccaccaccacagcctgccagccagccccctgggaccccacagctcaccttgtcccaacccatccagctcacagcacaggtaagggcagccactggggaccaggctccctgcagtgaaggacatgcagaaacagtgagtgtgtgggaaggggctgactggtccacatggactgttctgaccaccagccacatgccaggcagttcctagcaaccctaggaagctttggaagatgttgctgtcccatcttacagaggggtaaagtgaggctcacagggaggaatatcccacatcataatcctccctctggtggtgtgttgggggcagtgcttcctgtgcatctcgctgggagttcacagcctcctgggaggttgagattgttgtcctcaacatacaggtaaggaaaccaggagtcactctcgtgaatggtaccatgtgggtacaaaacaaaaggttaagaataagaatgagtgccctaccctcatcgtgtcccctggcttatccaacaagatgctctttcaaaaaaggggcccgtgatctatgaattaggaggttctccatcacctccctgactctggagcttttgctggtccatagttaatcatgaattagtggctgtctcagtttcctagggctgccgtaacataataccataaactgggtggcttaaggcaacagaaacatattgtctccaaccacaagtccaaactcaaggtatcggcagggccgtgctctctctgaagcctcccagggagaatctgtcattgcctcttctggcttccgatggtgctgtcaatccttggtgttccatagcttagtagatggctcactccaatctctgcctcctctgtcgtcacatggccatcttctctctgtgcacctgtctctgtattcaaatttttctttcttgtagggacactagtcattagtttagggcccaccccattgacctcattttaacttgattacatctgcaaccctatttccaaataaggtcacatttacaggtaccaggagtgagggcttccacatatctttttggggacacaatttaacccctaacagtggccaacagagttcccataaggacagccgggggagcagagtgggagctgagtaggcttcctcttccgaagggcagctgtctccagcccactcctgtccaccccttcccatgtcacccattcatgttgtctgtctggttttcacccattcatgttgtctgtctggttttcataagccttagagctgtggccaagtttcagggcagtgaaggtcgtgggaagccctacagcaaagccacctgtttaacttcccttagcctggcgtttccctcagtgactgctccacaaaaggcttttctctcactccgtccaaccacttccacagaaccctagatatagatgctgtccatgcagggagctgtccagccctggtaaggctgttcccttgttacagttcaccccaataatggcccgttccattattggccaatgctcccatttgggactttccttaacactgagctgataacctgcctccttagaacttccttccactgggcctggttctgtggagacactctgtaaactgggcgcatggctccgtgatggctcttgtagatgtagccttttttttttgagatgaggtcttgctttgctgcccaggctggagtgcagtggcggattatggctcactgcagcctcgacctctttgggctcaagtaatcctcccacctcagcctcctgagtagttgggactacaagtgcatgccaccacacccagctaatttttttatatatacatattttttgtagagacaggtttttgccatgttgcccaggctggtcttgaactcctgagctcaagcgatctgcccaccttggcttctcaaagtgcgggattataggcatgagccacggtgctcagcccagatgtagcctttcaatacctggctcttgaagtaacagtaactagtctgttgggtgccacctttcttccaggcaccatgccagtgatggcctctttgctcccatgaatcctccccacagctgaggctccaaggggtaaagtgacctgccccagattattctgtaagcatgagtgttagagccggcctggaagtccagggctctaaccacatgatccgcggctgctgcttttagctgtccttcacggaacatggtttctagcccctcccaccccggccaccagagactccagcagcaggtgttccatttgccttgtagcatagacagccctttactgagcaacgccaagggcttggggctcttcactggggctgagctcttttgcatctcagtggccctgctcttgttctctcttttcccgggaagtctgctcccttcctttacctggacagttcctcttcatctgagccccagcccaggagtccacacctctaggaagtcatgatgacttccctccccccagccgtgcctgaatctgctcgaggaaatatcagttgaaggaacaaagactagaggatagaaggcagaacagggcagcctagcgcagacccagccaggccaccatctctgtgagcagcagacattcttgcctatgcactcctagagccacctcccccagctccccagggacccagcagcagcaagctgagcctccaccacctgccgtatagcccaggccctgattgtcaagggctccttaaacccctcctcctttcctctcactcctccttccccagcttccctcagctctgatctttccctttctgtcttcaacaagtgcaaagctgggccaagtttgttttctgggaattctctctcacaaactgagttgccctttgacgtcatttctacaacagcacctcctatgggcactgtgctgggcccaggctgcagagggaccagctcttcctgacttacctacccactgctccagccttccccggctcctaggctcggatgtctctcccgggccgcatctcatgacctccaccccccagtccacttctcatgcctgctaagctctgatcctgcagtcattccacaaacatttcctggcctcctgtgtgtcaggccatggcaggaagctgaagacttaggagtgagtcacagccatccttgcccctgaggggctccccgtcctgcagtggagcaagcacatcagtgagccactaagaaatgtttcacttgaaagatactaagaagcccaggaaagagagtaaaaaacactcataaatgctatccctttgaaattatataaagtaccaaggaaaagccccccttccagccctctgatgtcagcttccaaagtaaatgctggttaaacagtttggcaggatccttccctgcaatctcctagcttgtacagacgaaggggcaattataatacagttctataatttgtctgtccattgctcagtgtgctgccttctgccgagggggctgtgtggatatttaccgaatcaatgagggatgttttgcggcagattttcaatcaaggataggagagatatctctccagggaagtatttcagaatgtctggggtaggggcaggcattgattgaaaacttacgttaacagttaaaacatcattttatattggagagtaggggggaaaatttcctattttcctaataggaccatggcaaataaagcttgacaaaatcttttaggctgctacgacctagcgagtgaaagtttcccaaagaaaccaactgagtgtgatgggaatgtgggaagagaaatgtgatgtgtgtctgagggaatcaggacccacatctgtccaggctttcaggaggaggtgggatctgaactcaggggaatgggaaggagtttgctgggaaggggcttccaggctgtgggaatggcaagtgcaaagtgagaaaacagggcaggctgtagccgcacaaatagggatggatgagctgggagggaggagccaaagcccaagtccaggtggctgaagaagactcaggaatatttggctcagatcactgaaaaggcctggtctggaatatcaggcccagctccaggggtctgtctccctgtttcattgtagggcaggtaaaatgggtgtcagcatttccagacttgtagctatcctgcccagggagataaaatacgtcccctgggccgggcagggtggctcaggcctgtaattccagcactctgggaggccgaggtgggcggatcgcttgaggtcaggagttcaagaccagtctggccaacatggtaaaaccccgtctctactaaaagtacaaaaattagccggccgtggtggcatgcgcctgtaatcctagctactcgggtggctgaggcaagagaattgcttgaacccaggaggtggaggctgcagtgagccaagatcgtgccactgcactccagcctgggcaacagagtgagactctgtctcaataaaataaacaaacaaaaacacgtcccctggctagatttgagcccttgccctcgaccccagagaaggcaaggtcagccctacctggacctcgtgacttgaggatgggaaagtgtaacccctgaaagagatgggttctgttgcttgaataagttgaagaaggggcagtgggtaccaggccaatcaaaactgcccacctggaggtgtgtggtcagttcatccacagggccttggagtccaggagcctggcccaggcatgccagttgctcccactggttcctgggttgggatctgctgttgcctgtctgtcctggaattttagcataaggtagcatgtgatgtaatatgcagtccatatgtaggtatttttttctccctgttgaatcattctccatttgtggtattctgccctgatcgccacaacttcctgggttccatgtcacagggccaaccactgggggtccagagaagaacccacactggagaacggccactcctctgcccctactcccatctttagagcttgccctagtggagtgactgtactaatcgactgcaggggataggagaatggactgcaggggataagagtagaaaagagagcccagtaggaagtccttgaaggcatacagatgggacatgagggtggcttgagccaggagggtgaggatggggatcctggttgctattttgtattgattggataggtcaaggatgactcctaggattttggcttcagcagctgggtggtaatgacgtggtttcctgagttggggaagatgggaggaatgggatgttttggaaggctggggtagagagccagcagtttcattttggacatgttagggtttgatgagtctattaatcatccacatgggaacatcaactaagcagatgcatatttgaggctgaagctcagcagagtatctgggcaggagctggaagttgttagttgtcaggaagagaatgaatttggccaggcacagtggcttatgcctataatcccaacactttaggaggccaaagcaggaggacggcttgaggcgagttcgagactagcctgggcaacatagagagaccctgtatcttaaaaaaaaaaaattaaccaggtgtggtgatgcatgcccatagcccccaagctacttgagaggctgaggcaggaggatcgcttgagcatgggaggtcaagatggcagtgagctatgattgcaccatgacactccagcccagaagatagagtaagaccctgtctccaaagaaagagagaaagaaagaaaaggaaagaaggatagatggacagatggaaggaaggaaggactcagccagattgggttcccaccctcaagagctcacattcaagtgtggtgacatgaggtgggcaatggtagcaaatgctcattttgagggatatgttgtaatttccaaaatgctttctagataatattactcaggcctcagaacaacccagtgaaaaagtagacattattatccccattttacagataagaaaactgaggccctgggagagaaatgactcagtcataatgactgccatttatgaaggaccaattaagtgaagaggaatcaggctaaacattctacacatattgtctcatttaattcctttaacagctccatgaagtaagacttattgtggtgtcacctgaggaaactgaggcttaaagagggtaaggaacggcctgaggtgtgtgaggggcagtcaggattctgggctccaaggcccaggtctctccataacaacttgcatcgtgatcctgtacagttaaggaggctggggcccagagggaaagtggcttcccccaggcacacagcaagaagcaggtgagagggctaaggctcaaacccccgagtttccaagctggaagggacccttgcaccccactagtctaaccttcccctaggttaggcgtttccttgttggtgttgttgccaggtggggattttcacccaggtggcttccatggcaggcacccactcccttcccaggcagtgcgtcccaccaccagacagactgagattactcagagtgtcagaaagcctgacctcattttaattttaagttttattttatttatgtagttattcatttttttagagacgaggtcttgctctatcaccatcataactcactgcagtgaggtgcagtggcgccatcataactcactgcaacctcaacctcctggctgaagcaatcctcccacctcagcctcccaagtagctgagactacaggcatgtaccatcatatctggataagtaaaaaaaaaaaaaaaaattgtggagatggggtttcactatgttgcccaactggtcttgaacttctggcctcaagtgatcctcccacctcagcctcccaaagtgcagggattataagcgtgagtcactgcatccagctgagttttattttatttttaagtagcaaataatcattgtatatatttatggagtaaaatatgatgttttgatacaggtatacattgtggaatgatcaaatcaggctaattagcatacttatcacctcaaatatttatcatttcttcgtggtgaaaacatttaaagtactcttcttgccagacacagtggcgcagtgtaatcccagctacttgggagtctgaagcgggaggatggcctgagcccaggagttcaaggctgcagtgagctataatcacgcactgcactccagcttgggtaacagagcaagaccctgtctcttaaaaaacaaaaactaaaactaaaactctgtctttgatattttgaaatatgcagtacattattagcagtagtcaccgtgcaatagaacaccagaatgtattcctgttatctcactgaaactgtgtccgttgtccgccttccctttccccatccatcctcccttcctcattttgaacacaatctatcacgatatagtttacatagttcccagaccccactccttcctgttctcccctactctggacttaacttgtcttagagagggaagatccagagctggtcacaatttgccatatcagggatggcaaaggaatgtcaactcatgcgccaacaccattccagtcatggtggctgccagagattgtgtggaggcctctaatgggggcgcgagaggccatgggggatgggccgtctggcctgtgcactggagtgaggtgcagcacctgggccgttgcagccggccggctctggggctcctcctcagtgaactcctcaagttcactgtcatggctttctcttctcccccaggtggaactgagccctggtaggaaagtgggcaattcacccatgtatcctgcaatccacatatcaacctttctgcccccagtcatagccaaagtcccagctatggcaaagtactgccagtctgtcctgaggtttcacctcattcattcattgaaaatgtattgatcacctatgaggctcctgcactgggagggtgatcaaaatacagcaatgagcaagaatcggtaccgtcccttctcagctttcacaggcatgctagctcttgtgctaggtttccttaaagcttagggacagagcagctgatctacaaaatatgccagccagggtcttttctctggcctgtctccacttactataccttctccaccctctgactggtgtgctctgactcggacgtaacacgccctcaagtggcttcagagggccatgctgccgctggattgtggagaaatggcgcctcctaccggcttaccctagtcctgagccaacttactgttcctgttcacccagaatcttgtcttctctcctttctttctttttttttctttgttttattttgagacagggtctctctgtgtcacccaagctggagtgcagtggcgtgaccatggctcactgcagccttgacctcccagggtcaggccatcctcccacctcagtctcccgagtagctgggactacaggcacgtgccaccatgcctggattttttgtagagaccccgtcatgttgcccaggctggtctggaactcctgggctcaagcaatccacctgtctcagcctcccaaagtgctggaactataggtgcgagccaccatgccccatcatctttctccccttctttcattcctttagttggcaaatatttagtgaatatcaccatgcccaagtgcctttctgggtgaggatatagcggggaatgaggtagataagtctgtgccctcttggagctgacacccgctgtagttggggagataggcaggaagcagataattgctatgaaggaaagaaaagagtgtaatagagagtgttggaggaaaaagaagacttcataagagtgtgtggccagagaaggcctctctagggagggggcgtttgatggagacttaaatgatgaggagggaccacctctgtgtagatctagaaagggtatagcaaaggtatgaggtggggacttctttgtggttcagtaacaggaaggagatcagtggggctggatcagagttagggagttagagttgtgtgaggcaaggaaggagaggtaagcgggggtggtgggcaggccatgcaggaccatagcctggatctggattataccacaaatgtgatgaaaatcagtagaggccttatggcttaatttatattttaaaacagggacttggactccatagaccacccctagaagagtctgtgcatagaattcagagtccatgaacttggatgggaaaaaaattacatctcaatttttactatcttctgaccaaaccatagcatgtccctctatcatgaatatagacaacagacaacagtagtattagcggtactgagactttgtcaccaagagaatgtacgcagattttcaaattctcttatagttgttgcagatctctcaaaacactgttttcactcatgattgctttgaaattacagtagtcatcagatctattgctggatcttgttacttagtgtgctaataaagaaacccataaatgattttatgaccactcaaaatatgtttgatgcctatatttttttaaattttaattaattaattttttttgagacggagtctcactctgttgctcgagctggagtgcagtggtgtgatctcagctcactgcaacctctgcctcctgggttcaagtgattctccttcctcagcctcccatgtagctgcaactacaggcgcccgccaccacacctggctaattttttttctgtatttttttggtagagatggggttccaccatgttggccaggctggtctcaaactcctgaactcaagtgattcgcccgccttggccttccaaaatgctgggattacaggcatgagccaccgcacccagccaaattttaattaatttattttattttattttgttttttggagacgggtgtctccctttgttgcctaggctgcagtgccatggtgtgatcatagcttactgccacctcaaactcctgggttcaagggatcctcccacctcagcatcctgagtagctgggaccacaggcatgcaccaccatgcctggctaattttccttctcctccttctccttctccttctcctcctgctcctcctcctcctccttctcctcctcctcctcttcctcctcctcctcctcttcctccttctcctcttcctccttcttgtttttttctttttgtagagacagggtcttgccatcttgcccaggctggtctcaaactcctgggctcaaaagattctcacatctagcctcccaaagtgctgggattataggcatgagccactgtgcccagccagtttttattttagattcagggatacatgtgtaggtatgttacaagggttatattgcatggatgctgaggtttggggtataattgttcctgtcacccagtagtgaacacagtacccagtaggaagtttttcagcctttgcccttctccctccctttggagtccctagtgatgatgactataattatgtgattgatttcatttgaaattctatatatctggctggacatggtggctcacacctgtgaccccagcactttgagaggacgaggtgggtggatcatctgaggtcgggagtttgagaccagcctagccaacatggtgaaaccccttctctactaaaaatacaaaaattagctgggcatgggcatggtgggtgcacctgtagcctcagctacttggaagtctgaggcaggataattgcttgaacccgggaggcagaggttgcagtgagccaagcaagactgagccactgtactccagccagggtgacagagggagactccatctcatctcaaaaaagaaagaaagagagagagagaagggaaagaaagaaaagaaagaaaaagaaagaaagaagaaagaaagaaagaaagaaagaaagaaagaaagaaagaaagaaagaaagaaaaaagaaagatcctatatatcatatgttatgtgtttttaattctgagaagagggcaataggtttttttttttttcagatgctgaagaattcagggcacaaaaacatttagacctctattgttttagacccctctctgcctgcctgggggcgaatggatggtctggggtagaaggatggtggtttggaccaggacagtcactgtggacaggaagagatgtagagggaactgggaagacttgcattgcagatggattggatggatggggagaggaagggaaggtgggattaaggctgacccctaagtctctggtctgagaaactagacagggatgtgattaaatgtttcccatctgaacttctcaccatgagaccttctgcaaactgggatgcactttccccattctttcctctcgctggtgattcagaacgaaacccacagacacctctctaggcttctggaggaaaggggaattttcattgagagtcatgctagggaggaacaggagttaacaaatactttaatcaacaagctaagggttataggaaatcagaaaaatgctggtaataagacttgatttctagtcttattcattagattcaattcagtgggcatttaatgggggcttaccaggttccgatatgagttagggatatacgaagaataagatatgcctctggtctgctagagtcagtctggcagaggaaaagtacacataagcaaatgcattgacttgggagacgtgtagcacagggcaggtgggtctcgttttgtggggccaaaagattatgcaacttggagtccctttgaaagaaaaagacaatgtttgaaacaaaaattaggtatggggccttgaaagggttcactgtaaatggggggccctgaagcataagtgttgcccgcttcacagttgatccacatctggagggaggtgaccatggaggtgttactgggctgggggtagctgggaaagggaaggcagggtggacattgtttcacaggatagagtgctaggacttcagaacccttaagctggattctgagatgattagcagcaagagttagagaggtcaggagcacaggagtacccagtccactgccatacacggaataagcagaggcacccccagggggtcagggaatagtgttcagctgtcgaaaagcagggatgttgatcagcagtgactgtttgggtgggtgggggtgagacactgggatatttatttactcagaccaggtacatgtttcaaatcccagaggtatgaatggatttacagcgtggccttctggtatggttttccagacatcaactatgcatacccaagcaaatatccagatatactctttttttgtgtgtgacacaaacagtaccacctcataccctctgttctgcctcttgagctttccactcaacaggacatcctgcagattgttccatgtcaggacacaaagagactcctcattcttgctggtgactgcatagtattccactgtagagctctgccctcattcatccaacccatcctgtcttgctgcatgctcagctaccttctactcttttgccagaatgccacttgctgctgggaatagccttctagagaggtcattttgcacctctctagaaggccattcccagccttctagagtgagaatagataaatttttagcagtagaatggctgagttgaaggctgtgtgcagttgtaattttgatagacattgccaaatcaccctctcaccagcatgtacaagaatgtgtgtttccccacactccccaatgtggtattacacactatttttatatttggtgatctgagaggtaaaaatgatatctcagtgcaattgcagtcgtgtttatcttattgcgagtgaatctgagtgtatttccatccagagctgttcacattaatttcactgggcactctccagacctgtctgtcagccacattactactgggttgtcagttttttacttatggatttgtaatcactacttttttcttcttctttaattatatagagttatttgcaaaatctctctttgtatattaaagaaatgagccccttctggcctgggcagggtggctcatgcctgtaatcccagctctttgggaggccgaggcaggcggatcacgaggtcaggagatcgagaccatcctggctaacacggtgaaacctcgtctctaataaaaatacaaaaaaattagccaggcgtggtggcgggcgcctgtagtcccagctacttgggaggctgaggcaggagaatggcgtgaacctgggaggcggagcttgcagtgagccgagatggtgccactgcactccagcctgggcaacagagtgagactccatctcaaaaaaaaaaaaaaaaaaaaaaagaaacgagccccttctgttgaattgcttatatattttcccagtttgttcacttcctggcacatcaaattggtctttaggaataatagcattgggaagaattgaggggcatgtgccaacccccacaatttcccagaaggaaaaaattgtaagtaacatgttatagctttcaactttacataaaatttgccaagtaaatgatgaagcatcagtcttggttcattaacatatctatgtggaacacctactgggtgccaggtgctgttctaggcactgaggatacagcagtgactgaaacagtcaagatcatgctctcatggagctgacgttccagtgagaggggcatgtcatgaatgagtaaacaggaggagcgatgcctggagatggtgttaagccttgtgagggagatgaaatggggtgataaggggaggccaggccaggggctggtatagactgggtggtcaaagagggcatctctgagagggtgactttgtgttaggatccaggcattagtgtcagaagtagaactgcccaggagagggaacggcatgtataaaggccctgaggcaggaacaagcttggtgcatttgaaaaaaaaaaacagaaaagggctaaatggctggagcacagccaaggagggatagggcagtgggagatgagcagggagatgaacacaggcctcagtataaagggacttgtaggcaggtgaggggttttgtttgcattgttgagggctatgagaagccattggattgtgtgtgtaaagcggttttgctttttctttcagaaatgtttaaacgtaaaagtagagagaattatgtcatgaaccccacatactcttcaccaagctcaatagatatcaacattttgcccttcctattggcaaataggatttcatctaaacccctcactttttttggtgggtggaggattggattttttttcccctccctctttccctacctcatccccccttttttccctttattttactttattttttactcaccactatacaaacaagatttttttttttttgagatgggggtctcactatgttgcccaggctggtcttgaactcctggcctcaagcagtcctcctgcctcaaccacccaaggtgctgggattacaggcacataccactgtgcctggccctgtcttaaaaaatacttttattaaaatataatgcatatataaaggtgcacaaatcataggtatacagctgtgagcacacccatggaactggtacccagatctagaaataatgtggccagctcccagaagccccctggtgtcccttttcagtctttactccccaaacttcaaccattagaatcgtacaggatgttctctgtcatgactagctctctcactgattatgtttgggaagtctacgttgtggcatgtaaccatgacttgtggactgctcattctcattgctgtagcttccactgaaacagtttctttacccattctactgttgtgcgcgcttgggctatcttcaagtcctgcctatttcaaatggtccacgtgaacattgtagtacatgtcttgtggtaaacacatacacatgtatggtgggttacatgcaggagtggagttgctgggtcctaagggtggtgtatgttcagctttcttttttttttttttttgagatggagtctcatactgttgcccgagctggagtgcagtggcgcaatctgaactcactgcaacctccgcctcccggcttcaagcgattctcctgcctcagcctcccaagcagctgggattacaggcacccaccaccatgcccagctaattttttgtgtttttagtagagacggggttccactatgttggccaggctggtctcaaactcctgacctcgtgatcctcccgcctcagcctcccaaagtgctgggattacaggcatgagccaccaagcccagccagttttcttagatagcgcctatattagtttgctagggctgccaaaacaaagaaccacaaactgggtgacttgaggtaaatatattgcctcacagttctgaggctggaagtcagaaatcaagctgtcagcagggttgtgagggaaggatctgtcccttctgagggctgtgatggagagatctgttccaggcctctctccttggcttgcacgtggctgtcttttccctgtgtctcttcacatcatcttcccgttatccatgtctatgtccaaatttgccctttttataaggacacaagtcatataggattagagcccaccctaatgacctcattttaacttgatcatctgccaaagaccctatctccaaatagggttaatctctgaggttctgggggttaggattccaacttacctttttggggggtggcagggagtggggggagacactgcaacctataacagtgctaaagagcttcccggagtggttgtactaatttacactatttgctggagtattttaaagctaattccagacatgaaatcatttgccttgggagtgttttttgtttgtttgttttgttgtgttttttgagacagagtcttgctctgtcacccaggctgcagtgcagagacacagtggcatgatctcagctcattgcaatctccgcctccgggttcaagcgattctcctgcctcagcctcctgagtagctgggactacaagtgtgtgccaccatgcctggctaattgtttgtatttttagtagagacagggtttcactgtgttagccaggatggtctcgatctcctgacctcgtgatccgcctggctcggcctcccaaattgctgggattacaggtgtgagccaccgtgcccagccaggagtgtttttaaaggaggaaagacctggtctggtttacaattttattatttatttatttatttttgagacagagtcttgctctgtcacccaggttggagtgaaggggcgtgatctcggctcactgcaacctatgcctcctaggttcaagcaattctcctgcatcagcctccggagtagctgggactacaggcgtgtaccaccacacctggctaattttgtatttttagtagagacgagattttgccatgttggccaggctggtgttaaacgcctggcctcaggtgtgtccgcctgcctcagcctcccaaattgctgggattacaggcatgagtcaccacacccggcctggcttacatttttaaatgattctatttgttctgcggaaatgttaaaacaaggaaaatatttcatcaagaaagaaagggtagccgggttcggtgactcacgcctgtaatcccagcactttgggaggccaaggcggacagatcacaaggtcaggagattgagaccatcctggctatcatggtgaaactgtctctactaaaaatacaaaaaattagctgggagtggtggcgggcacctgtagtcccagctacttgggaggctgaggtaggagaatggcgtgaacccaggaggcggagatttcagtgagccgagatcacaccactgcactccagcctgggcgacagagcgagactcaaaaaaaaaaaaaaaaaaaaaaaaaaaaaagaaagaaagggtaaataaagagtgagccctcccaggactgcccagttgggactctctggtaccccatggtagagagaagcctctgggtgcccttagctcagggatgccattcagagaccgagtggacgatccctcactgcccagtgccagatcgccatgtggagcagcttcctggtttcagcccctcaaggttcaggtgatgcagagaggatgaaacccagccaggactcaggctatctttctgtccaccccactccctgccaggacatacagcagctcctccagctccagcagctggtgcttgtgccaggccaccacctccagccacctgctcagttcctgctaccgcaggcccagcagagccagccaggtaaggcccccaccccagatggcctccctgacgcctccacagaacttcctcaccttcccctccccctcaccctgtgtatttccccttgtctttccaggcctgctaccgacaccaaatctattccagctacctcagcaaacccagggagctcttctgacctcccagccccgggccgggcttcccacacaggtgagactgtccattgagtgcaccaggccaggccagcagcaaggcctgctgaaagctgggtaaacgggggtgggggatgagtgagagtctcctttccatttgacccagccacactctgccagtgatttgctgtgagacctcaggcaagcccatctccctgtctgggtcagcctcttcctctatagaatgaggggagctggcccagacaagtggttcttaaccctttctagtacatgagctcctttgagaatatgatgaaagatttagatctgatccccattcccccaaaatgctcatgtgtaaaaacacacaaaattgcaaggggctgcaagcctttaggctgcaaatgcctcgggcctcttccagcactgcaacggaggattctctgaacaaggcattcgttaggtgattatttcacatccacttcccagactggagactgaaaacaaggcccacaggtgtcttttatttggtcattgtcaactaaattcccagaaagcaccacatttccagctcctcttgataaaccagaaaatctggcagggctgtacctgtgtctacgtggtggcttggcgcagtgagcagttggcctggccactggcaggagcagaggccccttagagagggtgccagctctccaggccaccttggcacctggaccccgaggcctttctttcagtttgctgcctgagttctagactttaatgataattttcactaccttttatgaatttcaaagtttttttctacccattttttatagccctttaaaaaaatatatgtgaactatttcagaaggactgactgaagagttagagactaatacaggtcttaactgcagttctgaaatcccaaatgctcagaaagtcaagttgttcttccaccattggcatgagaactcatttgactgcaaaacctgccctgccatgatataagccagtgtatgacttttctttgtccctcttggtatggcatttttgctgctgcaaaactgttactgtatctgattaaggagtaatattcttgaccctagtgggggtgggggccgggccacattatctatgatatacatcctatgtaggctttctttctttttgtttttttttttttttttgagatggagtctcgctctgttgcccaggctggagtgcattggctcaatatcagttcactgcaccctctgcctcccaggttcaagcgattctcctacctcagcctcccaagtagctgggattacaagcatgcgccaccacacccagctaatttttgtatttttaatagagatggggtttcaccatgttggccaggctggtctcgaactcctgacttcaggtgatccacctgcctcggcctcctaaagtgctcggattacaggcatgagccactgtgcctggctgcctatgtaggttttctgaaaactgaaacaggcacggtggtgcatgcctatagtctcagctacttgtgagcctgaggcaagaggatcacttgagcccaggagtttgaggccagcctgggcaacatagcaagactggtctctaaaacaacaacaacaacaaaacctgagaggggtgagagtgggtggatgatgagaaattacttaatgggtacaatgtacactgtttgggtgatggatacactaaaagcctacgcttcatcactacacaatacatttgtgtaacaaaattgcacttgtatcttttaacattttgttttttgtttgagacagggtcttactctgtcacccaggctggagtgcagtggtgtgatcacagcttactgcagcctcagcctcctgggctcaagtgaagcagtccccagccctcctgagttgctggtactacagtcacgccccacatgcttggttaatttttaaaatttttgtagagatagggtttcgccatgttgcccaggctagtctcaaattcctgtgctcaagcgatcctcccactttggcttcctaaagtattgggattacaggtgtgagccattgcactcggctgtccttaaatttataccaaaaaaaaaaaaaaaggcagggcgcagtggtcacccctgtaatcccagcactttgggaggccaaagcgggtggatcacctgaggtcgggagttcgagaccagcctgaccaacatgaagaaaccccatctctactaaaaatacaaaattagccgggtgtggtggcgtatgcctataatcccagctactcgggaggctgaggcaggagtatcacttgaacccaggaggcagaggttatggtgagccaagatcgcaccattgcattccagcctaggcaacaagggtgaaactccatctcaaaaaaaaaaaaaaaaaaaaaactgaaaaattcctaaacatctgccccagcattttggagaataatggataaaggacctgagcgacaaacatccctgtacccaccacctgcttcatatcctttattgttagggcaatgaagaatcccagatagagctgttgcttttttgtaaatctctctaattgccctcccagtccttttttttttttcttaacttttactttatttgcaatctactcattgcttaggacttaatttcttaagagctgttttagattcacagcaaaactgagtggaagatatagagatatcccatctatctctgcccctacacatgcacagcttcctgcatcatctacatccccaaccagagtggtacaagcgtaacaggtgatgaacctacattgacacatcactattacccaaagttcatagctgacattagggttcactcttggcattgtacagtccatgggtctgcacgacctactcatttttaacccgattctctcaacagccccactgggtagacagaacagcagtgattgttcccatcctgcagagggggaaagtgaggcctgggctaagcagtgatttggtggcagggccagtccctgattcccaggttgagatgaggatgaaccactgcctccagctccagggaaagagccctggcacaaaaagctggctgctccttctgggagttcgcaggcgtgaagggacagtgcagagagtcccaggcaatgaggaaacccatgtagggcagcagagtcggacctttaaagggattaacagtgcatgtggagggacctttaaagggattgacggtgcttgtggaggaaggcggggggagtctgcaggcggcggatggaacgcaggggcgaagagggcgggagggggactgtgcacccatcgctgagccccatcctggtcctccgccctgcatcccacccacctgcccaccccaccaggccgtgacccgccctacgctgcccgacccgcacctctcgcacccgcagccccccaaatgcttggagccaccatcccaccccgaggagcccagtgatctggaggagctggagcaattcgcccgcaccttcaagcaacgccgcatcaagctgggcttcacgcaggtctggaggcaccttgcaggctgggcggtgggcgtgggggcgtggccagttgatagatgccgcgaggggcgtggccagtgggcgggcggagcgggcccagtgccggaaggccccaccctgacttcgggcccttccccgccccactggcccagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcaggtgggaccaggctggggttcccgcgtagggggcgggcagtggccgctggccgcgggaggccccttctcatgctcacgtctcccccggcgcacagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcggtgaggcccccctctcctgggtggccctcacctgaggggtggcgggcggtgggcctcgggctaacgagccctctgcctgcagaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtaccaagagcccgcctggggggtggggagaccacagagctccgcaggcacctgtgtgaagcccaccctacctggttgtccacagagcctagaacagagacaagaagagtcactcttggagacaggccatcacgtagatgggcacagttacacagggacggtttccagggaactgtggtcttacatgggggatacaagcacccctagatacacaccgacatagccagacacagagttatcacagtgccatagccacacaggaagggatatatgtccagggacgtggtccaggttagaacacacaggctcacaaccacacagaggcagggagaggcacttatttgccgttcggggaaattgtcacacccatgggtgtactctcaggtccacagctatacacaggcccacttgatatcagacacagctgggacatcctttatcccatccttttatttccatttctgggaagagctgtgatgctccagagaggagcccctgcccccatcggtgtgaaggaggcactgtctgaactgagttctaaaggacaagggagagttagccagccacaagaaggcaaagagccttcctggaccagtgtgtactaaggcctagaagccagggtgtgcccagcccaatttgagaaactccagtgcaatttagtgtggttggtgctgcagtttatatgaatgaggttggggaaggagtgggggcatgtaccccaagttttacagtgaagagctggaacttgaaccatgggcagtgaggaggtaaggagtggttttgagctggggaaggagagagtcacatttagtgaggtttctggggctgatgcaaaggtgagactggaggtggggtggccaagaaggaagctgatggtcccagaaaatcaagtaatatgacatctcaacaccccgatgcaaagatatgcatccatttagcctcgcactttagatctgctctttccctgcctgggtcactttgaacagtctctcctgcattgcttgccaaccccactggtaaaagggtggtgtttgcttgtccagggaaaagagttttagttttgcagaaccaacaatatcaggagcatgtggagcagccactcttccggtgcagtcacttcagacaggacacaaccctgcaaagactagccagatggggcggtgtcagaagagaggtggggagtgttctcaatggagaattagcccttcctgcttgtggctcaggatcagctagggcaagtgtgaagaaagcatgtggaataatacaaatgcagcattgtgccaaagccccctgcccccatcctgggacggaggagtggggtcctacagggagcatcacgggggctgctggcagacagtggctaaccacacctcctttcttctctcctcaggtcacaccccaagggggcgcggggaccttaccgttgtcccaagcttccagcagtctgagcacaacaggtcagggagggcagaaaatggtgaggggggactgggaggatgtggcacaggctggagcctgaggttcccaagtggctctgggtgtccatgggcctcaagactgggcctggggagtgtgggtgggggaatgggagagacagtgggaagagggtaggactcacccctcctctgcaggagcaactcagctttaatctgcttcacgatttcatatgagaaaagcatgggcctggtaaaaggtgaggcacttgagttttgtgcctggcctctgtcatttttaagctgtgtgaattcaagcacttattttatccttctaagcctcagtttttattaaattattatgaatgtgtaaaacataaaaagatataaatacatgtatgtaagagtgtatgtgtatgtacatatacacacatacatgcatacatacatagtcttgtatccagagttcccctccctcttcctgggacacggtaggtttatatgtatggttatacaccatatatataataataatataaaattcgctgggtgtggtggcttatgcctataatccctgctctttgggaggccaaggcatgtggatcacctgaggtcaggagttcgagaccagcctggccaacatggtaagccctgtctctactaaaaatacaaaaattagctgggcgtggtggcgtgtgtctgtaatcccagctactcgggaggctgaggcaggagaatcacttgaatccgggaggaggaggttgcagtgaactgagatcacaccactgcactctagcctggtgacagagtgagattccatctcaaaaaaaaaaaaaaaaaaaatatatatatatatatatatatacacacacacataatatatatatgcataatatatatacacataatatatatacacataaaacaacacgttgcccctccccaggctagaaaatagtaagtggagatttataaagtagtaagtgcttgcctggcactgtactaaactctttctaaactgcattgactgacttaattctcaaactcattttatgagatagggtctattattatccccattttccagacaagggatctgaaggtcagagaggttaaggcactcacccaagggcaccactgggatgagacagagccaggagtttctaccccagcagtctggctgagtctgggccctcagcccctgccaggttgcccatccctcagatgtggcagtgtgcctggcacccttcgcccctccccagcccctagagggagccatagggctttgtctcctgggcacccccgtttctagtcggtaaaaaagtggttcagggcagggagtgtagagtgccagggctcagcaggaagcacctgctctgacttccattgttatgacaggggtcaccatggcagaggcacagggaaatgactctgggaagagagggcagggaggtctaaggctgttctgactgaggagatgctgcgtgagctgggcgggaggacaagtaggagctgaccccaggttcctcagtgggggacgagtggaagctgaagaccccatctttctgtctctctctggcagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacggggtaagtgggtgcacgtgggaagctgtggggagaagcagggtcgctgctgcttctagggtggggagcggcaccccagttatgttggcaggtccctgcccctgctaatgcctctgctttgcctcttgcagaagcacaatggtggggttgagctccgggctgagtccagccctcatgagcaacaaccctttggccactatccaaggtgcgtgctgcctcatgtcacacccatcgtcaccagccctatcctctggggcctcgagccctgccattgctgctccagccatgccatcctgcccctgctcactgcattgcttgcctcttcatacccatctcacctttggggaaggtgtgaggggtgctgatgggggtcagtgggaccgatggggagatggggggcactctgggcaggatgctggaaggcaaaggtctcccctggcccggcatgcccttagcccagcctctctctctccccgccagccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaacaaaagagaaaaccaaaaataatcacaacagaaaccagctgccccaaaggaaccagaggtgaaaaacaaacaaaaaaaaaccaaaaacaaaccaaaaaaaaaaaaaacccacaaaatcaaacaaaccaaaaaaccagtcgcgagccagacctcagcgtgctcaccctcactgctacgacgccaaataaaaaccccagccaggggcggagaagcctccagcaggtcagacctcatgccaccgagccctggctgtgggaccaacccccaaccctgcctcccccgtgggggctacagaaggaaaaagagaagatgccagcttcctaatcccagcccccagccctgggccagcgaagacagggcacagcctgggcagatgggctggggcttagcaccacccaccaaatgttcttttccagaaggtgaaagagaaagggcctgaacaaccttacaccaaatattcagtagcttcatccaaaggatgtacagaatttttagcattgtgctcaacagaatgtgtccctaccatgtgtccccttctcccctggcccccagctctccccacctgggcagggggtcttgctttaacctcctccctccccccagcaggggagagttcaagggaaggcctgcggacaacttttcatcccctgttcctccctcttttcccctttgaagggtgggctaggccattttgccaagttctagctctcacaagtccctcctcaaccctgtcaccctcctctgctctggaactgactccctccccagcctatgggaaggtggaaatttcaggcaagaggggatgaagacattcagttgagggcattcagttgtctttttccatcctgtctgtttccctgaaaaaaaaaaaaattcatattccagtgcctatccgtgggatccttcacgttctttgacattaaccagaaaccaaaaagagaactcacctcgcttttcccaccctgtgcccctctggtactggcgaatgcctctccctccccccacatgcacgcacgcacacaccccagtggtggggttcctcgagatggcatccccatcagggtccatgtggtggggacagtgccacagcctgtggtccccatctgagagggcgcggtggtggccaccactcccacaagacctccacaactcttggctggaccctgtgtttgaccagccccggacacgtctccactgacgacggacagaggagagacaccactgggagccaccctgccctcctgctattgtggaggccaacaaagttttgaaccgaaaaccaaaaaaacagaaacaaacaaacaataaatttaaactagaaaaaaaatttatatatatatataaacatatatatatatatatatataaaagggaaagaagatgaggactcttcaagaataagatggaaccgcgaggcggagccaagcccctgcaccggtggtccaggcccttgttccccaaggcggatggaaggacggatgcttctttctcttcacaaatacctcatggacgttgtctttgggaaagccggagggggcggctggggcagggcctgtccctcggccagggcagatggaagcgggtgggcggggctgagagagggtatcagggacaggggtgaagagccccaaactcccctcccaaatcaactgaaaaagctttaaaaaaagacaggaaaaaaaggagtaagaaagcaaaaagaacagatgaaggaaaacttaacaacttttgggtggtttgattcctcctttgatttctttttcggttctcttttgtctgacctctctcctcccctccttcctctctcctcccctccttcctctctcctctcctccttcctgtctcctctctctccctttgctctcctctcttctctctcaatcttgttctttctgtgtctctcctcaaaccaaagtgttgcagtgaaggacacgagccattgaaatcagggtggggcctgacagccgtagtgtggcccctgccccttgttgggcaggagcagagagagaggagagccctgagaccgcagggctttggcctgggcagcttccactttctgccggacactctgaggagaggcagatggagctccaggcctcagcgttctcttttttccttgtctcccttctcccacccgggaaatgaaactgttgggctgggcgacggaggcagcagagactcggccattgcaggggcctctgggtgccttgtccgggcagtggtgaagtagccgcccctcccaccccggcacgatggggcctggcacctcgtctacccaacctcaccggaatgtaagcatctccgctgaacgactccctgcccttaccctacctctgagtttgtccatgtttatttcctgaagagagaagggactggcaagagggcttgggccccagcccaagggtggagagggggccaagggctcctgaccaaataggaaggacatttgagcagagcaaaatgaaaggaattacaaccaaaaaccccctccgagaagacaggcagcatggaaggcatggtggagatgactcaaacaaaaactatgattctagaccaaaaaggaaaaaaaaaaaaaaaaaaggaaagaaaatccaggactcaccaccacccacttcatcctgcttcctccccatcaagtcccaccacctgggacctctccccaccccagtatgtgggagtggggtaaagaggagaggaggagcagggggcagggatggggcagatgccctgatgttggtggagggacccctgtgcagccgggggtgctggggaccctccccatccaaccctcacacctaggaaaagaaaaacaagaaaaaaaaattcctgggagggggaaaaataaccaaatcccaagctttaactacagctgtgaaaccaaatattgggaagggggtaggagggagggaggggcaggtgagccccaggtctccccctgggcccccctcccctgaggactcgagataaggcaccaaatacctcatagaactttaatgttaaaaaaaggaaaccaaatatcgttggctgggggccagccagggcaaggggctggggggctggagggagccagggttgggaaggtgatgggggaattcatgccccccacccccatctgccccttacactctggtcccccgtctcgactccgggaaacaaaactatctcatcgtttttattttgtggtctgtacagagcctgtgtccgtgtgtctgtgtatgagcgagagagttggagggctggggagctttatgtgggggatggggagggcaaccccaggctaggctatgggctaggttagatgtccgaggttgggggccaagggcctgggctagaaagagaggagagatgagtgggttggagcagtggggagccctctgaatttctcttctccccaaccctgacctcctacttaagggagggacagagactgggtctaccctaatggtgggccttttcattgtgccaaaaaaaaaaaaaaaaaaattgatgccagtaactaaaccacctctctctgttctcttctggggggtggggtgggtgtgtgtgtgggggtgggtagggatggggaacccaagccccagtaggagttggggctgagatcaggaggaggggaaggatatgagttttccatccatctccctggagaaggccatgacgggctctccaagccctggggagatctggcgagggactagccaagtcagggtgacctcttgacctgactagtttttctaacccacatgaacaccagggtgcctctctcttcctctagcccagggtagggggacctgagtgagagagagagtgagacagacagcaagattgagacacgcgggcccccactggtctctgagtgggaaaggcaagtgcgagagataaaggcctccaagagaaaaaagaaacaaaccaaagatttaaccatttaaaaaaaaaaaaaaacccacagacaactccgctacctttttatatgttggaaaaaaagtgaaaaaaaattaaaaataaaaataaaaaaaaatacacaaaaactccaagccgcaagtccttcatgcggtttaaactttgacctcagcagtctccaaagcaagacgacgatgacaaaggcggaaacaaagaaaaaataatgtatatttttaagtatttgtccttgaattgttagctccttgttaaacaaacaaaaggagagaaaaatccagagagaagtgttgctgggatggagacaactatttactatgtctgtgacccctcccttctgcctccctccccttcctctctttcctgtcctctatccttgctgcccctcccccaatatgtcccccaaacccaggggctcagtatttatttatttatataattgcagggtgactgggggcctctctcggcaactcgtagagagcctttggataatggcagggtggggaatgggcgaggagtctttgggaagagcaggggcctgaactttcaactcctttctggcctcttgtcccactgcttccaccatcaccttccaaatccagggctgcactagggcaaggtgaccaccctacttggtaaagacctgattggcgcagcccattctggtgtgggtgtctttcaccacccagaatgaccaggttggaatgggggtgggtgaagttggagggggtggcaagtacaaggcaagggtgcccaggaaccggcatccagaaatcagccctggagtagacctgcctttcctccatccttaccaagttagcctccctttcagttccgtctgacccctgtgttggtagccccttccttcccttcctgtaccccctccgtctcttctcgtggtagcgggttagtgtttcagtgttcttaactccaatctgcttgttcattgtacaatgtgcttcttttaaggccccatttttgtaacttgagtgtgtcattcatctgaacaacaaacatcaaaaaataaaaaattaaaaactgtacagagagaaatg

SEQ ID NO: 366 - DNA, 59074 bp, Homo sapiens
gcaggggtgccatcttggctcactgcaacctccgcctcatgggttcaagcaattctcctgcctcagcctcctgagtagctgggaccacgggtgcatgccagcatgcccagctaattttttggtagagacagagtttcactgtgttggccaggatggtctcgatctcctgacctcgtgatccacccacctcagcctcccaaagtgctgggattgcaggcgtgagccactgcacctgggctttttctttttttgagacaaagtctcattctgtcacccaggctggagtgtagtggcgcgatctcggctcactgccacatctgcctcccgggttcaagcaattctcctgcttcagcctcctgagtagctggaattacaggcatgcaccatcaccatgctttgctaatttttttttggtatttttatttattttatttttattttttgtgatggtctcactctgtcagccagactggagtgcaatggtgtgatctcggctcactgcaacctctgcctcctgggttccagcgattctcccacctcagccccccaagtacctgagattacaggcaagtgccactgcaactagctaatttttgtatttttagtagagacggggtttcaccatgttggccaggctggtctcgaacttgtggcctcacatgattcgcctgccttggcctcccaaagtgctgggattacagttgtgagccactgtgcccaggtgcatacacactcattttcatcttaaagactctacatttatattggtctatattggaaaaaacatagagatatggccaggacctgaaatctggtgcgcactgaagttgatcagggcagtgtgtgcttaatctgaacatcgacaccatcaggaagcagcaactccctgcatgattgacatttctctttttttttgaggtggaatctcactctgttgcccaggctggagtgcagtggcgtgatctcggctcactgcaacctctgccccctgggttcaagcgattctcctgcctcagcctcccaagtagctgggattacgggcatgggggttacaggcacctgcccccgtgcccggctaatttttgttctttttgtttttgtttttgttttttttttgagattggagtctcactttgtcacccaggctggagtgcagtggtgcgatctcggctcactgcaagctccgcctcccgtgttcatgccattctcctgcctcagcttcccgagtagctgggactacaggcgtccgccacaaatgcctggctaattttttgtatttttagtagagacggggtttcatcatgttagccaggatggtctcaatctcctgacctcgtgatccgcccaccttggcctcccaaagtgctgggattacaggcgtgagccaccgcacccagccaatttttgttatttttagtagagacagggtttcaccatcttggccaggctgatcttgaactcctgacctcatgatccacccgcctcacttggcctcccaaagtgctgggattacaggcatgagctaccacgcctggctgacatttctctttatgcctgcatctcccccattggatgggaagtccctccagggtgagaccttgtctaagtgaactttgtgcccatcaatgtctgcgtgacccaggcaggatctggctcagccaggagtgggtgtggggggtggaatcaataaaagtttgttgaatgacttaatgacctctgagaatgtatcattttgcaaaagggaaactgaagccctttgcactctaacaattattcctggcacctgatttgcacatggtctggtgcctgagagggagggacattgaatcataggaggggctaggaagtacccattctctagcctggcaggccttatttcttgtcttggctgtatcttgcattattttatgtgatagcttttgtgggcattggcctcttatttccctaagtcaagctcatccaacccctgacccacgggccacatttggcccaggatggaatatggctcaacacaaattcgtaaactttcttttttttttttttttttttttttttgagacagagtcttgctcagtcgcccaggctggagtgcagtggtgtgatctcggctcactgcaagctctgcctcccaggttcacgccattctcctgcctcagcctcccgagtagctgggactacaggcatgtgccaccatgcccggctaatttttttttgtatttttagtagagatggggtttcaccatgttagccaggatggtctccatctcctgacctcgtgatccacctgcctcagcctcccaaagtgctgggattacaggtgtgagccaccacacccggccacaaatttgtagtttcttaaaacattatgagatttttttgcaattttttttttagctcatcaggtattgttagtgttagtgtattttattatttatttatttatttatttatttttgagatggagttttgctcttgttgcccaggctggagttcagtggtgcaatctcggctcactgtaacctccgcctcctgggttcaagcaattcttctgcctctgcctcccgagtagctgggattataggcacgtgccaccacatctggctaatttttgtatttttagtagagacggggtttcaccgtgttagccaggctagtcttgatctcctgacctcagtgatccgcctgccttggcctcccaaagttctgggattacaggcgtgagccactgtgcccggccagtgttagtgtattttatgtgtggcccaagacaattcttcttccaatgtggcccagggaagccaaaagattggacacccctgctctaagtgacttgtgagctttttttctgagacgcctggaatagtttgttactcatgtttttaaatgattaacttgagcaattattactattttttgagacagagtctccttctgtcacccaggctagagtgcagtggcgcaagcatggctcactgttgccttgatcttctgggctcaagaggtcctcctgcatcagtgtcctgagtagctgggactacaggtgcacaccaccatgcctggctaatttatttttattttttgtagagaagggttctcactacgttgcccaagctggtctcaaactcccgggcgcaagagatcagccttcctcggcctctcaaagtgctgggattgcaggtgtgagccactgcacccagctggacaattaacctgagctaatttgaaaaattttgatgttctcaagatgactagggaactggagccctcaatcaacagtcctcagtatcttttctgcagggagggctagatacctcctctgtgacacttaacttccattatccaaggtgcttaggctgtgcccctcaccacgtgtacatgaagaatgcatgcccagccaatcacagtggctcatgcctgtaatcccagcactttgggaagtccaggcgggcagatcacctaaggtcaggagtttgagaccagcctggccaatgtggtgaaaccccatctctactaaaaataaaaaattagccggacatggtggtgcggacctctagttcctgctactggggaggctgaggcagaagaattgcttgaacccaggaggtggaggttgcggagagccaagatcataccactgcactgcaggctgggcaccaaagcaagactccatctcaaaaagaaaaagaaaaaaagaaaaagaaaaatgtattccctctttcagccacgttgagttttcgcaacagcgctacaaacagatgatgtgttctgatagaaataggctaggttcctgcagcaggtgctgtcattttggaagagctcaagccgtctcacaccctcaggtgggcctgctcatacctgtggtgtgggttctacctggctgatggctgagggtctagaattgtgtgcagtagcgttgatcgtgtactgaggttgcaaacagtgaacagcaccatctggacatcgtggattagaatgcaggagcttcccaaggctgctatgacaaaggaccacaaactcagtggctgcaaaacacacatttatttatttgttgatagagccttgctctgtcacccaggtgggagtacactggctcgatcttggctcactgcaacctccgtctcctgggttcaagtgattctcctgcctcaatctcctgagtagctgggattataggcacacaccaccctgcccagctaatttttttttttgagacacagtctcgctctgttgtccaggctgaagtgcagtggcacgatctctgctcactggaacctccgcttcccaggttcaagcaattctctgcctcagcttcccgagtagctgggattacaggcgccggccaccacacctggctaatttttgtatttttagtagagatggggtttcaccatgttgaccaggctagtctggcgactcctgacctccagttatctgcctgcctcggcctcccaaagtactgggattacacgtgtgagccaccacgcccggcccacacatttatcatcttacagtttgggaggtcagaagtctgaaataaattttaggggcagggcgggttctaggagtctttcttgctttttctagccaccagaggctgcccatcttccttgcctcttggcctgatctttttttttttttttttttttttttgagactgagttttgcttttgttgcccaggctggagtgcaatggcgcgatcttggctcaccacaacctctgcctcctgggttcaagcgattctcctgcctcagcctcccgagtagctgggattacagacatgtgccaccacgccaggctaattttgtgtttttagtagaaacggggtttctccatgttagtcaggctggtctcgaactcctgacctcaggtgatctgcctgcctcggcctcccaaagtgctgggattacaggtgtgagccaacgcgcccggcccttggcctgatcattgtaaagcctgcttccactttcccatctcctttgactttgaccttttgtatccctttttcacttattaggaccttttaaggacattgtgcccacctggatcacccaggagacgctccccaactcaaaatcattaactgaatcacacctgcaaagttgcaaagtccttttagctgtgtaaggcactgtattcacagatcctgggggcgaggacgtgggggtctagagacgcatatcttcgggggccatgatctgtctcctatattagggacatagcagaagtcccactgaccagatagaggagacttaatagagtgacgaagaaactgtaaaaagctaagtgggaactcaacatttttctgctcacagctctcaagggaaagaccaaagtcctccccggtggccttcaaggtattatatatcacccctctgacctcaactccccctcccctttgctcagtgggccccaaccacaccagccccttcctgctccctggacacctctaagccttttccggcctctgggtttgactttccctcctagacccatctgtccttggagtctcatctccgattccagctcaaatgtcatcttctctgagaggcccaccgcagtggccccagtgagagagtatcctctctccccgcctcccaccacatggctgctggtcactctcctataaggaatcatctgaaattatctgctttagttattcatttcttgcctgtctcccccagataggaattttccctccctgagaccaccaactgggtctgccatgtacaccgctgggttctgcagctctgagcaacctgtccggctgctttgtaggtgcccagcacaggtcactcctgtgcccgccaggactggtcagagtggaacagacagggcggagggggcagggcagccctgcccgcctggacagcctggagaaggcgggaaaacgaggcgggaaaagacagcaaacaagccctgcgggtgggtagagtggggagccctggcaggccctgacgccaggcagtggggcttggggcgatcgggcgagccatcagggtgcaggtggtctcctaggggccccccacattccctcgcagtatttacacattgattccggccttcttagacctactggtcaatgcgtgcgagtggggggctgcgaacggacttggacttaagagttcagggggtctgtaccctgggggtccccaaggctcctggggtgtccacgtgcggggggtgaccaggccctgccacgcagcccctttgcacgctgggcgcgcccagcagagcgcgcagggctgggcggagccgtggcccactaggcggaggcgccgtggacagaggcgggggcgccccccaccctctttctcgcttcccgccactgcgtcggccaatcaggaggcaggcgcccgcccccggcacggcctcctgcggccccgcaactcccaaatgccgagttttcgcgggaaaaaaatcagagcagctggcagcgcggcgggcagcgtttgccgagcgggcgctccgggtcgcacgcaagtccgcgcggggtccgggccacgcacgcggtttcatcgccatccccagccgggccacgcgcgcaggcagacaagctgttcgcggcgaccggagaggtgagcgggcgggccgggtcggggtgccagcccgggccgggcgcacggggctcgggaactttgcaaaactttcccgcgcggccagcccgggcgcacgcatgtcccgcactctgtcccgggatccagggcctccccttccacctaaccctcgggaatcgttccccggcacacatccggctggagccgggaccagcgctgcgtccccggagcccggcggggggtcgagcgcgccgggtgggggagggcctggcgagccgccggggaggatgtcaggctccgcgcctgcgcgcggggcgccccgcgattcaattgtcgcgcccgagcccgatttcgcgcgccctgagttccccgggagcatctgggccaatggggagcgagcggggcggggcggccgggtgctgcggagccaataagaggcggctcaagtgaaggggggcgggacttgacgagcgggggccccctctgtagtcccggcggcgggggtgggcgtgggctcgctggcgcgacccgcgcgggccagtgggagtgcgggagggacgccgagggtccagggtttggaggggcgcgagctgccgggggttggaggtcgaggtgagtcgcggggcgcgcgcgctcgcgggtggccgggacggggcggccggttaccatggccaccgcggggcgggcccggtcgcgcacgcgcgcggggggggccggcaaggagggggggcgtgggcaccgaggggtcccggggtccgcggatctcgggtggggtttttccctctcagtggcacttggttgagttcccccgggacttctgaagttccggcccgcgctggacttctgggattccctcttccgtaaataggaatccgaggaatgaatgaatcaatgaatgaatgaataaacgaaccaactcggccacttggcccgggcctcctttctcctctggtcgtggggaaggagggatgggttggaccttctgcttttctttcaattccctcttttcattctccttcctcctcaatcttcaacacttggctagtcgttaatgccttaagtgcttaatttgttgtgtctggtcctggccagggtctggctgtacaggaggactggaagggcatcctgggagtttcctggtgtccacaggccggacaaaagcaaccccgactccttagagcatggcatggctcagaggtgctggtaaaactgatgggggtttttgctgtccctcccctcagcgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacaggtacacccgccgccagcacctttgttctatgcctggtccaggcctcgcgcctctgcagccaccagccgatactttctccctcccacctccccccccaacaacctcgtccggtcccacttcatctctcccggaaggagaagtccacagaaacctcaaatgcctgcgagaggaaggaacaaagggaggactcacagattgacacgctgggctggcggctggccctcgaatctatagggtctgggcttttaaacttcttttttcaaagctccgcctcaaaataatggctagagaaagaagttttggaggtggccgatggaaggctgaggaattttcgagaaagggcccaggaccatctggtagctaggacggaggggaccaggttttcttttttaaacatccaccaccaattgctctcagcctgtaccggttaagcatcagaccctgcgagtgtttgtttctaaaaatttggattagcttattcagagtctggagatggcgcttgctaatcaggaatttccgccaccctgagcctgctgtgctgcggctgctgctgacctggggcgtgtggtccccgaggggtccaccgaccctcgtctctttctctgttctgtctccagcccctcgttgcatttaaaatgtccccctttgatttcatagctgccacgtttggggcgctccctccattggcacctgggggtggaggtgctactttggttggtgtttttgtgggggactgtgggacctactgggagtggggtttcccggcaggatgagacagtgtgatcgaaggtgtaggtcccatctgctggagttggttggaccgtggggacgggcgtagactactggaactggattaaaagtcgtcagttgagctgcgtgtaccccactgtgttgttgttggattttgaaccgggtactgctgccatctggtgtctaggttggaaaataaacactgcgcccggccaggggtttttgggggctgggaggatcatgcctgctcactccagatgagacctgatgattaatttctctggcttgcatgccataggagaccttcattagccctcttcccgtaagagacgtgatgacttgagtcttaagaatctgagttaacccgccctgccccgggaggaggcgatctggagaacttggggagttgacggtgcaagccgcgtgtgtgcagagaagaggcagggccgggctcgacagaggagctccgcctggcgctctcttcctccctcctcctatgatgcgtgctccctttgtggcatccaaactgattttgatttgccactcagcctattgggtcagcacagaaggcttcatttcacaaagagtttctgaagcctgcaaggaccttctaagttcacagcgtaggtcagtggcgggttggactctcatgctcccaagttcaggagaggagataatgctgagtatccactctatgccagccaccgagctagcattttaacttttgcatttcaaccatgcaggaatgggaaaacacctagacacacctgccatgtagatttcaccatcggtattctgacttattaggtttatcttgaagcgctctgtctttctctctgcccgccaatccatctttttgggatgcatttcaaagtaagttgcagacaccagtccacctttcccttattactgcagcacaccgtcagtacctagagctcagtatttgtttttggttctgttttcattgattttttttgttgttgttcctatttgagacaggatctcactctgcccaggctgtgttgcagtggcacgatcacagctcactatagcctcagcttcctgggctcaagcaatcctccagcctcagcctcccaagtagctaggactataggcatgcaccaccatgcctggctagtttttgtatcttttgtagagatggggtcttattatattgcccagggtggtctcctgggctcaagtgaccctcctgccttggcctctcaaagttttggggttacaggcgtgagctacagtgccggacctaaaagctttgtctatagtgaaacagatgttagacagactgaataattttgacaaatgtctacatccatgcaacccaaaacccctatctcccctcatttgtaacataatacttgagtcatacaatagtgtctgtcacatttctaagtttagtgtgacaatgacaggaacacgtatgttaattagacatgtacattgtgcttttttttttttttttttgagatggagtttcattcttgttgcccaggctggagtgcagtggctcgatctgggctcactgcaaccttcatctcccaagttcaagcgatcctcctgccttagcctcccaagtagctgggattacagtcacccaccaccacgcctgattaattttttgtatttttagtagagacggagtttcaccatgttggccaggctggtcttgaactcctgacctcaggtgatccacctacctccgtctcccaaagtgctgggattacaggtgtgaaccactgcacccagccacgtacattgtgcttttaattgtcaggatgtccgcagtgatgacacctggccctagccttgccggaactcacccggactgaacagggagctgggattggaacctgggattttggtttctgagactgggctctcaacactgaatttcgtctcccaggtcagctctggtagttatgaaaagattcagtgttcctgtgtaaccttcataaccgcctcttagttcccttaccctgtggctgtttcccatgcagtagcttttttttttttttttttttttggagacagtttcgctcttattgcccaaggtggagtgcaattgcgtgatctcggcttacctcaacctccacctcctgggttccagcgattcttctgcctcagcctcccgagtagctgggattacaggtgtgcgccaccatgcgcagctaattttttttgtatttttagtagagatggggtttctccatgttggtcaggctggtctcgaactcccgacctcaggtgattcacacccccctcccccaccttggcctcccaaagtgctgggattagaggtgtgaaccgtcgcatccggcccccatgcagtagcttttaagagatcgtgtcgttgcttctgtcttccgggccacagagaggtgatgcagtttccccacttgcatggctgggaaagtgagctggcagcagggaggtttggacagtggcgggaaggcgggacagaggcacacagcagcacctcccagagcgtgaagtctgcaggcacccaggctaacgtgatagaaagcaacacagttcccggtgggcacaaatgggcagttgtccttatagaatgttctagagtgttcacagtctttttttttccctgtttaaagaaacctggcctagcagcccaaggtctgcagtgaagttgatggagaccccagagcagaacagagttgggtctgtctcggaatatggaggatctcgtggtggtctcacttgggctgaatagggtgacagtgatgtcacttgatgggcgggaacgcagggagctgatcgagggcagtgactttgggcagacggcccagcctaggcaacgggagaggcatctgcggcccccacccctcaatcttttttttttttttggctgcacatcaaaataacaatagctgtcttttgcggcacctttaacctgctcgggtacaacgctctgcactgtacataatcttttcagcatccctggcccgcgactcgccagctcccacatcatcttattttagatagggctaatacccaccacgctgcagcgcagtgcgaattcaatgaggttgtggatttgaagggcggagtgagccctgtgccaggctcacaatgaaagcgaaatcaatctcttagcacagggcctgtcccgctctgcactgtggatgtttggggccaggtcatcctctggctgggaccgtcctgggcactgcagggtgcggagcagcgtccctggcctccacccactccatgccagagcatcctgccctaccagtcatgacaaccacaaatattcccagagacttccatgcctcaaaggcaggattaaggtcagtctgatgcctcagttgaaatggtggcccaggaatggccttgcaagagtcacttgtcacagtgatgcctcaggtgtccccactggacggcccccttgcagagacctgcccttctgtctgcgggagggagggtccccaccaccagctcccacccactgcggcatccctcccccaggatggctccctggtagagggcgcggcctctgttagggtgactcaccactgctgttgtggccccgaagcagctgtagacaatctgtaaaccggtgggcgtggctttgttccaataaaacttgatttataaaaacaggtatggcggggcccagtggctcatgattgtaatcccggtgctttgggaggccaaggcaggcggatcacctgaggtcaggagttctagaacagcgtgccaacatggtgaaaccccgtctctactaaaaatacaaaaattagccagacgtggtggcgcatgtctgtagttccacttaggaggctgaggcaggagaatcgcttgaacctgggaggtgggaggttgcagtgagctgagatcccaccactgcactccagcctgggcgacagagcaagactccgtctcaaaaaaaaagcaaaacaaaaaacaaaaccaaaacaaaagaggtgcaggccagaattgtccccgtggacatagttggtcaattagattgcatactttaatccagcctcagttggtgtgtctgggttttctggctaggaagaatgctgctgtggaatgtgctggaacagatccttacgtgcgctgtgttggagtctttccaggtcaggggttctcaaacggatttcaggaccctttacatcatccagaatgatccaatagccccaggagcctgtgtctgtgtggattatgtctgccggctgttagtgtgttagaagttgaggccaggcatggtagctcacacctgtaatcccagcactttgggaggctgaggcgaggatcgcttgaggttgggagtttgagaccagcctgggccatgtagcaagaccccgtctctacaaaaaatgaaaattagccgggcatggtggcgcatgcctgtagtcctagctactcgggaggccaaggtgggaagatcacttgagcctgaaaggttgaggctgcagtgaaccaagattgtaccactgcattccagcctgggagacagagcgagactttgtctcaaaaaaaaaaaaaaccaaataaattgaaagctgagaaattcagagcacaagaagacaagcgcgccccctcttttagctgtcaacatggcggagccgtccctggtgacgcagcctccaaaggcctccctgtgccctcctgagaccgcaagagggaaagtggcagcgacagtgatcgtggtgtctttgtggcggttgtgttgacctcactgacccccgaagtgccgctctagggtctgtcctcagcggtgacccggccgggtcgaagggcagagttccgctgtcactagccctccacccgtcctgtgtgctgggatgccctcgcggcgccgtccacgccaccgccgccccctcttgtgggttctgtctcctccgtgtctaggatcctcctgcatccgtttttccttcctcccttctctccctccgtctgtcttgcccgcacctgaggttgtcgcagaggcgctgagacgggccagcaggagctgtggctgcccctcaggaaggcagagcagtttctcacttccttccccccaggtcccgtcaggcccctgcaggcactctctcttccggctggaggtccctcctgatcgaggcttacacggtctttgctgagctcctaaacttctggtttctatccctaaagttggagaaccactgctccccaaacccggtggcattatctgccctgctgtgccgctaggcagtgttcggcaccctgaaagagagcccctgaatgtggcacgaggggtaggaagtgggcagctcggtggggggggggggtgcagtgagcttttagtcttaagttttcgtttttttttttttttttttcttttttatagagatgggatctcgcttttttcaccaggctggtcttgaacccctggcctcaagtgatcctcccatcttgacttcccaaagtactgggtttacaggcatgagccaccacactcggccctttgtctaagttttcaaaaggaatcagcaaacttagttatcaagttgtatttgtatttatctggacacttttttttcttttcttttttttgcctttaagggagacagggtccacaaggccgggcgtggtggcttacgcctgtaatcccagcactttgggaggctgaggcaggcggatcacgaggtcaagagatcgagaccatgctggccaacatggtgaaaccccatctttactaaagatacaaaaattagctggggatggtggtgcacgtctgtagtcccagctacttgggaggctgacgcaggagaattgctggaacccaggaggtggaggttgcagtgagccgagatcacgccactgcactccagcttggcaacagagcgagactccgtctcaaaaaaaaaaaaaaaaaaaaaaaaagagacaaggtcttgctgtcgtccaggctggagtgcagcggcgtgatcatggcttactgcaacctctgttttccaggctcaagcaatcctcctacttcagcctcctgagtagctgggactacaggtgcctgccaccacacccaatatttaaatttttattaattgaaaaaacttttttgcagagacagggtcttgcctggtatcaaactcctgggctcaagtgatcctcctgcctcggccttctgagtagttgggactacaagcatgagctattgggcctggcctagcttttatacaatgcccatgttacaaaattccaaatgtccaaaaagcaaggagaatatcttccactctgccttgaccttcagtttcccccctgtagtaacctgtctgcttccagaagtgcttgaacatgtgtgcgtttgctatgggtttttttttgtttgttttgttttgtttttgagatggagtctcactctgttgcccaagctggagtgcagtggcgtgatcttggctcactgcaacctccacctcccaggttcaagtgattctcctgcctcagcctcccaagtagctggggttacaggtgcacaccaccacgtccggctaatttttttgtatttttagtagagacggggtttcaccacgttggccaggttggtctcaaactcctgacctcaggtgatccacccaccttggcctcccaaaatgctgggattacaagtatgagtcactgtgcctggcctgtttttttttttttgagacagagtcttgctctgtcgccaggctggagtgcgttggcttgatgtcagctcaccgcaacctccacctcccgggttcaagcaattctgcgtcagcctcccgagtagctgggactacaggcatgcaccaccatgcccggctaattttgtatttttagtagagacgaggtttctccatattggtcaggctggtctctaactcctgacctccagttatctgccggcctcagcctcccaaagtgctgggattacaggcgtgagctactgtgcccagctggttttttttttttttttttttttttagacaggctcttgctctgttgcccaggctggagtacagtggcacgatcttagctcactgcagcctcgaattcctgagctcaagtgatcctcctgcctcagcctcgcaagtagcagggactataggctgtatactactatacctggctgattttaaacatttttatagagatgggttcctgccatgttacccaggctggtcttgaactcctagcctcaaatgatccttctgcctcagcttcccaaggtgctgggattatagacctgagccactgctcctgacctcattttttttttttttttttttgagacagtgtatcagtgtctcccaggctggagtgcagcggcgcgatctcgactcactgcaacccctgcctcttgggctcaagcaatcctcccaccacagccttccaggtagttgggactagaggtaaattttatagtgatgggttttgccatgttgcccaggtgatcttcaactcctggactcaagtgatcctcccgtcttggcctcccaaatcatacctgagattacaggcatgagccactgcacacagccccattttaacttttttttttttctgaggcagagtctcgctctgtcacccaggctagagtgcagtggcgtggtcttggctcactgcaagctccacctcctgggttcatgccattctcctgcctcagcctcccgagtagctgggactacaggtgcccgccacctcgcccagctaattttttgtatttttagtagagatggagtttcactgtgttagccaggatggtttcgatctcctgacctcatgatccacccgcctccgcctcccaaagtgctgggattacaggtgtgagccaccgcgcctagcccattttatcttttctgataatgattttccttttgccaaaaacggcaagtgggttttagattaagtcactccttttaccaggcacagtaggagaccttgagttagggctgaggtggtgtcatttaatagggacattcaacttcactaggttcaatgataggagactttacaaatttccataatggtaaatcttctttcatttaaattattattattgttaatatttttttttttgagacagagttttgctcttgttgcccaagctggagtgcagtggcgtgatctcaactcactgcaccctccgcctcccgggttcaagcgattctcctgcctcagcctcccgagtagctgggattacaggcacccaccaccacgcctggctaattttgtatttttagtagagacggagtttctccatgttggtcaggctggtctcgaactcctgacctcagctgatccgtccgccttggcctcccaaggtgctgggattacgggcatgagccatcgcacccggccaatcatttaaattattaatgaagaataaaaagaggctgggcgcagcggctcatgcttgtaatttcagcacttcgggaggctgaggcaggcagatcacctgaggtcgggagttagagatcagcctggccaacatggtgaaacctcgtctctaccaaagatacaaagattagctgggtatgctggcatgtgcctgtactctcagccattcgggaggctgaggcaggagaatcgcttgaacccgggagacggaggttgcagtgagctgagattgcgccactgcagttcagcctgggtgacagtgagactccgtctcaaaaaaaagaaaaaaaaaagtaagtcccacgtagccatcaccctctgcagtagtcatctgctgtgtctgatcttgttcattttgctcatttctaccctacccacttacctctacctgactggattgtttaagagatgggatcttgctgtgttgatcagggtggagcacagtggctattcacagatgtgatcattttgcatgagaaccccaaactcctgggctcccctgaccctccagcctcagtctgccaagcagctgggactacagatgtgagccactgtactggctcctactggatcattttgaagtgagttacagatgccataactataacacagacatcataggtacaggaatttcagtgcatcttccccagtggctcatggatcacacagatagaaaatcggtcaggagggccacgcgcggtggctcacacctgtaatcccagcactttgggaggccaaggcgggtggatcacgaggtcaagagatcgaaaccatcctggccaacatggtgaaaccctgtctctactaaaaatacaaacattagctgggcgtggtggcatgcacctgcagtcccagctactcgggaggctgaggcaggagaatcgcttgaacccaggaggcggaggtcacagtgagtcaagatcgtgccactgcactccagcctggtgacagagggagactccgtctcaaaaaagaaaaaaaaagaaagaaaatcggccaggatgccgggcacggtggctcagccctataattccagcacttcgggaggccaaggcgggtggatcaactgaggtggggatttcgagaccagcctgaccaacatggagaaaccccatctctactaaaaatacaaaattagccaggtatggtggcgcatgtctgtcatcgcagctactcgggaggctgaggcaggagaattgcttgaacctgggaggcggaggttgcagtgagccgagattacaccactgcactccagcctgggcaacaagagtgaaactccgtttcaaaaaacaaacgaaaaaggaaagttggtcaggatgctgggcacagtggctgggtcctgtaatcccagcactttgggaggctgagtcagaaggatcagttgagcccaggaatttgagaccagcatgggcaacatggagaaaccctgtctgtacaaaaaatacaaaaaactttctggacgtgatggcccatgcctgtagtcccagttacttggaggggccgaggcgggagggttgcttgagcccaggaggtcgaggttgcagtgagccatggtcgtgccactgccctccagcctgggcaacagggagggagaccctgttttaagaagaaaaagaaaattgataaagatgtagatgatttgaacaacacaagtaacagggttaccgtaatgacatggatggaatctgaacccagcaagagagaaaacacattcttctcaggccacgaggagtgcttagggaaactgaccacatacaaggcaagtcttaaaaactcgatttttatttttatttgtatttacttattttgtttatttatttgagacagtctcgctctgtcgcctaggctggagtgcaatggtgagatttcggctcactgcctcccaggttcaagctattctcctgccttagcctcctgagtagctggaattacaggcgtgcgccaccacacccagctaatttttgtatttttagtagagatggagtctcaccatgttggccaggctggtctcgaactcctgatctcaagtgatctgcctgcctcggcctcccaaagtgctgggattacaggtgtgagccaccggacctgggcttttgttttttatgttttcatttatttatttgtttttgagatggagtcttgctctgttgcccggactggagtgcagtggtgtgatctcggctcactgcaaactctgcctcctgggttcaagcaattcttgtgccacagcctccccagtagctgggactacaggcgcccaccaccacgcccgggtaattttttgtgttttcagtagagatggggttttgccatgttggccaggctggtctcgaactcctgacctcaggtgatccatccgccctcggcctccccaagtgctgggattacaggcgtgcaccaccgtgcctgaccctttacaaatttagaacaattactgccttactgaccatgttttctctcacctgtggggtcagaacttaacaataactaagcttcctccttcgcgcttcgggttgtgcaagcttcctcctgcctgctttggggcctttctgcaatgttccagaagcggcatcaggaggctgcccagccagctcgtgagttgtgttctggagtcagagttttgtgccagcctgggccaggccccatccccacttcccgccccatttgcccctgtctacatcattgtactgggagacacttcctgtccctcctacgtagcccacgctaagcagggtgcttctatccacctcacctttccgatgtgggaagggccgaagtcatggaggggcgacccgtcaggcccagcaagggtggcacagatgttgtccctagtaacagatgagaggggatgggctgggactgcaggcctggctccccaagctgctcctgcgggtcaggggctgcccattagcctggccagggcccctcattggatccctcctggccgcccagaccacagcccttgcccccctgcctacccgccaccagttctcattggccctgcctccctgcttaactctgccgccttggcttcccctcctcggtctgtctcctccccgacttgtcctctgtctgagtctggcaggacagagtccgaccgtctggccccctcctggctccgtctgctcctcctgccgcctcctgctgtcgaggtcacttggttcttggcctgtctggcccccagccaccctgctggctgcctgctctccaggcagcccctcgcccagggctgcacctccgacctgtcctccgtcttgggtggggctgggactgtattttccatcctctgcagtggtctggtttccctcgtgcgctgaggcccctctgcttggctgcccctggctgccccatgcagctgagccatgagcgcggcctgtgtgcccctctcccgctggctggagctcaggatgctcacgccgctctggcagatatcgctgctgcaaacataggaggagcagctgcccctctgcgcacgtggccttcggacacatgtgagggccgctctagcttgggtgctcactgcgggtgattccaccctccaggggacactgggggatgtctggggacattcatgactcgggcgctcctggcgtggagtaggtggaggcctggagtgctgattagcaccctgcagggcccaggaaggccccaccccagagagtgatcagaccccaaatgtcagctttggcaagagcagtgtgcctggccacagaggtgctggcccggatgcagatgagtgccccatccatccctctgagcgccgtgtggcttgtcccatgctgcttttcctgacccagtgatattgggggcacttgacttctctctttttaagacggagtctcattctgtcacccacgctggagtgcagtggcgagatcctggctcactgcaacctccacctcccaggttcaaatgattctgttgccttagcctcttgagtatttgggattacaggcactaaccaccatgcctggctaattttttaattaatttttaatttttttatttttttgagacggagtctcgctctgtcgcccaggctgcagtgcagtggcgtgatctcggctcacggcaagctccgccccccgggttcatgccattctcctgcctcagcctcccgagtagctgggactacaggtgcccgccaccacgcctggctaattttttgtatttttagtagagatggggtttcgccgtgttagccaggatggtcttgatctcctgacttcatgatccacccgcctcggcctcccaaagtgctgggattataggcgtgagccaccgcacccggccaatttttgtatttttagtggagacggggtttggcaatgttgcccaggctggtctcgaactcctggcctcaagtgatctgcccacctcggcctcccaaaatgctgggattacagagtaagccactgtgcccagccccttttttagaaaaaattaataaactttattttctagagcagttctaggttcacagcaaaattgagcagaaggtacggagttcctatagaccccctgccccaacaggcatagccgcccccactgtcagcctcccccacagagcggtgcatcggttacagttgatggcccgatggccctctgtggagtcatcttcatctctgagtccacagtctacatacaccaaggcttgcccttggtgttaagtttttttttttttttttttgagacagtgtctcacttgtcgcccaggctggaatgtagtggcgtgatctcggctcactgtaacctctgcctcccaggttcaagcgattctcctgcttcagcctcctgagtagctgggactacaggcgcgtgccaccacgcctggctaatttttgtatttttagtagagacgaggtttcaccatgttggccaggctggtctcgaactcctgacttcaagtgatccacctgccttggcctcccagagtgttgagatgacgggcgtgagccactgtgcctggcctgcttcatgttttaaataacggctttattatatccctgcagttcacccagttaaagtacacagttgaggtatattcatagttgtgtaatcatcactgcagtctattttagaacattttgtcaccttgaaaggaaaccctgaaccctgtcccagctactgcttcctttttctgcatctcctcccgcagcccctggcaccctcaaatccccttcctgcctctgtggcttggcctgtcctggaaatttcatagaaatgggatcatgcactgcgtggccttttgtgtctggtgtttctcactgagtgtgatgtcctcaaggtgcatccacactgtggcctgggtcacagccttgctccttttcatggctgagtcgtattttattttgccttatattttatttattttattttatttcttaagacagtcttgctctgttgcccaggctggagtgcaatggcacaatctctgcttactgcaacctccgtctcccaggttcaagcaattctcctgcctcagcctctggagtagctaggattacaggcacccgccaccacgcccagttaagttttgtatctttagtagagacggggtttcaccatgttgaccagggtggtctcaaactcctgacttcaggtgatctgccctcgttggcctcccaaagtgctgggatgacaggcgtgagccaccgcacgcggcctgagtcatattttgacacatggatggatggccacattgtgttgatcctctcacctgttttttcttttctttctttctttttttctttctttttgagacggagttttgctctttttgcccaggctggagtgcagtggtgcaatctcggctcactgcaacttctacctcccaggttcaagcaattgtccttcctcagcctcccgagtagctgggattacaggcacctgccactatgcccggctaattttgtatttttagtagagacaggtttcaccatgttggccaggctggtcttgaactcctgacctcgtgatctgcctgcctcggcctcccaaagtgctgggattacaggcgtgagccaccgcacccagcctcaatcccctcacctgttgatggacacctgggttgcttccactctcaggctgttgcgagtgatgccgtgtgaacctgcgtgtacaggttgacgtgcctcttcctctccatccgtgccacctctccccaaagccagctgctctgtgctggagagctggccctgagcctcctcctggctcccaggcagcgcctagcatgtcagaggcactcacttctagctgggagaacagaggggctgaagcggatattggtgggccctcgatgtccacggtgggtttcagagcagcccttgaaacccttgtagctgtaggtgggtgtgtacatattcaaacgggtttttctgatgctggtggatcgcttgcttgagccccggagttcaaaaccagcttgggcaaagcagcaagacctcatctctaaaaaaaattagctgggcatgggtgatgtgtgcctgtggtcccagccactcaggagcctgaggcaggaggattacttgagcccaaggttcgatgctgcagtgagctacgattgcaccactgccctccatccttggcaacagagtgagatcctttctaaaggaaaaaaaaaaaaaagtccgggtgcagtggctcacgcctgtaatcccggcactttggaaggttgaggtgggcggatcacgaggtcaggagatcgagaccattctggctaacatggtgaaaccccacctctactaaaaatacaaaaattagccgggcttggtggcgggtgcctgtaatccccgctacttgggaggctgaggcaggagaatggcgaacctgggaggcggagcttgcagtgagccaagatcgtgccactgcactccagcctgggcgacagagcaagattccgcctcaaaacaaaaaacaaaacaaaacaaaacaaaaaaaaacaggccgggtactgtggttcatgctgtaatcccagctctttgggaggccgaggtgggtggatcccttcagcgtaggagttcaaaaccagcctggccaacatggcgagaccctgtctctactaaaaatacaaaaattagctgggtgtgatggctcatgcctatagtcccaagctactcaggaggctgaggcacaagaatcgcttgaacctgggaggtggagattgcagtgagctgagatcacacccctacactccaccctgggcgacagagtgagactccatctcaaaaaaaaaaaaaaaaaaaaaaatttttttctggaaaagatgagtcagcctttatcaggttcttaggtttatggtgaacaaagaaagaaagcctgcagagaagggccttggccttcactgtgacccccatgctgtttgcatttgaacagccgtcaggccttggatccccaaggggcgaaaggaggaagagctgacattctatgtatgtctctctcctcccttttcctaaggtctctctcctcccttttcctaaggatgctcctgaaccagggcatttctgcctctaggggacacatggtgatgtctgggggacatcggttgttgtcatgactggtggaggccagggccgctgcagtgcctctgcagtgcccagcacggccccacggtccagtgcccagagggggagacccagcccatcccagagtggtcagccctaatgtcagccatgcttaggtcgagaaacctgtattaattacatggaaaccaaccgagtccaatcctgctcgcaccaggcacgggataaactcctgacggggcagacgtggaaaccagggggacccccagctcctgggattcacctcctctctcccttcccactcagtgtgtggattttaatgcgtgcagcctcctgggacctcagtagggcacagcatcatgggataaggagtttcttgggggcctgtggaatccttcaccagggggtctcacccagggtgacttcacacccccccaccccataccgtatgatgtctggggacatttgtggtcgtcacaactacggggtgctcctggcatggagtaggtggaggccagggacgctgctcagcaccctgcagtgcccaggatggctccgccccagagaatggtccaggacctggccccaatgtctgcagtgccgggggagaggaacttgttgccttgggggcatctagatggcaaatcatcaggaggggggggtcctagatggcaaaccaccgggagagggtccttgttgggtgttggtggagtgtgaaggggcagcttctgacaaaatgcctcggcttctccagcccccagatacagctcaggtgatgagctcctccttgcatacctgctgagtcaggtgacccgaggggcaggctgtggagccaggccccaggggttgagcgcatcaggataaaagcgcacaaagggcgggtggagctgagggtcagaggaggtgccctggcaggcgagattggcgctggagccttacccaggaagctcataggaagctcatggatgctggcatgtgcctcttgctgttcaggtgggacagggtctctctgtctcgacactggacagtgggaccgtcctgggcactgcagggtgccgagcagcgttcctggcctccacccactccatgctaggagcttctcccagtggcgacaaccacaaatgtcccagacgtggcccagcgtcccccggggtctgaatcatgtttggttgagaagcagtgacagaggtgacacatgttcactgtcacaaaagctgccgtaagcacgaagtattaggaaaaactcccaagacccccatgtgtgcgtggtgccccgtgatgatgttttgtgcttctgggtgcttcctgcatgcagtgccaaaagccctcgctagaggggcctgagaccctgagggaagggactggggtgccgcttgtgagcgggacagccccctggcatggcccaggtatcatggctctttactctgatgcagattgccccccccccacaagggctgggacacagtgtttggttcatcactggtgcccacagatgcccacttggcatttggtggctaaacagcgtctgcctctggtgtccctgcagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggtgaggcggccgccgagactgacagcaggccagccgatgaggacatgtgggatgagacggaattggggctgtacaaggtgagcctcccctccgcagctgctctggggttggacgttctccctgccattctggtctttgcatacccagggctcacaggaggggcttcccacgcgcctctctagctctggctgggcagaaatggccaaggggtggtttcctgcacgttccttgaggggaacatggtaccctgggattcctttgtggacctctagagcagagtcctgttcggggcctgcaggtgtcttctccgtgaagcttgcagtggctgtgacgtttctgaacttgctgctaccatgtaagatcaggaaatgtcacagaaagatctgggtttccagcttttttatttttttattttttttttggcagggtctcactttgttgcccagcctggggtgcagccgtgtgatcacagctcactgtagcctcgaactcctgggctcaagtgatcctcccacctcagcctcctgagtagctgatgttataggcatgtgccaccacgcccagctaattttattttattttattacttttttaatacatggtctcattctgtcgcccaggctggagtacagtggtgccatctcggctcattgcaacctccaactcctgggttcaagcaattctcgtgcctcagcctcctgagtagctgggattacaggcatgtgccaccacacctggctaatttttgtattttttgtagagacgggatttcgccatgttggccaggctagtcttgaactcctggcctcaagtgatcttcccgccgcagcctcccaaagtgctggaattataggtgtgagccactgcacccagtctgttttattttttagtagacacagcgtcttaccatgttgcccaggctagtcttgaattccggggctcaagcgatccacctgcctcggcctcccaaagtgctggtattccaggcgtgagccacgacgccctgcctggatttccagcttctcttgacaaatgggcagctctggtctctcagggcctcccagcagctgtggctgaagcagagccgcaggggcctttgttaagacagtccatgccccctggccccgcatccccgtcacccctgccggggctggtttctcatggtcagcggttcccagccagggaggagaaacctcgctgtgggcattcgagtttgcgccctggttccagagcatcccagtgtccgagaaccaaggtggtctcccgtcagttttcctcaccccgttgggatgccagacttccctcattcctcacaggtcaatgagtacgtcgatgctcgggacacgaacatgggggcgtggtttgaggcgcaggtggtcagggtgacgcggaaggccccctcccgggacgagccctgcagctccacgtccaggccggcgctggaggaggacgtcatttaccacgtgaaatacgacgagtgagtcatggcaggtgggcgggcctgggtattcaggctctgtgacgcgcatccttggctgcgggtgttcaggccagagcttggcactgtctcgagatggtgatcaggatctggggccccatcctcgaattcctaacagcatacgaggctgcccacttggggactagcctggggacccgaagccggctgccccctcctgtgtctccgcggagggttctgctcgatcagtggctgaaactgccaccccatcagtttttctgttttattccatcttccgggtttgtcatctctccctcatccccacccctaacgtcagtctccagtctttgcacaagtgtttactgggcacttcctacctgccaagttcggggtccacacaccagtggacacagatggtggctgcgtctgtccgtgctgccatcgtgagatttcacagacggtgtggcttaaacacggacattggttgacttgctcactgcaacctctgcctcctggattcaagcgattctcctgcctcagcctcctgagtagctgggactacaggtgcccgccaccacacccagctaatgtttgtatttttattttattttatttttattttattttttcgagacagagtcttactctgtcactcaggctagagtgcaatggcgtggtctcagctcactgcaacctccgcctcccaggttcaagcgattctcctgcctcagcctcccaagtagctgggattacaggtgtgtggccaccacgcctggctaatttttgtattttcagaagagatggggtttcactatgtaggtgaggctggtctcaaacttctgacctcgtgttccgcccgcctcagcctcccagagtgttgggattacaggtgtgagccactgtgcccagcttattttatttttttgagacagtttcactctgtcccccaggctggagtgcaatggtgtgatcttggctcattgcaccctccatctcccgggttcaaacgattctcctgcctcagcctcccaagtggctgggactacaggcgtgcaccactgcgcccagctaatttttgtttttgttttgtttttgagacagagtttcactcttgttgcccaggctggcgtcaatggcgcgatctcggctcaccgcaacctctgcctcccgggttcaagcaattctgcctcagcctcccgagtagctgggattacaggcatgcgccaccacgcctggctaattttgtatttttagtagagatggggtttctccatgttggctggtctccaacttccgacctcagatgatctgcctgcctcagcctcccaaagtgctgggattacaggcatgagccaccgtgcccggccatgcctggctaatttttgtatttttagtagaggcagggtttcaccgtgttggtcaggctggtcttgaactcctgacctcaggtgatcttcccgcttcggcctcccaaagtgctgggattacaggcgtgggccaccttgcccggcctctcctcttgttctaaagacaccagtcctgttggattggggcccaccctactgcagtgtgatctcatcttaatatgatttcatctgcaaaggttctatctacaaagaccctgtttccaaaaacaatcctattcgtgggtactggggatcagcctttgaacatctctttttgcaggggacacgggcaacccataacaattttgtacctggaatgtgccttaatatacctgtgtgttctcaacaccagcatataagcctgttgggaggggcctctgcacactgtcgggaggggccgtcccacctcggctcgtttcccattgagggaaggaggcttggtcttagcacggggtctaaggcccgggctttcctcccagctacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctggggtgagcctcgcgtcctggggcgagcccttcctctctcctttcctcccctcccggggcccccggactggctttgaagccgtccagccagcgctgtgtgtgcgaggcccttagcctccggcctggccttcctgcctcccctctggggtctgttcctgctcactgctgagcatctttctaagaccgaccaccttgtgcccctgagtgcctctgcccagggaactgtctctgacccccaggccctgacaggcagagttgtcaaacttcctttttctcatggtgttttttttatcgctctgttgcccaggctggagtgcagtggttcgatctcggttcactgcaagctctgcctcctgggttcatgccattctcctgcctcagcctcccgagtagctgggactacaggcgtctaccaccacacctggctaatttttttgtatttttagtagagacggggtttcaccgttaaccaggatggtctcgatctcctgacctcgtgatctgcctgcctcggcctcccaaagtgctgggattgcaggcagtgagccaccgtgcctggcctcaagctttctttttctctcttgtttgtttcaaatttggtgaataggtcccattcacagggtcaaaatagaaagcacccaagaccacacatgaaggttctccctcctctgcctggtcacccagttcccctttttggcgacatcactgttaccaactttccagggacattctgttcataaacatacacgccaaaccacaccgcttaggagttggcaaactgcagtccacaggcctgctgtggtccgctgccggctttgactaatagttttattgggacgtggtcacacccatttttatcttattacctgtggttgcttttgtgttataagagcagagttgtgtagttgcaacagagactatgcggcctacaaagctgaaaatccttcctatttggccatttgcagaatcattttgcaaagcctgttctttctcccttgcctctttgtgtgtgtgtgtgcgtgtgtgtgtgtgtgtgtgtgtgtgataaaatgtatgtaacagaaaatttaccttttttttttttttaaaagacagagtctccctctgtcgcccaggctggggtatagtggcatgatcttggctcactgcagcctccgccttccaggttcaggtgattctcctgcctcagcctcccaagtagttgggattacaggcgcccgccaccacgtctggctaatttttgtatatatatatatatttagtagagtctgggtttcaccatgttggccaggctggtctcgaactcctgacctcaagtgattcgcccgcctcagcctcccacagtgctgggattacaggcatgagccactgcgcccggccaaaaatttaccattggaaccatgtttaagcgcacagttcggtggcattaaacgcatttacgttgttacgcaaccatctccagcactttgtcctcttcccaaactgaaactctgactccatgaaacactcactccctagcccctgacacctctgcatcctactttccatctctgtgaatctgacaactcgggggacctcctaggaatgggatcacacaggatttgtcctttgcatctgttcactgacgtcactgagtgtgatgtccttgaggtgcatcaggctgtagcctggtcggaatttccctcctttttgtggccgagtgatagtacgtgacgtgttgtctataaacacgagcatcttggcaacggcgttccaagtacaggtacagcaagcacgcagaggtcctgggctgggacatttatggtgcatctgtggcccggtagggaggtcagtgagctgcgggtgatggaggggagtggctggggctgtgggagcctcctcactgagtctgggccttaagcgcgtggctcgggtgtggtgtggaattggtctttattctctgctaggcgcatttctgaatctgagattttctgagaaactatctggattgttatatggaatctgatttttaaatgctggtgactaactttttttttttgagacagagtcttgctctgtcacccaggctggaatgcagtggcaggatctctgcttactgcaacctccacctcccgggttcaagggatcctcctgcctcaccctcctgagtagctgggactataggtgcccaccaccagctaatttttgtatttttagtggagacagagtttcaccatgctgcccaggctggtcttgaactcctgacctcaggcgatccacccacctcagcccctcaaagtgctgggattacaggcgtgagccaccgcacccagcctatctggttttataaagggcagttcccctgcacacactcccttgcctgccgctgtgtaagatgtgcctgtgctcgttcaccttccaccatgattgtgaggcctccccagccatgcggaactgtgagtccattaaacctctttcctttctaaattacccagtctttattatttagtatgtctttattagcaacatgagaacagactcatacaaccccttccaagctcttgtggtggctgatataatccactactttgcggttgaaggatgggggcttcatttttttttttttaacttggttcttggaggccgcctgcagttcccagggcccacctgcagttccttgccccatgggcttctctgatgtggctactgatgtcaagctagcaagggaggtcttcagctagtcggctagtaagatatagagcatcgtgtgatgtgtcatcgtcccaggagtgacagtccgtcagctctgctgtattttatgggttaggtttaagtgacagccctgtccatacttttatggggagaaacgcctacaaatgcgtggttgccaggaggtgggggttgtggggccaccttaggctccatccgcaccagttatacaccagctgctgcccgtttaccctgagacagataacctgcccagccagcacccacgggcttcctccacctcagtccctcccctagcagaagaaaactgcatttctgcacattgactgtcacaaggcaggggtgtcaccaggcagggaaacgaagatacctggccgaccacaccttggggtgtttgggttcttcgattcattcatgcttgtgtcccgagccctctggggatgcaggaggcacagcgggaaagggaacaggtgctcggtccaggcggccttggggcagacactgtcccttgccagccccatgggagcttccagggatgcagtgagagggtcacgctgagccgagttgtgcctcgcaatgagtttgtgatgtgtgcccatcgttagcaccttcgacttctatcatctgctgagtcaggcatcatacaagatgagacagagaaacgcgattgcagtccctgtcttaggaggcacccagcctggtgtgggagacagatctgcagatgacagaccagggagatgcgtgctctgagacaacacgcgaggatgggtggcagagatggccgagtggactctgggattgggaggctcagataggtggctgagccccaggtcctgctctgggcagtgctaggagctaccagcctttgccagggctgacttctaaatgcaagccctctacactggtgtctctgcagtgtggggggtcaattcattcatcattcattttcattaaattttaccttgcattgtagattcacatgcagttataatgtagagatggctaggcgcagtggctcaggcctgttgtcccagcactttgggaggctgaggtgggaggatcgcttgagcctgggaggttgaggctgcagtgagccgtgatcacaccactgccctccagcctaggcaacagcaagagagtctgcaaaaaaaaaaaaaaagtgaaaagaaaaaaaaacaggctgtgtaccctttattcagtttcccccagtggtaacaacttatattaataaactatactgtgttatcacaactggaatattgacattgatacagtcaaaagtgagtttcctcctcacaaaatccttctcgttaccccttttatagccaaacccacctccccatccccacctggtccctgacccccggcaagcaataatttttttttttgttggagacggagtctcgctctcttttgttctccattcatacaattttgtaatttcaaggattttacaatttcaactttgtaataaggattcccgttatataaatggaatcacacagtatgtaaccttttgggattgattctttttttcccgactctccataattacagattaattgaagttaccgcatatcagtagctcattccttttcatccctgagtagtattctgtggtatagatgggccacttttttttttttttttttttaacgacccattggatatctgagctgcttccaggattttttgctgtttaagatttgtttatttttttgagacacagtcttgctctgtttcccaggctggagtgcggtgatgtgatcttggctcactgcaacctccgcctcctggattcaaacgattctcctgcctcagcctctggagtagctgggattacaggtgcgtatgccagcacacccagcttatttttgtatttttagtagaggtggggtttctccatgttggccaggctgatcttgaactcctgacctcaggtgatccgcccgccttggcctcccaaagtgttaggattataggcgtgagccacttcgcccggccagtttaggatttatttgagtaagttaataagaaacagtggtctgcaattctcttgttttgtatggtctttgttggttggtcaataccagccttataatgtgagctgggaaatgtttattcctttttctgttttctggaagagattgtgtaaaatttacgttaattcttctttaaaggtttgatagaattctttaacgagaccataggctgggtgcagtggccgatgcctgtaatttcagcacttggagaggcggaggtgggcggatcacttgaggttaggagtttgagaacagcctggtcaacatggtgtgaaatccccgtctctactaaaaatacaaaaattagctgggcttggtggtgtgcacctgcagccccagctacttgggaggctgaggcaggagaatcgtttgaacctgggaggtggaggttgcagtgagctatgatcatgccattgcactccagcctggatgacagagcaagattccgtctcggtggggtgggggaggaagggaagctttactgaggccatggagatctggagatgtcttctggaggagcttttatgaattgaatttcttctatgcttatgtgactgtctggactatctgtttcatcatgtttgagctgacatactttctgggttttggggaattagccggtttctctgagcataaagtcatttgtattatttccttattctctgatgcctgaaggatctagtgagatccctgttttattcttggtgttggtaatttatgttttctttttatttttgtcagtctttaccaattttatttttgaggatcttagacctttccctcccttctcatttatttgtacagcaagaataagacagtttttttttgtttgtttgtttgttttgagacaaggtctcactctgtcacccatgctggagtgcagtggcgtgatctcagctcactgcaacccccagatcctggcttcaagcgatcctgacctcaggtgatccactcgtctcggcctctcaaagtgctgggactacaggcatgagccactgcacctggcataagagttttgttttggtcaggtttttttttttttttttttttttttttttttgagataaggtcttgctctgttgcccaggctggagtgcaatggcaagctctcagttcactgtagccccaacctcctgggctcaagcaatcctccaacctcagcctcccacgtagctgggaccataggcgtgcaccaccatgcctgactaatttttttttttgttttttgatgagacaaagtctcgctctgtcacccatggtggagtgcagtggcacgatcttggttccctgcaacctccacctcccgggttcaagcgattctcctgctttagcctcccgagtagctgggattacaggcgtgctccactgcacctggctcatttttttttgtattttcagtagagacagggtttcaccatgttggccaggctggtcttgaactcctgaccttagataatccacccgcctcagcctcccaaagtgctaggattacaggcatgagccactgcacccggccattttttttttttttttttttttaattttcggtagcaatgggggtctggctagattggtctcgaacttttgagttcaagtgatactcctgcctcagcctcccaaaaggtgctgggattataggtatgagccactatacccagtcttagaatatgtttttctttctttttttttgagacggagtcttgctgtttgctgtctcacctaggctagagtgcagtggtgcaatcatagctcactgcagccttgaactcctgggctgaagcaattctcctgccttagcctccttttccttaacacttaatttgttgaggaatcctggtcatttgtcccaggagttccaaatggctctatccagactgtagagatgaccaggagatgtcacttgctgtgtgcgtctgtgctacctgtgagctggtaggtcagtgtgttcccacactgtcccatagccaagagccacctgtgctgtgcttgaaatgtggccaggaggaactggaatgtactgtgagtgtaaaatacacatgggtgccaggcgcagtggctcatgcctgtaatcccagtactttggggggccgaggtgggcggatcacaaggtcaggagatcgagaccatcctggcaaacacggtgaaaccccgtctctactaaaaatacaaaaaattagccaggcgtggtggcgggtgcctatagtgccagctactcaggaggctgaggcaggagagtggcgtgaacccgggaggtggagcttgcagtgagccgagatcgtgccactgcactccagcctgggcgacagagcgagactgtctcaaaaaaaaaaaaaaaaacacatgggctttcagagacctggtacaaaagaagaatgtaaagtagctcattaataactttttcatattcattccatgttgaaataatcttttgtctacactgggttctatggaacatattccaattacttccacctatgtttacctctcaaacgtgcttattaggaaatttagaattacatacacagcgtgtgttcaagtgctgtttccctcggacgttgctgatggggatgtcggattattgatctcgggggatcagtttcactcacaggagttcttgtattttgatgtaggccattggatcaagcgttgcctttatgattttttttttttttttttttttttgagatggagtcttgctctgtcgcccatgctggagtgcagtggcgtgatcatctcagctccacaacctccatttcccaggttcaagcgattctcctgcctcagcctcccgagtagctgggattacaggcacgggccaccatgcccagctaattcttgtattcttagtagagacggggtttcactatgttggccatgctagtctcgaagtcctgaccctcgtgatccacccaccttggcctcccaaagtgctggaattacagatgtgagccacggtgcccaacttgatttatttatatatttttttgatgagatggagtctcactctgtcgcccaggctggagtgcagtggcacgatcttggctcacttcagcgtctgcctcctgggttcaagcaattctcctgcctcagcctcctgggtagctgggattacaggtgcgcgctaccatgcccagctaatttttgcatttttagtagagacagggttttaccatgttggccaggctggtctcgaactcctgacctcagatgatcggcctgcctcggtctcccaaagtgttggaattacaggtctgagctaccatgcccggccaacctttatgagtcttgcttgtcggttcttgtggatttggtgctccttagccaaaggttcaaactcattcttcccagggcatcctgcaatgaaactctggtttctgtgttttgtttttttttttttttttttttttgagactgagtcttgccctgtcgcccaggctggagtgcagtggcgcgatcttggctcactgcaacctctgcctcccgggttcaagtgattcttctgcctcagcctcccgagtagctgggattacatgcgcgcttctccaagctcagctaatttttgtattttcagtggaggcgggggttcaccatgttggccaggctggtctcgaactcctgacctcggcctcccagtgttggtattacaggcgtgagccactgcgccctgttccgtttcatgttgcttctgtgagtgcagctttgattgctagggggcgtagctgagctgttgccccaggcatcccgagaacccgtggtgttcaagtgctgtgagtagatttaggggcctcggcaggccagaatgttccagcgtcctcgttccttgcagggatgattctctgaacgactgtcggatcatcttcgtggacgaagtcttcaagattgagcggccgggtgaagggagccccatggttgacaaccccatgagacgtgagttctgagccagcctttccccatcttccgcggtgggcacggggcgggggctcttgtcccgtctctggcttggccgggccccgccggagctgaccctgccgccccgtgcccagggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtgagtgcggccctgcccgccgcggggagaccagagcgccccctacaaatccccagaggggcactgaggagatacaggagaggggcaggcgcgggggctcacgcctgcaatcccagtgctttgggaggccgaggcgggaggatcacttgagctcaggagttcaagagcagcctgggcaacacaagaccagcctgggggacgtagagactctgtttctttttttgtttgtttttttgagacggagtcttttttcttttctttttcttttcttttttttttgcggcggagtctcgctgtctcccaggctggagtgcagtggcgcgatctcagctcactgcaagctccgcctctcgggttcacgccattctcctgcctcagcctcccgagtagctgggactacaggcgcccgcctccacgcctggctaattttttgtatttttagtagagatggggtttcaccttgttagccaggatgttcttgatcccctgacctcgtgatccgtccgtttcggcctcccaaagtgctgggattataggcgtgagccacctcgcccagccttgagacggagtctaatggcacgatcttggctcactgcaacctctgcctcccgggttcaagcaattctcgtgcctcagcctcccgagtagctgggattacaggtgcctgccaccacatccggctaatttttgtatttttagtagagacggggtttcaccatcttggccaggctggtctcttaactcctgaccttaagtgatctgcctgcctcagccttccaaagtgctgggattacaggtgtgagccaccatgcctggcctggagaccccatttctacaaaaaatgtaagaaaattagctgggcgtggtggtgctcgcctgtggtcccagccacttgggaggccgaggtaagaggatcggatcgctggagcccaggaggtcgagggtgcagtgaactgtgatcgcgccactgtactccagcctgggtgatggaagtgagaccctatttctttagaaaagtaaaaatgaggtcaggtgcagtggctcatgcctgtaatcccaggactttgggaggctaaggtgggtggatcacgaggtcaggaaattgaggccagcctggccaagatggtgaaaccccgtctctactaaaaatacaaaaaagttagccaggcgtggtgccacgcgcctgtaatcccagctactcgggaggctgaggtaggagaatcgcttgaacctgggaggcggaggttgccgtgaactgagatcgcgccactgcactcaagcctggcgacagagtgagactaagtctcaaaaacaaaaaaaaagggggggtggtgaggaaatcttcccatgttgcttgagtgggtgagacctgcggccagccagggaacagagtgcagggggcttcacagcttctgtgagaggaggtttcgtagccactgtgttcctggcgcacataatgacaattgcggatgtggatggggaggttgtgatgtgctaggctcgggtctgaggacctgcctgtggtcattcctccagcacagaagtgggtgttgttgttgccctgccccccctccccacatcgtagagatggggaaactgagtccacggcagtgagaaggcactcatggaatctgcacgtgtatttcccacatcccacattgcgttcactctcactgttgcaagatccgtggaattctccgtggaaggccaacagagaacctgctttcttttttttttgagatagagtcttgctctgtcctccaggctggagtgcagtggtgcaacctcggctcactgcaacctctgcctcctggtttcaagcgattctcctgcctcagcctcccaagtagctgggattacaggtgcccaccaccatgcccggctaatttttgtatttttagtagagatggggtttcaccgtgttggccaggctggtcttgaactcctgacctcaggtgatctgcccgcctcggcctcccaaagtgctgggattacaggcgtgagccactgtgcctggcttagttcgaatgaatttaaatgtaaacagcctcgtgtgccaagcggcctgcaatgtggacagggcaggatggtagtggtgccaggcggggagagccatgtccgtggtgtgtgggcagagggcacatgttggctgagacatctgccaggctaggcgtgggcagtgacaatcccgacctcgcaggtactgccctgagtgccggaatgatgccagcgaggtggtactggcgggagagcggctgagagagagcaagaagaaggcgaagatggcctcggccacatcgtcctcacagcgggactggggcaaggtgaggcgggtccttcccacgtgcccgtggcccctccccgcctgccagggctcacgctgttgttctttgtgtctgtgcctgggacagggcatggcctgtgtgggccgcaccaaggaatgtaccatcgtcccgtccaaccactacggacccatcccggggatccccgtgggcaccatgtggcggttccgagtccaggtacctgcagcgtcccggggctccaggggccacgcgggctcatcctgcttttctgggggcagtttctcctggctttggccagccaggggtcagggtggttaccagtggtgcctcggctagccgaggaggggtgtggaaagcctgcaggtttgggtttactccttattttaccagggacctgcaatgaatccttgggggtgggggctgctgctctgctcagagacacgtaaggtcattcccaaagctcctgtcccagggaaggggtggcatctgctaagagggacctgtctcagcgctggttgtgatctatcattggggcagcccctgcctgtgactgggtgttgacagtgctgggcgctgtcagctgtgggctgtgtgtcacggcagacgagacactttggcactagtgacattggagccagatggttctctggggcggggccatcctgggcactgcagggtgctgagcagcatctctggcccccacccactccatgtcctcccaagtcatgacaaccagaaacgtctgcagacatgagtgtccccttggaggcaggattgcccctgggtgagatgcactgagctgggtggacaagctgggcctcatcatggagttcatggggccaggcgtgcagggctaggagctcctggggcagcgctgtatccctagtgctcagcggccagccggggccccatgctcaggccagggcctctcaaggcattttgtggagtgagtggcaggctgcacctcaaccggcctaatgaaggccggcttttatatcataacctcatttagaactcagtcacccccacttttattttttttgagacggagtcttgctctgttgcccaggctggagtgcagtggtgcggtcttggctcactgcaacctccctctcctgggttcaagcgattctcctgcctcagcctccccaatagctgggatcacagggacatgccaccacgcccagctaatttttgtatttttggtagagatggggtttcaccttgttggccaggctggtcttgaactcctgacctcaagtgatccacccacctcggcccccgaaagtgctgggattacaggtgtgagccaccgtgcctggccgtcaccccccattttctagaggccgaagaggagcatcggagatcagcagtgaggatgccccgtgcacgcttgatggggctggaattcacgccagctggtttttttttttttttttccatggtgcagctcaactccggccgtctctagccgagcagcacacgtagtaggtgactcgcaggcctgaggagtttggtgtaaaagtgaggccgctggctgctcggggtagggaggaggagggcggtggagcttctctgcagcagtcattgcagaggacaccatgtatatcttggtggcatcctcaggtcagcgagtcgggtgtccatcggccccacgtggctggcatacacggccggagcaacgacggagcgtactccctagtcctggcggggggctatgaggatgatgtggtgagtgtgtgtgtgggaggggtgggggagggttgctctagttttttggatggtggtaaaatacatagaacaaaatttcccatcctagccgtttttaaatgcttggttcccggtggcgtgaagtatattcccattgctatgcaaccatcaccaccaccatctccagaactttctcatcttcccaaactgaaacgttgtctccacgaagcactcactccccaccccctcccagtccctggcaccgcccaacctggttcctgcctctgtgactctgacgactctggagacctcctgggagtggaatcgcacggcctgcgtccttgcatgcctggctcctctcactgagcccgacgtccttgctttgtccatgttgtcgcatgtgtccggattccccttttgttcacggctgagtcctattctgccgtgcggagggaccatgctgtgttgatctgtctgtccgtgggcactggggttccttcccctttcgactgctgtgaatagatctgctacgaacacggctgtacaagtatctccagcccccgttttccattcttttgggtgtatatccagaagtggaattcaagactcctgtgataattccatgttgagtgttgttttttttttttcttttttttgagaccgagtctcattctggctggagtgcagtggtgtgatcacagctcactacagccactacctcctgggctctagtgatcctcccatgtcagcctcccaagaagctgggactacaggcaggcactgccacgccaaactaatttttgtatttttttgtggtgatggggtttcgccatgttgcccaggctgatctcgaactcctgggcttaagcgatcctcccgctgcagcctcccaaagtgctgggattacgggtgtgagccaccatgcccagccctctgtttaagtttcttgaggacgcaccacactgtttgtatagtcgctttgccattctgtagtcccaccaacagtttacaaagggctccaatttccccacattctcaccaacgcttgttattttctgtttctttgaaagtagccatcctggggagtttgctttcaatgcagtctctttttttttttttgcctctgcagagggttcacccagccttcttgtctgtttcaggaccatgggaattttttcacatacacgggtagtggtggtcgagatctttccggcaacaagaggaccgcggaacagtcttgtgatcagaaactcaccaacaccaacaggtttgtggaatcagccttcttatttccttgctgatgcatatctgccgagtcttggttctgttttgggcctcatgtccagcaagtgatagtctcattaggagcgtggtagaacatagcgaagcctggcatttggttcctccctctgtctcccaaagtgctgggattacaggcgtgagccactgcgcctggtctggttcctcccgtatgtgtgccacataccgtgagccattcagatggatgaaagcaaacttccctataaaaggccagataatagatatctttttttttttttttttttttttttttttgggcagagtctcgctctgttgcccaggctagagtgcagtggtgcactctctgctcactgcaacctctgcctcctgggctcaagcgattctcatgcctcagcctcctgagtagctgggattacaggtgcttgccacctcgcctggctaatttttgtatttttagtagagatggggttttgccatgttggccaggctggtctcgaactcctgacctcaggtgatcttccctcctcggcctcccaatattggtattacaggcatgagccactgcgcctggctgatagtaggtatcttaatgctgggcctggtggctcacgcctgtaattctcgcgcttcaggaggccgaggctcgaggataccttgagttcaggagttcaagaccagcctgggcaaggtagtgagacaacccatctacaaaaagtaaaaataaaaaaattagctgggtgtgttagcatgtgcctatagtcacagctagtcaggaggctgaggcaggaggatcacttgagcccaggaggttgaggccgcagtgggctgagattgcaccactgcactccagcttgagcaacagactgagatcttgtcaaaaaaaaaaaaaaaaaaacccctccaaaatagattgcttcagctatgcaggtcacacagtctattcagagaacctcttcagctcttgtgtcgtagcacaaaatcagccatagaccatatgtaagtgagtgagcatggctgtgtttcagtgaattttatttgcaaaagtatgtgataggccagaatttgcttggcccctgattacaggatgggggcggacttttccagcataaaaaccatcataaagcccaaaggaaaagacagatttgattatctaaacattataaatatattacataaataaatcctataaattaaaaggcagatgactaggaggagttcttgacatgacacatgatgatagtgtctttatcatataaagagctgttgcaaatcaacaagaaactcatagaagagctgggtgcggtggctcacgcctgtaatcccagcactttgagaggccgaggtaggtggtggatcacctgaggtcaggagttcaagactagcctggccaacatggtgaaaccctgtctctactaaaaatacaaaaattagctgggtgtggtggcaggcacctgtaatcccagctacttgggaggctgaggcagaattgcttgaacccaggaggcggaggatgcagtgagccgaaatcatgccattgcactcttgcactctagcctgggtaacaggagtgagactctatctcaagaaagaaagaaactcgtagaagaaagcaaagaggccaggcgtggtggctcacgcctgtaatcccagcactttgggaggctgaggtgggcggatcacgatgtcaggagatcgaaaccatcctggctaacatggtgaaaccccatctctactaagaatacaaaaaaaaaaaaaaaaaaaaagcctggtatggtgacaagtgcctatagtcccagctactcgggaggctgaggcaggagaatgtcatgaacctgggaggcggagcttgcagtgagccaagattgctccactgcactccagcctgggtgacagagcaaaaaaaaaaaaagagaatatggaaataatgcacaaaagaagtgcaaagttgtaatcaaatacaaactgaggctgtggtgagatactatttgtttcccctataaagttggccaaaaattctaaaatgttgacataggtcaggggtaaaatagcattccactgttggtagaaatacaaattggaaccatctttctggaaatctcttctgcctgtttgtatgaagagctttataaatgatctattcttgtcactctaactccgctttgaaaaatgtctttaggagacctctggctaggtaaaaatgtaagatgtaatgtttttcataccattatctaaaacaattggcacatagacacacacacacacacacacacacacacacactctcacaaagtcagtaactaagtacctaaaaaagacatgggccatgggtggtgtgtcacatgcctgtcgttccagtactttgggaggctgaggtgggaggattgcttgaggctaggagtttgagacctacttgtgcaacataaaattatgaaaaattaaaattacaaaaaagaatttcaaaaaagttagctggttatggtcgtgtgggcctatagtcccagcttgggagccggaggtgggaggatggcttgagcccaggaggctgcagtgagtaaggcgtgatcatgccattgcattccagcctgggtgacagagtgagacaccctttctctttttgtttgttttttttttatatgtgtgtgtgctttgttttgttttttttgaggcagggtctccctctcttgtccagggtggagtgcagcagtgtgatcgtagctcattgtagcctccacctccttgggctccactgatcctcccacctcagcctccagagtagctgggactataggtgcatgttaccacgcctggctatttttttttttttttgtggagatggggttttgccacgttggccaggctggtcttgaactcctgggctcaggcaatcctcctgccttggcctcccagagtactgggattagaggcgtgagccacggcacctagcaaccctgtctcaaataaatagtaggctgggtgtggcctattttataaattatacatatataactttgaaatattaaatttttttttttttttgagacagaacctcactctgtcacccaggctggagtgcagtggcataatctcggctcactgcaacctctgcctcccagactcaagcgattctcctgcctcagcctcctgagtagctggaattacaggcacgcgccaccacgcccggctaacttttgcatttttagcagagacggggtttcaccatgttggccaggctggtctcgaactcctgacttcaggcgatctgcctacttcagcctcccaaagtgctgggattacaggcctgagccaccactcccggctcctgtgtttccttttttggggggtacatcctcacctataatgcgtggggtcctgactctccctgcagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggtgagtgccccttgaggaggccgggggctctgtccccgccggggctgcctctgatggagctgacgctgatgcccgctctctgcaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcaggtgtgtctgggatgggggatggcactttgggaggccaaggcggatggatcacttacgttaggagttcaagaccagcctggccaacatggtgaaacctcatctctactaaaaatacaaaaattagctgggtatggtggcgggtgcctgtaatcccagctactgaggtggctgaggcaggagaattgcttgaacccagaaggtggaggttataatgagctgagattgcgccactgcactgcagcctgggtgacagaatgagagtccatctcaaaacaggagcactgccgggctccatgacggctctgacacttcccgcctgggcaccatgtgtcctgcttggaggctgtcatccttgaaggtcattgtgggtcacagaatgggccctgcctgggcttgtggtgctcatgttctggaccgcgctgaacactccaggaggcctcccgtctcgggcccatgcttccctggtttctctctgatccagaataatttccagggccccagctgatggcacccccctagctgtcccatataaatcctccagccagggggtgatgggaacgcgcagatgacatttgcttctccgcctgccgcatctcagagttgaaaaccagacttgcttgtcttcgttctgttggtaaagggatcgctgcagaccagtcaggcatctggtgtcttctgttttcacttcttggctcatcacaaaaaaaaaaaaaaaaaagcagaaacaaaccaaccaaattggtggattccagagagatctggacggaaaaatggggaagatgaatatccccgagccatctctcacctccctgtggcgatgggaactgccgagaacttactcaacaagcggcgcagcatttcagcaccagttaggatgtggtctgtccattgcagggagaagctttacagcagacgaatcgtgagactatttaaggaatcttaattgctgtcgagagcctgatgtcctctacccgagggggtcactcaggttgtcttttgaatggatttgtacggtggggaatttcagaagctgaggaagtagagagaaaaatagtaatgggagagacagcctcagcttctgttgggagtaggattttttttgtttgtttgttttgagatggagtcttgctctgtcgcccaggctggagtgcagtggtgggatctcggctctctgcaacctctgcctcccaggttcaagccatactcctgcctcagcctcctgagtagctgggattacaggtgcccaccaccacgcctggctcagtttttgtatttttagtagagacggggtttcaccatgttggtcaggctggtcttgaactcctgacctcaggtgatccacccgcctctgcctcccaaagtgctgggattacaggcgtaagccaccgctcccagcctttttttttttttttttttggagacagagtctcactctgtcgcccaggctggagtgcaggcatgatctcggctcattgcaacctccacctcccaggctcaagcgactctctcatctcagcctcctgcatagctgggatcacaggtgtgtaccaccatgcccagctatttttgtatttctagtagagacggggtttcgccatgttggccaggctggtgacctcaggtgatccacctgcttccacctcccaaagtgctgggattacaggtgtgagccgctgaccctggccaggattttttttttttttatgactctcatctccattgtaacataaagaatgtgaaaggagctcaaagatttcctgagacactggagagtcagacgtgacttataggtaccttcgaaatggagcgatgatgccctgtgaggacagagagggcccgagtcctcagaatcaccagagtttggccagctaaggccctggggtcaggtgttcgtaagtgaagtttctggggaaacagtcatgctcattcactgaagtagcctgctctcagcgcttgcagtccagacccataaggcttgaaaacattcaccctagggtccctggaagcaaaagtttgcctgccctcatggaaatcgtaaagacaacgagatcttattggtgggatgtgatgctgaacacgtcacccgcgttcgctcacattaaatgcgcttaccccgaccctgccaggtggagcttggccgattatctcctcttagtctcctcttgttcgtagtgaagctttgcgattagacaggattagccattggtcgaggctccacagttaacgaagagctgaatgcacaggcgtcccccccttaccagggggacacttcgaaggtcctcagcacatgcttgaaaccagagagtaccaaaccgttgatgtataattttttttccatacgtttggactggtgattaagtttaatctataaattaggcacagtatgagattcacaacctctctttcgcatcttaggcttctctttagcatttccaaattgtcagcatccctactcttgcactttggggccattatttttatttttgagaccaggtctcgctctgttgtccaggctggagtgtagtggtgtgatcatagctcactacagcctcaaactcctgggctcaagtgattctcctgcctcaggctcctaagtagctgggactacagatgcacaccaccaggctcggctaattttttaaatttttttgtagagaggggatcttgctatgttgcccaggctggtctcaaactcctgggctcaagcgatccccctgccttggcttcccaaagtgttgggcttatttaataaaaattagaatgtttaatattaatattttatatttagcctgtaatcccagcattttggatgactgaggcaggtggatcacttgaggtcaggagttcaagaccagcctggccaacatggtgaagccccatctctactaaaaatacaaaaattagctgggtgtggtggcgggcacctgtaatcccagctactcgggaggctgaggcaggagaatcgagaagctggacaaagggaaggttcacatccctgtgggacgatgcaatgtttcatcatgcagtgtgcgtgatgtgaggtggctgtaaagggggaggaaggggccccgagccgagggatgcagcgcctctagacgttggacacttagaacagtgtgcagtttacaacttaggaattgtttctagaatatttcatgtaacattttcagttgactttgggtcactgaaacctcagcaaaactagataagggaggactaccctgtgctcttcagggggattgggggtcaggtgtgtctggaaacccagacctggcaaggaggctggaagagcgggctctgcatagcgtgtgggccccaagcctgactcacggctgtccctcttcctcctgaagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggtgagaatctcgtgggtgtggggtgagcgtcttgtgtgtgggggagcaggtgggcatctcgcgggtgtggggttgaggtcgtgtggacgtgggagccggtggctgtctctccggcagctcgggccacgcgcccctccctcacgcgccccaccctcttccaggaggtggcccgagcagggcgggtccccgcgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccggtaggctcgcacggctcactcgtcgccctgatttgcgttgactgcggtaaaatgtgtggggcttgtttcccatgttccccattttcaagtgtacagctcagtcgcactgagtacattcttgtggttgtgcaaccatcaccaccatcaccacctccagaactttatcctctccccagactgaaaccctggccctgaaactgtcactcccaccccctcccaagccttggcactcgctccccagccccggcaactgctccccagcccctgcacccgctccccagctccggcaccccctgccatcctaccttctgtctctgtctcccggggctgttgcaaagtgaccccaagcctaggagtgcaaagcgactcacatctcacagctctggggctgggagcccgacatgggccttgctgggctaaagtcagggcagggatagggctgggccctcctgggggctccaggggagaaccagatttctgcctttcccaaggtctagaggcactgtatccctcggctcggggccccttcctccccctttacagccacagcgcatcttcttccagtctctgagtctcactctcccgccctctctcgggaggacctcggggtgacatcaggccccccgcctcacccaggatgctttcccagctccaggtccttcactcagtcccacctgccatttctcctctgctgtggatggtgacgtctcaggatggtgcaggtctcaggattcagctgtggccgaggccatctcagtggtccctctcttcccatttccttcaggccacattcttcccagggctttctccccagctcccaccctacgctggggcagccccttgcccctagaccttcacttgtgtctctttggtccccgcacttagctccaagcaggaggaggtgtctttcgagtcatccgaggctgggctcctggtggcccgtgtactcagtatgcattgtgtcagtggacaccatgcctctaaatttttttggtgacaggagctcaccctgtcacccaggctggagtgcggtggcatggacaaaggtcactgcctccttgaactcccaactcccaggccacgcctatgtttttaatttattttgtttatttttattatttttttttgagatggagttttgctctcgttgcccgggctggagtgtgcaatggcatgatcttggatcactgcaacctccaccttccaggttcaagtgagtctcctgtctcagcctcccaagtacctgggattacaggcacccaccacgcctggctaatcttgtatttttagtagggatgggatttcaccgtgttggtcaggctggtctcgaactcctgaccttaggtgatctgctcacctcagcctcccaaagtactgggattacaggcgtgagccaccatgcccggcctattttttaattttttgtagagatgggggtctcactgtattgccgggctggtcttgaacacctggctcaagcgatcctcttgtcttggccttccaaagttctgggatgacaggcgtgagctgccgctcccagccaggaacctctcctaaagccctgtcttgactcagtgcagggtgtgcttggtggtgccagctggtcatatctgggtcctgcccagcatcattgaggctggcgcccttgtactggctccgcctcatcctccccaccttgccacttggggtgttggggacttcaggtgaggctcatgcctgttgggcctctgtttttctcagaacggggacgatcatggcccccgcctcctggagtgaaggctggggacagaattagaggacccaggtacatgctcagcaggaagccactgatctgtgggagccctggtcccggtgtctttgccggcctcacacccgcttccctctagttccagttgttcctgagtaaagtggaggagacgttccagtgtatctgctgtcaggagctggtgttccggcccatcacgaccgtgtgccagcacaacgtgtgcaaggtgagtagagatggccgcgggagccgggtggaaggttctggaaggatgacctgacctcccgttcccacatgcctgccactacagacagaggcttgttggctttgctccgctcactctgcagcttttctcggggccctgttgactgctttctgggcagcctgtattaccacggaggcctataacattctcccccaagtcctgtatggtcaaggggccagggtgggagaggatgggccacagtcttggcctaaggtctggagaggaggtgcacatcccctaggggtcaggaaagaaggcttcttggaggaggtggtgttaccaggcagcatcccttgtacctgggacagcaggtgaagaagcctgggtgggaagtcagcagctggggcctgcagtggctctgggcactggggtggtggcctgccatgggctttaaactcaggacaagtggtcagtcgtaggagggacacaagatcccagctgatggtttttttttttttttttttttttttttctgagacagagtctcgctctgttgcccatgctggagtgcagtggcgcagtctccactcactgcaagctctgcctcccgggttcacgccattctcccacctcagcctcccgagtagctgggactacaggcgcccgccaccgtgcccggctaattttttgtatttttagtagagatggggtttcaccgtgttagccaggatggtttcgatctcctgaccttgtcatccacccgccttggcctcccaaagtgctgggattacaggtgtaagccaccgcgcccaccccgcagctgatggttttcaaaccgattggtttggggccaggacagggtctcttcccccctgtgctgtgggccttggggctggatcattgtctggggtggggccgtcctgggcactgcagggtgctgagcagcatccccggcccccacccactccatgccaggagctccctgcctagtcgagacaatcacagacatccccagacaccttccagtgtcccctgggggcagaactgcccaggtgggcagtgtgggtctgggtgatggtttctctgctgcaacctctggccagagccggcagtcccggtggacaggtgtggaagggactgaccctgccaccccacggatctccccaggcttctgagttgctggcggttttccttccaactgcagtcccgcagtcctctcagccatgggccacacccccgggtctcagaccccgtgtttgttttcatgccaggaggcagctcagggaaggtcaggagatggggtgttcccagtcatgcccatggcatctctgcctcctcgggccccacctgcctcgccctgtggcctgagtcccttcagctgtgtgggcctccctgagtgccctgagtgaggtggcagaaggggtgagaggccatggtgtctttggggctggtggtccgggtctggccatctgtcacctctcaggcgtgcaggcactaatccctccaagcctcagttggccacagtgagaaggggcctggtaacactgtcctggatgccaggttgttgtgaaggtcccggcttagcctctggcaggaaggaggtgctcaggaggtgggcacaggcagagggctggctgtggggggctattggaagagggaggcctgggagccccgtggcggtaggaaggactgtggggacattggaaaccatctgtcctgtgcatcggtgtgaaggcgcggaagcgctgaggatgtgaaggaaggggctaaccagcatcacggtgtccccacaatctgtccttgttgctctgttccaacttgggaagctcagcatcggaggggttctgggaaacaggctgtgaccttccaccttgatctttttaaattataaacttgaggccagccgtggtggctaatgcctgtaatcccagcacttggggaggctgaggtgggaggatcacttgaggtcaggagtttgagaccagcccgggcaacatggtgaaaccccatctctactaaaaattaaaacaaaattagctgggtgaggtgacaggtgctactcaggagactgaggtggtagaatcgcttgaacctgggaggtacaggttgcggtgagctgagatcgcgccattgtactccagcctgggcgtcagagcaagattctgtctcaaaaaaaaaaaaaaaaaattgaaaaaaacattcagagacagcatctcactctgtcgcccaggctggagtgcagtggtgccatcatagctcatcgcagccttgaactcctcgcggggctaaagagatcctcctgccttagcctcctgagtagctggggctacaggcatacaccaccatggccaacatgatgaaaccctgtctctactaaaaatacaaaaattagccaggtgtgctggtgggcgcctgtaatcccagctactcaggaggctgagacacgagaatcccttgaacccgggaggtggaggttgcagtgagccaagatcacgccactgcactccagcctgggcgacagagcgagactctatcttaaaaaaaaacaacaaaaacaaaagccacaggctgcctggggcaggtgactgtgctgtggtcaccaggcctctcccccatgtggtcaccgccctcgcccagctgtgtgacgacatgctgcagacatgtgccccctgcgtaggcatctgtgcacctgtgtacggcgtgtcactcctccctggcgtgcagccagcccggtggcatcttccctgtttgtctgcttgggaagtggagactccaggcctctcagctctgtcttctcctggctttcttccccaggcacgacttggttgattgagcttgaagttaggaatctgaatccaccagacttggttccttcctccttttcccctttcttctcattgacgtgtatgtttattttttatttttttcgagacaaggtcttgctttgtcgctcaggctggagtgcaatggcgtgatcatggctcactgcagcctcagcctgcctccctgggttcaggtgatcctcccacttcagcctccggagtagccacgcccggctaatttttttgtttttgttttttctttgagacgcagagtcttgccctgtcacccaggctggagtgcaatggcgtgatctcagctcactgcaacctccgcctcccgggttcaagccattctcttgccttagcctcccaggtagctgggattacaggcatgtgcctggctaatttttgtatttttagtagagacagggtttcaccatgttggccaggctggtcttgaactcctgacctcaagtgatctgcccccctcggcctcccagagtgctgggattacaggcatgagccacgatgcttggcctgatgtgtgtgtttattaagcatctactgtatacactgtgcttggtgttgagagagaacacagcctcaaagctcagggagcatctgccctgttgtagataagataagcacattaataatatataacacggctccacaggtggaaggagaggtgccgtcttgaaggcagatggggtgaggggatgggactgcctctagggaggtgtcagggaaggccccataagggaggtgacttgagctgagctgtgagtgatgagagccgggggaccgagctgttaagctgcatgacctgccagggacaaaagcctggaggccgggtgagcttggaatctttgagggcccctaggggggccaggctggtgatgggcagcaggtggaaagtgagactgaaggtcagaggggcctctggacctggtgagactgtccccacagtcctgggagaggtggccaggagcaaacctgatggtgtggatggcacttctcacgcgcctgctgtgtcttacaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcagggagttggggccacgcagaaatggcctcaaggggactctgctccacgtggggccaggcgtgtgactgacgctgtccgacgaaggcggccacggacggacgccagcacacgaagtcacgtgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggtttttttaaaatttttttttctcttaatgaacacattttctaaatgaattttttttgtagttactgtatatgtaccaagaaagatataacgttagggtttggttgtttttgtttttgtattttttttcttttgaaagggtttgttaatttttctaattttaccaaagtttgcagcctatacctcaataaaacagggatattttaaatcacatacctgcagacaaactggagcaatgttatttttaaagggtttttttcacctccttattcttagattattaatgtattagggaagaatgagacaattttgtgtaggctttttctaaagtccagtactttgtccagattttagattctcagaataaatgtttttcacagataga

SEQ ID NO: 367 - DNA, 324068 bp, Homo sapiens
aggagggggttgggcagtcgctggcgctgccgctggtggtccctgtgcttgaagtgccggtggtatcggagtccatgcacccaaggcccagcacccagcaacattctctggcccagcagaggggtgagagatcaaaggagggggcgtggggcatggattgcttctgggcagacccatgccaatgtgacatggggtttcctgcctgagtgttactgtgtggctgtgcctgccacgctcatctggggtgtgtgtgtgtgtgtgtgtgtgtgtatgtgtgtgtgtgtatgggtgggtgttggggggtgtacagacgctctgggtatgtaggggggtcagcactaggggggcttctaggatttgtctgtggtctcatctccgccctccctgctcctggagggggagctgtaactcagccaggaggccacctagctgattcccctccccccacccaccagccgctcgctctgtcacaacaaggagctttggcagaaagggaggggagcgtgggtgctgcggagagaaaaacaccccaaagtttcagaaaaaatggcaggagagatgccagcacccaggagcaggagccttctgcttctcacagcctgcactgctgggctggggggagaccacggtttcctttccttcctttctcccttccttccctccccgccccttgctgcgtgatattcaggaaaaggaaacattacagtgaggggagaaagggaacaaagagatgcttttcagaggggtcatgggatctttccgtagccaccagaagacacagttctgggctctgcttgctctgggctaagtgggtgtgtatgtgtatgtgtgtgtagaagagaacaaaaaagagagagaatgtgtgtgttagtgtgttagtttatgcatgcctgtgagtaaatgtgtgtctgagtgtggatgtgaattgggcgtgcatgtgtgtgttgggaaacagtaaagataaaagcagacagaacaaaaagaatcatatacaagattggttagacagctgcccttagatagtctacacatgaatacttgaaaaatgtttgtgcaataggttggccattacccaatattgcgcggcattagaataaacatgtatacaatgaaaaacctccagattgacacttcttcctcatgcttttgaaatcagggtatttcatttgggcaatgactccttttctgcagggtaaaaacttcatttactcgcaggtagctggaacaccattaaatattcttaagaagttagttaatattacatgaagcttcacggagaaaatataaatatctatttataatgatatattcactgtgaattgacgtctttattgtagttggaacacgtagcatgagatctacggtcttaacaaaaatttaaatacacaatgcagtaatattaactatattaactataggtgctatggtgaacagaggtctagaacttattcatcttgcataactgaagttttatacctgttgaacagcaactccctatttcccccatccctcagcacttgacaagcaccattctcatttctgtttctatgagtctatttcagataattggtgtaaggagaacagtgcagtttgtgcttctgtgactgtcttatttcacctagtataatgtaccccaaattcatccatgttgtcatatatgacagaattttcttctttttaaggccaaataatattttattgtatgtatatgccatgtttgctgtatttgcttatctattgatgggcattagtttccatatcatgtgtattgtaaataatgcaataatcaggaaaatgcagacatctcttggagatcttgatttcaattgttttggataaaaatacagaagtgggattgttggattatatgacagacatttttccaaagaagacatacacattgccaaaaggtacatgagaagatgcttaacaacactaactgttagagaaatgcaaatcaaaaccatagtgagatgtcatctcgtctattaggatggctactataaagggaaacaaaaggtaagagttggcaaattcattgggaagtaaaatgattcagctgctgtggaaaattgtacgaagcttactcaaaaattatgaatttttttcccccagaatgcttagctctttttgtaacttttattttaagttcaggggtacatgtgcaggtttgttatataggtaaatctaagtcatgggtctttgtggtacagattatttgatcacccaggtattaagcctagtacccattagttatttttcctgatcctctccctctcacactccaccatccagtaatctccagtgttcattttttccctttttgtgtccatgtgttctcatcatttagctcccgcttataagaggacatgtagtgtttgcttttctgttcctgtgttagtttgctaagaattatggtctccggctcctcctgcaaaggacatgatctccttctttttttatgcctgcatagtatttcatggtgtatatgaattaactttcgagtggagaaaagaactggtagatttgtgagattaacaaatatttccatagattcaagttcattttcccagggttttctgagcttaataacctcaaaagtacctgaaatatagtttttcttcctttcacagagctatttatgttatatatgaactacaacttagagtatttaaaactcaataaatagtgaaattaaaaaaaaacaaaaaaacctcatttactcaaagctcagaatacagttttgtgagcatttcaccaaagtaagggctagagtttctcttagcattatttgcttacaaaatatttgagtttgtaaacaagatcccaagggaaatatttatcccactcaagaaaacaagttacttttacctctttgaagtatctatttgcattccaacaatatggtacttataaatcactcctttctagcaacttattaaagcaactcttagaggcaatacttttaaaaaatagcaaggctgtatttttttaaaaaaatttaaaggcctgcaatgacttttaacagcttatctgacttagtgatgtctatttgcttatgattataataacttcttacatttaatgaatgctcttcatgcaccagacactgcattaaatgctttacatacatgctcttatttggtcctcccagccaaggaagtactgttattttacaactaaggggtagagaagtaacttaaccagtgtcaggtaggtaatacatgtcagggcagtacttaaatctgagttttgagtccaaagccccatgccttaccctacatgctcagttgcatttctttatatttctttcttttcttttttcttttttttttttttagtcagagtctcactctgtcatccaggctggagtgcagtggcacgatctcaggtcactgcaacctctgctttctgaattcaagcaattctcaagcctcagcctccgtgtagctgagattacaggtgtgcaccaccatgcccagctaatttttttgtatttttagtagagccccggtttcaccatgttgaccaggctgtctcgaactcctcacctcaagtgatccacccaccttggcctcccaaagtgttgggattacaggcatgagccaccgcgcctggcccatttctttatatttcactgcccaaagatgtccaaacatcagcatgcaggtgcctacaggtgcctacagagggctgtccccacaaaaatcttggctcctggtccagacccactgttagggccagtgcctgggcattatgggtcagtccagctctgagattttaattcctgttgttggaatgaggggaataaatgggcactcaatctcttgggatttttcagctctctctgaggcatcagatttttttcctagggtcatctctgagagaagtatgcctggaacattggcatgaggaaatcaatcaatgcaaagcatataatgaggtatgtattcagcaccatgaggaccaacccagcgagaataagctcagaaggttgtaggaagagtgtaggacttggagaaagagcaatgaccctgcactccgtctagaaggggtgagggagaggggacagggaggaaaaagaaggtgatgggaagaggttgaggaggagcatgtggggtatgtgcaattggatgagtaatggagagcagctttattactttgactttttgaaataagaaccagcttatgaaggtggggagggaacagcctgggaataaattaattgagaaaggaaattaaagccatcatttctgctctgctgacgagcagatgtcagcatgcctctagcctcttgctatattcagtgtttttctagagataaatggtggagctcaaagaggttccaacagggcctgtgttgaacacttgaaggctctagaatattttggtcatgagaaaagagggctgaaagttgaggaccaggcttctaggctctgaggatttttttttttttacgttagctatttcacaattaccagtagatttaactgcaaaactgaagggaaatcaggtaagcatttataaaagaggaaattaagatgctggtattcctaccaagatgactcgagggagaaagaaaagagttggaaacacctttgccaagccattgagaagctagcattgagggcagagagtgcttgaagcaacccagccttaaggcactctcttagaagcagccagggcagagagcagcggggacaggcagttccagcaatagctggctgaggaggatagagagggaggctggctcagcaacctagcctgggaaaacaacccctgtgctgaaatgcattagaagttctctactctgtattccagtactttgggaggccaaggcaggaggatcgcttgagcttatgagttcaagaccagcctgggcaacatagagaaatatagatagaccttctctctactaaaaataaaaaaattagccgggtgtgttggcatgcacttgtagtctcagcttcttgggaaactgaggtggaaggattgcttgagccctggagatggaggctgaagtgagctataattgtgccactgcactccagcctgggcaacagaatgagatcctttctcaaaaaaaaaaaaaagaagttatttgtgaagacttactcccagcaaggggagacaggcagagtgtgcaccagaaaccaggcatcttcaacatggatattttggatcttttctgcatccagacaaaggaacttatttactaacagctggcagatatgggcaaaatcacaatttgatgggttaaccaaggtctgtattacgtgcataggggcatcgcatgaaagaaaagtgagtatctccaaacccagtgagatgttaacatttatatgcccccttcataggggggatgtgaggggagatataggcaacttaggggactgtaaatgattttggggaaagatgaatgggccctcagaagaacaggtgacatcatgagatggtctgggtatgaagtgggcctctagtttcctctcctggttaatcttccctagttgatgagatttctggggacgggactcatgacaatggagttcttcttggagaatctgtccttaggcagatgaagttcagagaaagcctctccctgcatttgctgtttcccaggtgtcctcactttgaggcccaaagcagcatattttggggtggcattttctgaactcctttagagctaatctgtcagaaggcaggtggagcctgggtcagacgaatctgagcatgcccaagttacataaaagttatgtgtcaacaagcacatcctgctccactttttttttcttttttctttttagagacagggtcttgctctgtcacccaggctggagtgcggtggcacgatcatggcgcactgcagcctcaacttcctgcccaccctacttttttagtataacagctgaaagatatggaacgtggaattgatgaagggtgactcattaaaattataatagcaattaggaacaagcagaaaaagaccataggcaaggacagtttcatggccaagatcatatgttttcccacattttatatttggcgagcgcgtaggagggatcaacacatccagattactctccagctacaacttcggtttcaacaaaaccctgaatctgacaccctcggcccaggccctctttctctttcctgagcactaaggctcctgttggtgctcttggcattagtggcttcaaggcgagggtgaatgggtttgtgttagtgactttgtggatgaaaggacacttgaattttccttgcccagcctcggcactgcctcagacattaaaggctatgaaatctgcgctggtgttttggtgagggactggagtagtctcaaaccactttttataccctatgtgagaaggaactgtcaacctaaataacgatcagagaggctctctaaaagaaaaggtctttattttggaatagagcattgtaatgggaatatgaaaatgcatgccatagtaaactgtttgagtgaaggaaggcaaagtctttctttttttttttttttagatggagtctcgctctgtcacccaggctggcgtgcaatggtgtaatctcaggtcactgcaacttctgcctcctatgttcaagtgattttcctgcctcagcctcccgagtagctgggattacaggcatgcgtgaccacgccagataatgttttgtatttttagtatagacggggtttctccatgttggtcaggctggtcttgaactctcaacctcaggtgatccgcctgccgtggcctcccaaagtgttgggattacaggtgtgagccaccgtgcccggccctttttttttttttttttttttttttgatacacggtctggctctgttgcccaggctggagtgcagtgatacgatctcggctcactgcagcctctgcctcccaggctcaagcaatcctcccacctcagcctctcgagtagctgggactataggcgtgtaccaccatgcctggctaatttttatattttatgtagagatggggtttcatcatgttgcccaggctggtttcaaacttctgaactcaagcaatctgcacgcctcgatctcccaaagtgctgggattacagatgtgagccactgtgcccaacctgataaaggcttttaaaggaaaaattaagaagattccataattatttaaaaataattatccttggctttaaagatcaatattaagggtgatgccagtctgagcttggacaggcagttgctgggcagatgtccttgcagaagtatttttttatgaaatgttgtgaaggccttcatgcaaggttgtgggttttacgtcttttgtgattttttttttttttaaatcaggcatacaagcatgaaaaccctctcttcatggcctgccctgattctatttgtcagggttttctttttttctttttctttttttttttgagatggagtctcgctctgttgcccaggctggagagtagtggtgcaatctcagctcactgcagcctctgcctcccaggttcaagcaattctcctgcctcagcctcccaagtagctgggactacaggtgtgtgccaccatgcctggctaattttttgtatttttagtagagacggggtttcactgggttagccaggatggtctcaatctcctgacctcgtgatccgcccacctcagcctcccaaagtgctgggattacaggtgtgacccactgcgcccagccagggttttcttaacattagtgactttattttaatcttgacaactttcacagaacttaattgtagtcccttaatccatagttgcctctgattctgaactgcccagagaaaaaggacgttagttggttggttccctgggtttttttccttccagtcatttattcacaactggtgtcacacactggagatgtaagaacagaaaaaatcgtggtacctgtccttcaagaaccacagtcttgtaggggtgacagggatagaaaccacaatacaggcctgggtgcagtggcttatgcctgtaatcccagcactttgggaggtttaggtgggtggatcacctgaggtcaggagttcgagaccagcctggccaacatggtgaaaccccgtttctactaaaaatacaaaaattagccgggcttgttggtgcgtgcctgtaatcccagctacctgggaggctgaggcaggagaatagcctgaacccggaaggcggaggttgcagtgagctgagatcatgccattgtactccagcctgggtgacaagagtgaaactctgtctcccatcccccacccctaaaaaagaggtcacagagtagaatttggtggaggcaattgttccagggtcccaagtccagtagggcttaatagctatctcctatcctggtcctcaaatgaggaattcttttctctcttcttcccttcctttcttccacaaagatgtagtgagtgctgtgagttaggtctgagttaggtcctgcgaatacataaatgaacaaataccattccatgcttagaggagatcatggactagttatgttcttcccagactccatgctagggtattcactggtccatttcactatcatgatgaaatgagaaaaagcaagagacaatgtagtgagtctttaaataaaattaaatgtattcaatataagatcttttctctttagtttgaagttatattcttatgtacattctttcctcaaaacatgttgatagtagatggtagtcatcactgatttgtttgtttatttccttgctcgccaaaatgaaaattaagcaatcttttgtcacaccacaaaaagtacgtgtgtgtgtattaagtgttgttactggttaaagattcatttcctcatttcaaaagtgggattaaggcggggcacggctgtaatcccaacactttgggaggccgaggcaggtggattacttgaggtcagcagtttgagaccagcctgggcaacacggtgaaatggtgaaaccccatctctactaaaactacaaaaaaattagccgggcgtggtggcacatgcctgtagtcccagctacttgggaggctgaggcaggagaattacttgagcctaggaggcggaagatgcagtgagccgagatggcgccactacacaatagcctgggaaacagagcgagactctgtctcaaacaaaacaaaacaaaaaaacaacaacaaacaaaaccaaagttggactaagagtgaccctttctcatctaataaagtggaccttatacagggaacatggatttaccagacatgacaaatgcaggctctcatgccactccccactctccttagactcagaagggaggaaatgggagagccccaggcctcaagagaggcaggattaactcttttcttgttatccctgcacaagacaccaagagcagcagcctcttgagaccctgtaggaggcagtgcgggaagtcctggacaggaaccagtgcaagtgccagaaacttttgggaacagtggagctacagatcagcttgaagaactctgaccctcagaaggatgaacgcttcttgggcactgtcatctgaagtccactcgccgccccaggttctccacgtgtgtcctgggggaccagcagcacagggttgaggccaagcctgtgggtatctcctacgtggacatcgaggtgctgaagaaactcgacaggaacaagaagctgctcaacaagtatgatgcctttctggcctcagggtctctgatcaagcagatcccacaaatcctgggcccaggcctaaataaggaaggcaggttcccttccctgctgatgtacagtgaagacatggtggccaaagttgatgaggggaagtccacaatcaagttccaggtgaagaaggggctctgtctggcatggctcttggtcgtgtcaagatgacagatgatgagcttgtgtacaacgtccatctggctgtcaacttcctggtatcattgctcaggaagaattggcagaacatctgggctttacacatcaagaacaccataggcaagccccagtgcctgtattaaggcacattctaataaatcttagtgccacaaagagagagacagagagagaaagagagagagagagagagataaacaaagagagagagagagagagagataaacaaagagagattcgggattcagcaatctcctttctagacaagggctgctccccctgacaccacagaggagatggctgatgttccaggagtctacaggcccaagagacctgggttcatcccatctcgttggagaaggacagcaattctacagagggacccagcgggaaaagctggtgaaacacaaataggctgccccagggaggagcctctggctcttttatagggtaactgaatatggtcaccagcttttatcaaaattagccaggtactcagagtttccaacggcccaggcacaaataatccacaaaccaatcacttcaaattatatccctgaaatagtcacacgcatgctctcaacataccattagcacctaaactcaaactatgacacacccacaagtctgcatcaccctgcttataacttaaagcttgtgggtttaaactaatttaggagtcagtctggggaccaaagggggaaagtcttataatgaggtggcgatttgcttagggaggggaatgcaatgcatgcgtgacatccagaggctgggaactaatcgtctcataggagaggtaagtgtgtaagcaggctgggtgcagtggctcacgcctgtaatcccagcactttgggaggcttaaggtcaggagttcgagaccagcctggccaacatggttaaactcctgagatcaggaattcaagaccagcctggccaacatggtaaaacctcatctctgctaaaaatacaaaattagctgcacatggtggcacacacctgtagtccgggctactccagaggctgagacaggagaatggcttgaacccaggaggcagaggctgcagtgagccaagatcgtaccactgcactccaacctggtgacagagcgagaccccgtcctggaaaaaaaaaaaaagaaaggaccatggtgtaggggtagggtggtgagtttagcatgggtagaggtgatgggcatctggtggaagtacctgaaaggtactagaaagggaggttggagcctgattgtgaagggccagaccaggagtaggttctcaggaagcagagctgaagagagggctgccgaccagtgacctagggaagctgggagagtctttcccaaggagctgacccttggggtgcgtttcttttctcatctctgccttaaggctctcttgtctcttttctttcccccgccccacattcctatgcatgccaggcccaaaacatcctcacaggctgctgctctaattacttcatcccattttaattctgctgagttaggagcctgtgaactcaagaggaaattcatgcaaaatacccaacaaattgaatgtgctggtgttttagaacgccaggtctgaccctatctgcccccttcatcctctcttcctgtggccctgctcctgaccaatctcagcttgagaaatcaaaggtagaatgtgctggtgagaagagagggtggcattgattgagaaagatgttgagtttcactgaattgtttgagccattgcttgggatgaggacagggtggaggctttctgatgggaggcttctgtgggaacctttttggaactgatggagtccatctctagagctccaaaataccacgtgtgtttgtgagttgtaatgtttccttgtccctcaagatacttacaagttaggagagatttcttattccagctgtttgtccacggagatgataaatcatttaaaacaaatggatggctgttttctttctttcttattttttttgagtcggagtctcgctctgtcgcccaggctagagttcagtggcgcgatctcagctcactgcaacctccacctcccaggttcaagcaattctctagcctcagcctcccaagtagctgggactacaggcacatgccaccacgtctggctaatttttgtatttttagtagagatcgggtttcaccatgtcggccaggctggtctcgaactcctgacctcaagtgattggcccaccttggctccagaatgtgctgggattacaggcatgagccaccatgcctcgtggatggctattttaaaatcagtgattctcgagtttgagacagtctgggcagcaaggcaaaatcctgtctctattaaaaaatacaaaaattagctgggtgtggtgctgaactcctgtagtcccagcaactcaggaggctgaagtgggaggatggcttgagtccaggagacagaggttgcagtgagctgagattgcatgactacactccagcctgagcaatagagccaaaacctgtctcaaaaacgaaacaaagcaaaaaaataagtgattctcaaatttttcggtctcaggactccattatactctgaaaaatgactgaggtctccaagagcttttgtttatgtggttattgctattgatatttactgtattcaaaatgaaaactgggatccttttgtagttcataagcatgatgattgggttttcatgcttgtgtgtgagatgtgcttccctcaaaccttgttatgatggtggcacattacccatctgatgtgaaaaaaaaaaaaagaaagaaagcctgagaagttgaaagaatatttattaatccatttaaatttaaaataccaaaaataaaccataatgtgttaacataactaacacattttggtgaaaaaagtacattttccccctaaaatagtgataaaattggcatgttttacatttttacaaatctctaataactggcttaatagaaaatacctggattctcttatcttattctcttattacaattaatccatttctttttttcttttcttttctttttttttttgagatagtctttctctgtcacccaggctggaatgcagtggtgtggtgtgatcttagctcactgcaacctctgcctccctggttcaagccattctcttgcctcagcctcccaagtagctgggattacaggtgtgcaccaccacacctgactcatttttgtatttttagtagagacagggtttcaccatgttggccaggctggtctcaaactcctgacctcaagtgattcacccacctcagcctccaaagtactgggattacaggtctgagccaccatatctggcctaatcagtttcaatatgttgttttggttgaactggcctcaagtgatctgcctgcctcgacctcccaaattgctgggattacaggcatgagccaccgtgcctggccaatgctgttatttcctaaatatctctttaatccataacatgaaacaaatctggcctcactgagttagaaaagtgaggaatattttagtcttcagataattgtggatatttttcttggacactacaccaaaagttgacacacagcagttttttcttcttttcttttttactcaccactatattaatgaggaaacatagtagtttcgtaaaggtatgtggaatctaaaatcatgtcaatcaattcctattctattacattaaaatccattggtttatcttgaactttgaagagattttgtaacattgtgtattagtcatttggaaaatataggtccactgagttatacatagcttctaaatgctgatgcatttcattatacaatactttaaaatcacattcattatatcactatcaatctcatcaaagaagtctttaggaattcggaagttttcaagttcatggtgacagatataagtgttccaaaattctaatttttcacttgaaagcttgaattttattattggcaacaaatactgtcagttgtttcccttgaagtaataagcttactttgttcatttttggggaactatctgccaaacactcaaatttgaataatcatagtttgtctctccattatattttcaagtaaaaataattctccttgctgggtgccatggctcacacctgtaaccccaacactttgggaggccgagacagtagaatcacttgagcccaggagttagagaccagcctggaaacagagtgagaccctgtctctacaaaaaatatacaaagttagccaggtgttatggtgtgtgcctgtagtatcaactactcaggaggctaaggtgggaggatcgcttgagaatgggaggtcgagggtgtagtgagccaagatcacaccactggactccagcctgggtgacagagtgagaacctgtctcaaaacaaaaacaaaacaagaaaaacctcaaaaaacaaaacaaaacaaaaacaaccaaacacacacacacacgcacacacacaaaaacagaacaaaacaaaatggtgctccatgaaaaaagaggctaattctgcttgaaactcaaacaattgcagaagtgcttttcctggagactatcactgtacttgggatacagcagaaatgctttatgtgtacttcctatttcgtcagaatatatatatatatttgagacggagtttccctcttgtcgcccaggctggagtgcaatggtgagatcttggctcactgcaacttcctcctcccgggttcaagcgattctcctgcctcagcctcctgagtagctgggattacaggcatgagccaccacacccggctgatattgtatttttagtagaaacagggtttctccatattggtcaggctgttctcgaactcccaacctcaggtgatctgcctgccttggcctctcaaagtgctgggattacaggcatgagacactgcgcccagcagaatattttttaaaaagtacccaaggattgagatttagtagaaattaataatctttaccatttgatgaagaacattcctaagtaaacgtgaaatttttttagtgcatgtgcatggcagtgaagtgtactatgaatactagcacaggttagcacaactgcttcgatttgttttgaggtgcagtctgttttacccaccattgcttttgcaccatcagtgcaaatgtcaacacaatgaaaaaggcaaatcgtatcttacactattatgaaaatagttttagcagggcacactgggtcacgcctgtaaatcccagcactttgggaggccgaggtgggaggatgatgacttgagcctgggagtttaagaacagcctgggcaacatggcaaaacttatctctacaaaaaatacaaaaattagttgggtatggtggtgcacacctgtggttccaggtactcaggagactgaggtaggaggatcacttgagcctggggaggcagaggttgcagtgagccaagatcgcaccactgcactccagtctgggcagcaggagggaaagcctgtcagaaaaaaacaaaaaacaaaaacagaaaaggaaagaaaatagttttaacttcacagacccttgagagggtcttgggggccccctcagggttgcatggagcacactttcagatccactgccctaaatgacgtgtctgagttcctgagagttggtcctaggcctcttttcttctcactctactctctccttaagtgagctcatctactgcctttgaactacctctgagaaaatgacccacacatttgtcatctccagccgtgacctctccctggagctccagactgtgtatccagctgccggctcaattttggcagttgggtgtcccaaaggcaatatgtctaagactttacttctggtcttccatccatttatataagcccaaatccttattgtcaccatgttcctcctcaccccgtatctaatcaatcattaagtcctgtaaatgctgttatttcctcttcctttctctctctttctctctctctcttccttcctcttttgcttccttccttcctttcttttctttctttctttccttttttctttcctcccttccttctctctctttctctctttctttcttttgagacagagtctcactctgtcactcaggcacaatcttggctcactgcaatgtcccgggttcaagggattcttctgtcttagcctcctgagtagctggaattacaggtgtgcaccaccatgcccagctaatttttgtatttttagtagagacggggtttcaccatgttggccaggctggtctcgaactcctgacctcaagtgatctgcccaccccagcctcccaaagtgctaggattacaggcgtgagccactgcacccggccaatgctgttatttccttaatatctctttaatccataacttctgtctctaccaccatcaccactaccaaagcaagataccattacctcttgctgcattaccacaacaggcctccttcaatctgttctcctcattataaccagagcaatcttttcaaaatgcaaatctgattatgccaaaaccttgtttaaacccttcaacaacctcctattgctctcaaaataaaggtccaaatctttaacatggtctgtttccccagtctaggtcagattcttaaagttctcatagaatcatgcccccttctttcataatagtcatcgtcgtttgtatttgtatattcattagtaggattatttgattattatctctctctgatgagactataagttctgtgaaagcagagacaaccacatagtagacattttataaatatttgctgagtcaatgattcaatgaggcctaggacaactcctttgagcatggagtaaccactgagaaataattcttctgccctcggccctcgagttggagaagacctattttcattcttatcgtctcatagcatttcaaagaaaaatgctgctttgtccaggcattccatcatagtgtcttcctaagcatgaggcacatttatcttccttttgacataggcgccctctttgctccccatcactcatcctgccagtggttcttgaagtgggttagcaatactggttcttcaggattataagagaggggactggggctgggcgtggtggctcacgccttaatcctagcactttgggaggatcatgctggagaatcgcttgaacccgggaggcagaggttgcagtgagccaagatcgtgccattgcactccagcctgggtgacagagggagaatctgtctcaaaaaaaaagagagagagagaaagagagaggggactctttctctcctactaggtggttggctaggaggcccatttctgcaatagagaacaaaatgtattaagagagaacaaaggaagaacaaagggaacaagagagaacaaaataaggcctttcctatagaagggaagggaagggaaaccaatgtttatcaagcaactactgtgtgccaggcactttgagacttttgttgtcccctttcatctttttttggagttccagtgggcttttaatctttacaacaaccctatgaggtaggagttatggtcccatttgtatagatgagaaaacaacgggcccagagaggttaagtaacttgcctaaagatacacaatatagtgtattagtcctgtttacctacctaccctaagaccccttctaagggactttgtactggcaaagattttgcagcaggccatattacataccatatgacatcatccctaccccagtagtttatatcactacttacctacccctgcctcttctgccctaggtgattagaccacagggaggttctaaccttagccatgttggtccatgggctagccagtcacctctgacttattgcctggtacagaaagacaactggccaataggattccctcttagtaacctcaacctgaagcagagttccccagcagggagcacagactgggagagatgcagacacacccagtgtggcagaatcacattgagggtgggcagagcctgagaaggaagagccgtgaccttattttcactccttaagagcccctgaggagtctttttttttcattttattttttttgagatggagtcttattctgccaccaggatggagggcagtggccctccacttcccgggtttaagcgattcccctgcctcagcctcccgagtagctgggactacaggcacgtgccaccacacctggctaatttttgtattttagtagggacagggtttcactatgttggccaggctggtcttgatctcctgacctcgtgatccgcccgcctcggccccccaaagtgctgggattacaggcatgagccaccatgcccagccccctgaggagtcttgaatccagattcctcctcagcttcagcacctgcccctggggtttcctgacaggccagaagtggttctgcatgtatttttatactaagcttctgtgcctgagctaactcaaggggtctctttttccataagagtctacctcaaatgggtacagagtgacagggtcaggattgaaacccaagcctgtctgtttccctagcttatcctcctttcactattccacagagggtgagcccttgagcggtgtcaagcgcccactgcctgggaatgagcacagccagctttgcagcaaggcactaatttaaagaagagtgtgaggaatcctcactttctgaacactctgaggtgggccaaagactaacagcgcctggccttgctttgggaagctttcctgagaagtacaagccatgccatctagaaaccttcccactgtgggccacagttcagtgtgtgacatcatgtatgaaatcactaatcatcagtgacattactcgatgatgccacttccataatgaccctaaatcttggtcagctcaggatgggaaaccacagacagcctgggaattaggcagaccaggattccagtcctcttcctgactgtttgtccttgggaaaggcagcactgcttttcctgtctttcctctcagtgtccttgtcggtaaaaactgggagccaggcagggtggcacgcacctgtgtccccagctactcaggaggctgaggcaggaggatcacttgagctcaggagttcaagaccagcctgggtgacatagcaagaccttgtctcaaaaaaaaaaaaaaaaaagaaaggggggatatttcctatctcagaacaaaaatcacaggagataaatatgcaagatcctgcactgaggggagttggtgtttaatgggcacagagtttcagttggagaagatgaagaagttctggagagggattgtggtgatggttgtataacagtatgagtgcacctaatgccacagaactggacactttaaaatggctaaaatggtcgattttaaaggaaataaatacacacatatatatttcctttttgttttgagagggagtctcactctgttgcccaggctggaatgcactagcacgatgttggctcactgcaacctctgcgtcccgggttcaagtgattctcctgcctcagcctcccaagtagctgggattacaggcacccaccaccatgcctggctaatttttttattttagtagagatggggtttcaccatgttggccaggctggtctcgaactcctgactcaggtgatccacccgccttgggctcccgaagtgctgggattacaagtgtgagccactgtgcccggcctatgttacctatattttactacaacgacaacaataaaaagactttaccttgggcccctcatgtagcaggtaccttagaaatgctgatttttcatctttatcccatgtagcagaagccaaggtccagttaatcccggtgcccttaacccaaggcaaccctctggcctctccttcaagactctgagacgtagagcccaccacagccccctgccccagagagctggaagcccatcagagcaatgaagtaaagtctccagacctgggagatcaggacactcctatgaactggcactttcaaggaaagagcccaggacctgggactgctgtggctgagaagagctgggcccaagacttgaccaggtccgtccccaagccccaggacgccaggcccgtggggcagtgtccagggttctgtctgctgagaccctccctcgctggagaaaggagcacttggtgggcttctcatcaggaaagaggagatggttgagctgcatctctactgaaaactccagagttcatctgggagggctcctttttctccagccatcagttttctgactagcaatgctcattgtgtgctgtgtagggctggcctggttcctcttccttatagcagccccctgcctcctccaaagccagtgcctgtgttaatacgataatgccatgacagtggccaggagatggttttacctaactgattaggccctctggagtggcatctggggcacaggcttaattctccctggcaaggaggcagccagggcccagggctggagagcacaaggcactggctgggaaattgcatctgggagagcactgagggggaaaattggaagtatcagaacttcccaggttgctattccacagaggccaaacattgttagcagcagcactaattatgatccaggagagtcaggcctggctgcctagcctgccaaggcagtccttgagagcggccttgggagccagtagggcagaggcagagatgcaggcaggctggggctctcagcaacagggtgaatttgggagaggaaaaactgcagagcctttcagacccatgtggaaggggagctggatagactgagttgctgggtgccttcatgtcctttagaaggcttagaactatgataggaagggtggaaattagatgctttaatgatttctacctgccaggaattaagaatcgtctgtatttgtctccacttcctctcttcccatccctgcttgtcctcagtgctccaaggcaaattctcttgtcaatgtcaccagtgatttccatgttgctaatttcagctgtcatttctgagtccccattttactcatcctggcagtggcatttgacatggatggtttcttcataaaacactctcttcctttggcctccatgacacgcccagttctcctacctccatcatctcctgggctggctcctcacctccccatcactggatgcctcagggctgtccttacgcctctgttcttcttcatccatcctcactccctaactaattccatcttctctggactttaaagccagctatgttgataggtcgtggtcatatccagcggctacttgccatccccatgtgagtctctcttatagtcctctcaaactcagcagtccctcagtcttccccagggcaataaatgcaaatctgttctaccagagccccaatcttggagtcattcctggttcttctcttcctttcatgtccccttatccaatcccttgggaaatgctatcaagttctaccctttaaattatctccagaatctggtcacttatacccagttacaccactatcaccctcatcagaaccacccgctgtcactgtttgcctgagaaattacaatagcctttgaattaggtacaatacaggccatcgtggtggctcatgcctgtaattccagccaagacaggcagatcacttgaggccaggagttcaaaactggcttgggcaacatgacaaaatcccatctctactaaaaaatacaaaaattagtcaggcatgggggcgcgtgcctgtgatcccagctacttgggaggctgaggcatgagactcggttgaacccaggaggcagaggttgcagtgagccgagatcacaccagcctgggtaagagagtgagactctccctcaaaaaaagaattaggggccgagcacagtggctcatgcctgtaatcccagcactttgggaggtcaaggtgggcggatcacaatatcaggagatcgagaccattttctattaaaattgtatatattatttgagctgtacaatgcaatgttttggtatctgtatgcattgtgaaatgattaccacaatcaaactaatgaacatatccatcacctcacgcatttaccttttttagttcatgttcttttttttttttttgagactgagtctcgctctatcacccggctggagggcagtggcacgatcttggctcaccgcaacctccacctcccgggttcaagcaattcccctgcctcagcctccggagtagctgcgattacaggcgcctgccgccacgcccggctaatttttgtatttttagtaaagatggggtttcaccaccctggccaggctggtcttgaactcctgacctcgtgatccgcctgccttggcctcccagagtgctgggattacaggcatagtccaccacgcccggcctgctcacatcctttttgctggcattttgtcacatggctgcgcttagttgcaagggaggttgggaaatgtagtcctttttctgagcagccatgtcgcccgctaaaatgtggaaggaaaggatgaatttgaggggaaaactccttgctctgccatagtctcctaagtggttttcttctttctgctctgccccctacaggttgttctaaacacagcagccagagtaatcccgttaaatcagaacgtgtcacttttctgtgtagaaccttctaaagacctcccccctcactcagaaagaaatctaaaatccttaccatggtctacaaggccctacataatctgagcaccaatttctctctgatttcatatcctacatctttcatccttactcactccactccagcctcactcactccacgccttgcaaaatacccccacctcagagcttttgaagctgctataccctctgcctggaacattctttccccagatagctgaaaatgtgtctccttcacttcctttaggatcctgctcaaatgccacccactcaaagaggcttttcttgggccccattcccaccatccccatcccccttaccatcctttgtttttctctgaggcaattaacatcacctgaaatattatatgtttacttacattatatgtgtttttcccactagaacatatgatctagggtccacatacagcaggtgtgctctacatgcttgtggagtgaatgaacagatgaagacagcagtgcatgggaacaaaggcagcagaaggctgcttcttccttagtcatttcaggaggacccatgtcttgattcctgttgtgggtccaatttggaaacagactccttagtttcttgcttctaggagctcccttgagttcaatttatgaaatattcattagacatctagtgcgtttgttacctagtatggcagatgtagaaggaaaataagctatagagcactattggcccttgggaaacatatggattggttaggagcctagattttgtccttttctttctttgcaagtgtgaccattcaggtgttgtgtaaaaggccagggaaagagtggcttcactctttatggaggcacgataaactggtatggcctgggtaggaaagaggggaggaggccgggcgcagtggctcacgtctgtaatcccagcactttgggaggccaaggtgggtggatcacctgaggttgggagttcgagatcagcctgaccaacatggagaaaccccatctctactaaaaatacaaagttagctgggtgtggtggcgcatgcctgtaatccctgctactcaggaggctgaggtaggagaatcgtttgaaccaaagaggtggaggttgcggtgagctgagaccgtgccattgcactccagcctgggcgagggcaaaactccgtctcaaaaaaaaaaaaaaaaaaaaaaaaaggaaagggggtggggtctgaagagaggctgccccattacaggttatagtgttttttttctccctcttattccctatggaatagggcttcgttccttgctggtctgcttaagaaacagtttgaggccgggcacggtggctcaggcctgtaatcccagcactctgggaggccaaggtgggtgttcacctgaggtcagacatggtgaaaccctgaatctactaaaaatacaaaaattagccaggtgtggtagcaagtgcctgtaataccagctacttgggaggctgaggcaggagaattgcttgaaccagggaggcagaggtctcagtgagccgagattgcgccactgtactgcagcctgggtgacagagcaagactctgtctcaaaaaaagaaagaaagagagagagaagggaaagaaagaaagaaggaaagaaagaaagaaagagaaagaaaaagaaaggaaggaaggaagaaaggaaggagggagggagagacagaaaaaagaagaaagaaagaaagaaaagaaagaaagaaaaaagaaacagtttgaaccagttctcatttgatggaggagggggaaagatagacgggggtgggggttggggttgggggcttgcgggggtgggaaggggcctggccagagggctgcagagggctggtggaagagaaggaaaggagggctaggctttagggggccccagctggagggaaaggtagctgagaaaagctgaggctgagtaggagataaatgacctgaaaagattgctccattatccttccttgctctgggcaaaatgcaaaaggtcatgcttggttattttccccccaactccctcctcacagggccacttagacactgctctgacatttacagccgcagaggatcagaggcctcttctgaggcctggctcgagatttccacattgggaaagttccagtttctttttttctttggatgaggctgcttgctgcatccctcataattcttccttctcttgacattccccttcagtccgagagggagagccaagagcagtggttctcaaacttgaaagtggataagaaccactagaaggcttgttaaaacaagtttgggctgggtgcagtggctcacacctgtaatcccaacactttgggaagctgaggtgggtagatcacttgaacctaggagttcgagaccagcctgggcaacatggcaaaaccccatctctactaaaaataccaaaagattacccacacttggtggcgtgtgcctatggttacagctgctctggaggctgaggtgggaggatcacctgagcccagaaggtcgaggctgcagtgagctgtgttcatgccattgcactttggcctgggcaacagagtgagactgtctcaaaaacaaacaaacaaaaaaacaagtttgcctgatgccacacccagagctgattcagtaggtctggggtaggcctgagagcttacatttctagcaagttcccagctgatgcggatgccaatactgctggtcccaaccacgttgggagaatcactgacctaaagcaacttgtttgggtcaaaagatgtccctcatgatcttcagtccttttctccagctccccaaccaaggggaagtaggcttgagttatcacaagagtcatccaaattcaatgtcaaggacttcttgaccatcaggtttataggacaaggcagtccacaaaatccccctccctctaaatctttgagaatctcttccattctcatacacctgggtgagtgaagatctgttctcccctgccacaaaccccactgcctggacagggaattcccgggacttgagaatggcagcaagtgtggcaggtggaagatgggaggacaacagatgccgagtaagcagagggaacccctcccctcctacatgctatttctttgagattaaaatatttgtttcttcctgggctctggtcaagcccatatctgggaaagcatttatgcttaatgtcctcaacccattagcaacccggcatggggctctactaatcagggtccttaatggcagcaccgtgaagagtgaggctgtaagtgactgcacctgcttcccagcctcagctggagaggaagtgtctagacaagaccagagactaggtaggctcagcggtggcctgagaatgattcatgccggcttaggaggctgatctgacctaatgataacctgtcctcccacctccagtttggtaggggtgcagaggaggctccctggttaccttggctgaagtagcaagaccccccagtcctactcagcctcctcttctctcctcaaattacagaacattggcctcctttagagcatgttcttctcccagcatccagcatttattgagcacctctatgtgcaaaggactccttcccgcaccaactgcttttcatttcaaaatccacaagctcgtacttgagtctgtcaccaaatagggggtgagggcctttgacctggaatctaggggatacctagggatcctctagtgctcagactgtgtgggctgcaccttctgcagccactcttgatgagttgggttctttggctttgatctacagagggagtatttggagagcccttatttaagagtaaccagatattctaaggatcaaggccagtctcgaagtatttgcctcttgcttctcttgacatgatgtgtttggtccttgctgcagactaagtgtccccaactaaatgtgtatgttaaaaccccacccctcaatgtgatgatattaggaggtggggactttcggaggtaattaggattagatgaggtcattggggccctcatgaatgagattagtgccctcattcatgaacggggctaggcatggtggctcatacctgtaataccagcatttcaggagcccagcgcaggaggattgcttgaggccaggcgttggaggctgcagtgagctatttgtgctactacactcagccagggtgacagagcaagacctggtctctaaaaccagagtcctgagagagcttgctgcttcttgcttgcctcctctctctgtgctcagccagctgaggatacaattagaagctggccatctgaaggaagaagaaggccccacccagaagttgattccgatcttggatttccagtctccagaactgtgagaaattaatttctggtcaggtacagtggctcacgcctgtaatcccaacactttgggaggccaaggcaggcagatcacttgaggctaggagttcaagaccagcatggccaacatggtgaaaccctgtctctattaaaaatacaaaaattagctgggcatggtggtgcacacctgtaatcccagctacttgggaggctgaggcaagagaattgcttgaacctggaaggcagaggttgcagtgagccaagatggcgccactgcactccagcttgggccacagagtgagactctctctcaaaaaaaaaaaaaaagaaaaagaaaaagaaaaaaaaatctgttgtttataagccactccatttacagtattttgttatagaagcctgaactgactaaggcagttccactagacaactcaaaccactgcagctctcccagattctggaaaggaaagatatcccactccacccccactcaatgaaacacttgagacaggaggtgagtttctgcttcagaaggacatggagtcatgctttaaaaaggactatagaaaaaacaaacaggctgggtgcagtggctcatgcctgtaaccctaacactttgggaggccaagaaaggccgatcacttgagcccaggagtttcagaccagcctggctaatgtgctgaaaccccgtctctactaaaaatacaaaaattagccaggcgtgggtgtgcgtgcctacaatcccagctattcaggaggctaaggcaggagaattgcttgaacctagaaggtggaggttgcagtgagctgagattacaccactgcactccaggctgggcagcagagcgagactccatttcaaaaaaaagaaaaaacaaacagattgggtgcagtgcctcatactcttgatcccagcactttgggaggccgaggtgggcagattgcttgtgctcaggagtttgagatcagcctgggcaacatggcaaaaacccatctctacaaaaaacacaaaaaaattagccaggtgtggtggtgcacacctgtggtcccagctacttgggaagctgaagcatgaggctcacttgagcccaggaggcggaggttgcaaacaacataagagaaacaacataagagaaaccatcaagtgccagtgactggttcttgttcattctcccctcgtttatgggaacttcagagcctggaagaggtagagcacctctaagggggacaccacacaaagccaccacactaagccaccactgtcatcagagccacagggctggacagtgctgacttttctcctactcggaggggaaagcctatatggacacctgtattccaggccaccaacaagcccgatggttgtccaagagctcagggcctcctctctcctgccttttctattctggttcctcagcctcaggtctgagccatgggaaaccctctccaatctgctgcaacagaacatcacaaactgctcctgttgtggtctgggctgccagttccctagcctgctgttgctactggaagaagactatgacatcagtaatctctccccatgccagtccctttgtaggtggaaggtgcccatttgaaaagaatcacatctaaagcagacaattcaaagcaatagggacaatgaaggaagcaagaagtgccaactgggtgaagccgtgtttcagccaggccccattatgcctacacttttctcaaggcccagcctccccacatggccggttcaggcccatctgcccagctctcttccccttgcctgctcctgggccctgtcaaaatgccagctcttcccttctctgtcccctctgccttccaggctccacctggcccatccccaagatgtccaaacctcccagctggaggctggattagcagcaggcagggtaagcccggctggggctagaacagtaggtctgagctgatgaacctgtgttccagagccaagggtagatgggaacactaagcaattgaaatgtcacctgcttcctgctcccccctccctaccaggacatgatctccctaaaggcagactttggagatggaagacctgtgcttgactcggatctgtccctttctagcagctagctttgtacaagttagaccctctaagtctccacttcctcctttgtaaaatgagggcagtaattggggtaatttgagaaggaatggtaaattggtagctgaggtacagctcttagcttttagttatccttctcatgccctgccctttctgtcaccctgggcactggtcatgcaggagatgctctcttggctgctaggggggttgggatgccccaggaggcagcccgcaccttgccaaggagcagccggagccctgaaacctccaggaaggggtggaaaagcctctatctgtgctgtctttccacagaaccaagggagagggtggccaagaacttaggtgagaagaggcactgtgggtggcggggtggggtgggggctcatttccatagttttgtcccagaagaatgtgctgggtatttttcctgctttgccctggccaggtttgaaggaggaatccctgctggagattgatgtcacaggcttgccttcccctccccagcttcatccttgtgatttaaagaaattatttggacatagaagttaatggaagtaggttgctagtgtgtgggcgaatccatcactgtctcccagcattccaagagtggatctgtctttcagggtgagatatcctagagcgactttccaaggtctgagaaatagagtctaccttgggaggacagggccgggggcattgtggacagggattttagaaagctggggtgactgcacgctacttctagggcctggctggaggactttctttacttatgggggaagggagggagacggtattggcacggatggggatgctgcttctctacctccgtccccagctgtcttctgccccaggaagtggataggaaatagacggacacatccccgcagtccactgctcaggatgaggagggctgattttgcagctgtcagtggcagtgatgaaagaggtggaggtgaggggaggagggggtgctgtttgatggagcagtgctgtcgggggaagaggactagctccccttccttccattcccccattctctcagctcagcacttcctggaggtagcattctgggagggagctgctttgaaagcacaaagaactagtgctggaaggctgaggggtggggaggtgtgaggaggagaagataagtattcaggagggggcagactgcccctcaagccccacacacagccaggccttctccacagcctaagtatgtgatgtgtgtgtgtatgtgtgtgtgtccacgcctacatgtagtgcgagcatggacttgcagctatgaagtgttgacagggagagtgactagggacaatgcagaagctgttctccaccgggcagatggctcctctcaggtacttgctcgggtcttcctctctccactccttcagttctctctccactccttctccttgttttgtctttctcctcctcagtttctcagcatcccctttgctttccccctccctctcttctagctgtcattcagatgcagcaagatggatttaaatcagactgaagatccaatgtggactctatatggcaaataaataaattaattaatttaaaaaaatcagactaacgaataaactgggaaagggcagctgcagatggtccaggagagagaatcctgtaggttatggaatgttagaactaaacaccagaggagtctgcgggtctcttctgcacctgtacacaggaagctggaggtcctttgggaaacatgtctcattggctctgggggcagttgctggggagaagcagcatctcccctcttgtgcttcccatggctggctgatcccccgacaacacactcatagccctgagataattgactgtctcagccctttctttcttaggctcagaggaagagcctggtctttctacacagaccatgacttttctcatgaagctggggacatctgcaggctggatggcctccagagctctaggcatgtgcccagaggccaggctgccaggcccaggtatgacagcctaggcgtcctctcaggtcgactgcgctttagacattctcctccttggtccctgatcccccttgaggaagtccagctctgattcaggctgtggcagtatcggggggcagcctaaagtgaggacccttctggtagggcctgctcctgcagcggctgtctttgggcattgtgattagaatctactttaatcattctttctccccgccccccacactggtttcagccaaaccagacagaagggggcgctcctgagtcatccgagaagaggattctgggctgatgccttagccctggctcagggaacatcggaaattttgtctgttcatccatcaatctgaaggtgactggtgcggtcacctcgttctctttcttcctttgctttctttcttaagagatagcgtcggcctttcttaagagatagggggtggtggctcacgcctgtaatctcagcactttgggaggccaaggcgggtggatcactggaggtcaggatttccagaccagcctggccaacgtggcgaaaccccgtctctactaaaagtacaaaattagccaggcatgatggcaggcacctataatcccagctacttgggatgctgaggctggataatcgcttgaacctggcgggcggagggtgcagtgagctgagatcacgccacttcactccagcctgggcgaaagagtgaaactccatccccccacaccataaaaaaaaaagggatagtgtctcactatgtcatccaagcttgcagtggcacgattatggctcactgcagcctcaaactcctgggctcaagccatcctctcaccttagcctccctaataactaggattacaaatacgcaccattacacctggttaatttttacatttttatttgtagaggtggggtctatgttgcttaagtggtctcgagctcctggtcttgagcaatcctcctgcctcagcctcccaaagtgctgggattacaggcgtaagtcacggcacccagccccactcacctgcagactgacagatggacaatttttttctagcaggaccagacagagacttggaggaaacacttttatgacttgtccagagactccctgggctggaaggaatctggcctctgcctctgggagatcagcaagtggggcaagtctttgtctggggccacggccaaggctggctgggtcctaggctggggacagtgtaacccctgaccatttgccagcccccagtagctcaccctggtctgactgtcttggcagagctgaatgtcccaattttcttcagaactttttcccaggttaatctgtgttgctattgcccatgacctgctcaccaccttcttcatcatgaaaaaaaaaatggctttctctctttctcccagatctcacagtcctctgtgactcttcctggccccatcagatggggatgggctgagcctagagtactgagctggtcggcagggtgcagcacattccttacctggagctgacactgttaggactttcttcccagttgtcttcttcgggcttcctcctccccaccctgtcaccccaaagcctcccacacttgggagtttctccttccagtaacagggcctgcatgagcactggcttagggggatggggtggggggtacgatgcctgtatcaggttacacagccccaaaagaaaaggctggctttttggcttctagcacctccaaattctctctgtccaaaggatgaggagcagtcctgggtgtggtggctggtgtggaggatgggacctctgggctgccaacaaaggcattgccagcagagctgagggcacaggccaagtctggagtctgtggacttgtacttgggacatgcccaagtcatccctatgtctacacccttccatctgaccaagtcatctgttcccccagagcaaacttgccaacccaagaccacatgtggcccaggacagctttgaatgcagcccgatgcaaattcataaattttcttaaaacatgatttttttgcgatttttttttttctcacagctatcagtgttagtgggtttttttgttttttggggcggggtggggatgaagtcttgttctattgctcaggctagagtgcagtggcatgatcttggctcactgcaacctccccgcctcccagttcaagtgatcctcgtctctcaacctcccgagtagctgggattacaggctcgtgccaccatgtcggctaatttttgtatttttgtagagacagggtttcgccatgttggccaggctggccttgaacatctgacctcaggtgatccacctgcctcagcctcccaaaatgttgggattacaggcatgagccactgctcctggcccatgttagtgtattttatgtgtggcccaacacagttcttcttccaatgtagcccagggaaaccaaaagattagacacccctgccctagagcctggctctgtagaaactctcaggacttcaggggtctacctcatcccacagggccacagggttgccttgggggtggtgtggggttgccctacccttttaaaatgccctaagggtcctgacagctacgggtggatacccagcctcagctccagcccagccctactgaggcattaactctggagctctctagggcagtagggggtagggaagaggccttctctgattgaaaatctgaagagaagaaaattgcgtgggcctgtagccttttctttgcgtctctcagctctttcaccaaggacgttttccctgaggtttcctctaaattctcccagctgcagatcacggcacacactgcagacccctgagacacccacctgtgaaaccagtgtgggaatggaccagtgaggtgcacatctgtgggaagggccaaggatgaggaaactgtatctgttcaaagcccatcgcaaatcagcttcttcatccctctcaaaggtcaaaagcatgacagggcccagaggagtgttggtattttcagaggagaaggcagtgaggatttgggagcagtccaccctcctcagccacatctcagatctccttgctgaaataaggcctcagctggaccaacagaagacagggaacttaggcacctggaagaggtgcagaccttatccatcctcctgtgtgtccccccaccccaagcctgataccaggccctctgtataggggcaaaactttttccattctaaacgaacatttactccttttctccaggacactgggcattagctggacatcggcctgttcaggggacctcaggcttgagacagaaatgaggaagcacagagatcaaagcctccttcccagacaggagtgactttgaagttcactggcattgcaattaggaatgacttccgcagagggcagggatggaggaaaaaaaaaaggaaaaaggaatggcttccctgactacagctccagaaacctcgttttcatagcccctactacttagggaactgggagtttgggccagtttggtggtggctccccagtaggtaatctgaaggcctggggtgggggtaaggaggggagtatagggatcactcctattaattgacacttcccatggctaaggtgctgttcaaggcattttacgtgttttgtctcatgaaatctgcaaactactcattgaattaggtctaatcatgatttctatcttacagacaagtaaacagaggcacacgcaatgataataaaaatcagaatagtaataataatgataacattttaacagctttttaaaaaaattttttaattaaaaagagatgaggtctcactatgttgcccaggctgatctcaaactccaggcctcaagcgatcctcccaccttggcctcccaatatgctgggattataggtctgagccaccatgcccagcctttaacagctttttttttcttttttatttaatttattattattttttaaatcaggcaggctcccaagccagagtaggctcagagagactcccaaaccgctttaaaaaaaaaaaaaaattgacacagtgccagtcttggtgcaagcacatgatgtatatggtactattaaatcctaagaattcatcatattatcccgattttcagctaaagaaacaatctgagcaagaagtgacttcaccaaggtcatggagtcttagaaaatgaccaagccaggagccaaacactcttctctccaattccaaccaatcagcagcctgtgctgctgattccttggcaagattgcctcccaaggggaccatggtagagcaagcagtggtgatggaggagggtcccgttggcctttgaaagcaggagaacccttgcccgtgggctgggccaggagctgcagcatctggcatgctgggaaattgtggaggagccctcctttgcccccactccatccccacctgacagggaaggaagctttgatgctgttttctcgcccacaggggactggggtttgtaaaacaaactcacagcctgcaggaaaacagatcctggaacagcccaaacagaaaggcaggggctgcttgctgtggcccaaagcccctgcctccctgctcagtctcagatgtgtgcctccaccttggcattctgtctgggcttcctgtcagtccccgctctctctccatcctcactgtgaatcttgcagggctacagttgccttggtaacatgatgggaagctcttgaggttttctggaaccagagaaggctgtggagggaggactcaggctctgttgggctgcttgtcacaaagggaagaaaccactccagtgctcctgcccctgccagtccttccttgggtctgacctcaacctcttctgttgcatctgcaggagctttgtttgggtggcctatagggctgggcctgagaggagggagctgtcacatactgctctgtccttggagttgactgccactgtcaccagagctaaattcctacttgctaccatgacctggccctgtagccctaattggttttatgaagttcaatgcctgttttttatgagacagataattatgatgcggggaggtcaggtcctcctctgctggacctggcggggtctccagaattgctgattctccaatcggctccaggcagactgatgggatcagggtgagccgagtgcagccaggctgtggaaggagagcgagtctccactttccagtctctgacgggatcagggaggaaaacgtgcaccgcctgccccgtgaagaagcccatgcctgtgaagtgggcacctgtgatgccgtccctcgtgggtatgagggataacaggcagtggggtgggaggggcagctctctcaggctagaggaatccaacatggggctgcctgcggctccgcgaagaaatcctcaatctttgacactacgggcaccccgtgaagatgtttttttcctccatctctccttctagtcttcttcctttcctttctcccacagtctcagttcgaaatatggcctatttcttccctatgtctatgtcagtttccgtaactggtatctctccctgccccccaatccgcccccaccctccccaggtgagagttgacttgctgtgccctggagggcagttctaggagggtggagatggaggggagggcagggcaagctgttctgctgacactggatggctcccctccgatcctcctggtcaggaagaccgcggcaggtagaggcttccatgcttcgctccaggctgggagcagctgtccacaattgtgcctcccagatggggtgagaggttggccccatccctagaacaggccacacagctgtgtgccctgtgtgtttgacccactcatggcagacacagaactgcactttcagactaagccagttgttgggtgtggctgtgggacaggatgacctcaggaagacccttacacattccacagattaccaagttcccagcttcccttgctttctgactcagtggccaattcctcaggagttgccttctctttagagtaaggccaatcttgcaggaaagaagggaggagtgagactggggcccaggtaagaagggcctggggtccctgactgcagaggccagctcctctctatccctcctccatttaattagctaatgtctgtaaagggctgggcaatggaaaagccctatacaaatgttgagcacaatttcatttccaagactagacaagaatatatttgcagacttgagcaaaaggtcactgggcctgcctgggacagagggaggactccctgcaggccccagagggaggatgaccctgaaagactggggcaggagaaggagaggccacagtgggggccggcatgcctgcctccttggtctttaagctgggtctcttggtaccatgcctgccttgcactgtccccgttccttgtgaatcccagggtcctagaagcttacccctctctgcagggaccaccctcagagactttccaccagaagattatgctaatatccacaacagctgatgtttattgagtattcactgcatgccaggctgtgctagaggccagagtgctccggcttggggagacgtggctgcctctctgcagcaggtgaaggagcttttccagtgagggagcccctgcatgctgcagactctgcctgaaatctctccgaaacctttgggagattggtatcacttatcttctctgaccaatgagaacagttcctggttttgtgatctcccaagtccctggtgtggatgttctgtgagcttctgaattctcctctcctttccccactgacaactcacctggccctacactcattatgaaagaatattgaggccaattagccttgacaagcttcatgcccaaggggcagctttcaagtttctggtcctctaagacctgctcaggccacctatgtgtctctgcccactcagaattctaggagcagctcccctctccatctctgggcaggacctggctttgagtaagggctagagtgaaggagactgggagaggggaatagccagctttagcctcacagccccgtagtcaaggggagtcctctgggagggcgagaagaatagcaaagcagggaatggaaggttcaggaagaggcaggcgggacagggaagggaaatggagaatgtgtttccaacatcccctgggtttcctctgtccctgtctccttcccccactgaaagaggaatggagctggctggcctttctgggaggcatagtcctctagcctcccaaccctaccagcctcctctctgtccccaactgctccttctctggcttctctccagagcccagggcctccctgtgtcatcagttcattatcattctgataaaagtcattagtccttgaaaaagcatgattccccagctgaggccagcccccgctaacctggggaggaatacagatggatggagatgtgggggtggggacagacagaggcacaaacacaatgacacttgtttccaggaggtgtgtaaatggacacaaacccactggtgcacacggccacacacctttacacacaggcccagggatgtctcacatggtcaccagagagcccacagggctacatcactggaggcacactcagctgcttccagtcccagagaatcactcgacactgagacccagcacccagcagcctcagcctcctggaaacacagaagctgggctccgcagactctgggggcgggggcagggagtggaatatggaggccaaggttagagatctccgagttccattagccacaagaagcgtgtccggaatctaaaagtgcagggacaagggcgctgcagagccggttcctgacagtgtgtccccatttcccaccccttccaccactgggaagctcctccctgtcagcaaagccatttagggattagagcagctccctcagtaaaagctgcttattcaaaaggtgctttcagttcatttgcattcacttcatggatattataatgcgtggaggagcttcctcctcagtccctctttgctgtccccagattgagtccctggcccatgcaaggtatcagtttgggctgggccaagctttccagtgacctggggatcttgtcagggagtgggaggtgataaacactgaccattaacccctggtcctcagaaggcagctccggggacagctaggaggggtcacaactggagttttcccaagggagaggaaggaggccaaggtctggagaggcctctcaattcccccggggtcataagcctggtctcctagggaaggaggaatctgcccagctgctgtctgcagatggggctgccacaggggagcaggcagagtcagcctcagctttgaagaccttctctttggcagccaccccaccccggctccatgcattcagttcattcaaagagtatttaactaacaccatgatgtgtgaagcttgatgctaagtaactggaatacagtgttgaccaggcaatgtggcccctgccttcacagagcttccactccaggagtgaaaacccacaaaaaatgaagacacaagacaatatggaataatatgaattatacctagtaccataacaaacagggcgctaagatagaaagtaataggtcagggccgggggaccgtcttcagatggggtgatcagtaaatggtggacacataacacacctgcagttgaggcttcagggagccagcttcgcacgactgcactccagccggggcaactctgtctcctaaaaaagaaaaaaaaaaaaaggaagaaagaaaaatttctttctttctgtgtgtgtgtgtgtgtgtgtgtggtttttttttttttttttgagacagagttttgatctgtcactcaggctggaatgcagtggcacaatctcggctcactgcaacctcctcctctgggttttaggagattctcctgcctcagcctcccaagtagctgggattacaggcatatggcaccatgcctcgataatttttgtatttttagtagagacagggtttcaccaggtgatccgcctgcctcggtctcccaaagtgctgggattacaggcatgagccacaatgcctggccaagaatttctttcttgatttgtccttttatcacctcaaaggtgcatcatgggatttcccatcccagctcaggggaaaggcatggctgtgcctcttcatccccagatcagcctatggcgaggctgccgtcttttggacactccagtgaacgtgcccacctgcctgctctggcacatctgacaaggctggaaagaagttgccattttcggggaggggtcagtttcaatgccttcccaccaattggtccggagcatgtccacagttctgtacactggggagcatccagttcaggcttggctgagtcaggcagatccagagctgcccacccctctccccaggccagggctccagagaccctagagccatttccagcttccctgctgctcctctcaccatcaatcaggggctgggatgtcagaatcaggactgggggaagccactcacatcctgaaccaccccccagggacataggaatatgaggcgaggatcctgagctcgaacatttacaggtagcattcaggattgaaaactgatttatagtctgaaggcaggcaggagggagcgggaggaaggtgggagctctgtgtacagtgcagccttgtggggcggcggtaattatatattacgttgaactgtccttgcagcacggtgaagggcagtgggaatgagactctaaatcacgcttccgtgatgctccccatagctcacctccctgtatgtggccccagaggccagggctgacacttctcccttctccccagccccagcaccaccgcctgcccccacccccacacacacagagcccagtggcagggccagcctgactgactgggggagagcaggaagatgggatgtgagcaactctggcagcttccaggggctgctcatcctgcaggcctcattgtttattgcccccgcagccgccagcacttcccactctctaccccgcttcttccactggggcctgtatgtgcgctgtgttgtttgaaaaagacatccctgtccttccttcattcattctcccctgtagcatctctcttctttacaccacagccacacagccaccaccttggttcgagtggggcctcatcacttctcacctggatttctgccaccatctcctaaccagtctccctctagcgtgcccctactcttagtccatcatcctttacctcgttgccatggtaatctccctaaacacacctctgaccataatcttgatctcatttgtctgggaagtggggattgtccctgctgatacaatagctttgtgctcgtgagctattattattattattattattattatatatttttgagacagagtctcgctctgtagcccaggctggagtgcagtggcacgatctcagctcactgcaacctctgccttctgggttcaagcaattcttctgcctcagcctcctgaggcgctgggactacagacgtgcgccacaacacccggctaattgttgtatttttagtagagacggggtttagctatgttggtcaggctggtctcaaacacctgtcctcaagtgatccacctgtctcagcctcccaaagtgctgggattacaggcgtgagccatcatgcttgactgtaagctattattactgtaattagacatctctgagcctcagtttacttgcctgtaagtaaggagtggggagaggtggtcagatgttggttcctgaaaggaaccaacacgttccagcttctttaagaagtctacccgggctcttggcgggctggtgcctgctggctcacctcccgccctgtgctttcagtccaggaggaaccctggtactcatctgtcctgaggggccatttccatgactagaccctgatccttacggtcagtcacctggacttcccaccaatctcctgcccctccatctaggctttgagttcctggttcagagggacatattagtgcttagtggtgatgagaaacgggtcagacaggtcagggcttgaagtctagcccatgacggtgcacaaggttttggagtggcgtactgattgagagcgaggactcagccgccagactgcttgcttgagttcggatcttggctgggctactctttagtttggctaacctctctgtgcagtttccctgtttctaaaatgaggataataattgtacccacctcatagaattgttgtacagattaaatgagtgaacatatgtgattgttcttgctgatacaatagctttgtgcttttgagctattattattgtaattagacttctctgagcctcagtttacttgtctgtaacacatctccataatacctttccttcctgcttcagggttattgtgaagatcaaatgacacattccctttggaaactcttaaaggctttacaaaggtaagattattattatttattatcagatacttgttccttggggttctccgccacattccctttagaaacaaagcagtttccttcacccttctcttgccccagtctcaaggcagaaaaccgtggtgtcttggaaacaggagcagccatggggtctccctccacctaggaaaaggggcgcataaagctgtgcacacagacacatctctgacagagattatttcaaaggaggctgctaattaaaccaagaacagagagcttgtcaacattttacacaattatccccttcactgcagaggtgaacccaggttttgtggagcccaaagcttatacaatttggggggccctctttaagaaaaaaaatacaagatgatgaatatgaaattaagtgcagggtttcgaaggggcctgtgcaaatgaggagcactgccacccaagcttcattagcttcacagaaaatccacctctgccaccaggccaggtatgcatttgacaaggacttgttggttagttgcttatggccaaaacaaaccgttttttaccaaccacaggcaggccaggatctctagagggcaggagcgcacagcctgcacccagactccagaagtcaccctgttaccaggctgtggctcctccactgccttcacctcagtctaattgttcctttttcaagacccaccacctatttatttttgctttcaacacatttgcatgtgatttacatagcattaatattcagtctcatgttgggaactcttcctctgccccggcttaagctagattcctgggacttggttaccaagtgagatgcaactttctctcttctcaaaatgtagagggaaagaaatatacatctaatttgggggagggtgggagaagggacagtgatgacatttgtcttgaagtcagtttctagtctctggccctcctagtctatgtcttcctccatatatccccactgtccctacccacaacccacaacccaattccaccccagttttcctctgattatgaaattggaagctcaccttctcaaggacacacattcctacccaaattctgggcttactggggctcaagggtgcagcctctgaagtgaagaggcacatggcatcgaggtgccagcagacaagagcacacagggattcttcctcaggtccccctctgggagaatcagccccttccagtccccctgcactgtttggaggcccagtttatgtgatcccccgactgacggaaacagatggcaggtgggagtatgtgtgagtgtgagtgagtgtgtgtgtgtgcatgcacgtgagctgtacatacataaaagaaatgtgcacacatgtgtgagacagagaatgcccacgtgcacatgagtacacccccccccccaccgccacaagacaggcagaggaggaggaggtgaggatgtgggaaggaaattctcggtttaaaaaaaccacattgtggttctaaatgtcatcaaaggtgaaacttgcttccttagccctgccctataaagggaggcaaaaagaagtcagcaaggcaagaaaaggtctcagggcagggatggggcagttctagtgtcaacagtgacatcactctcccagacccctccgctgagtggtgagtcaccagagcccactcaataccacagtctttatgcagtcatgagccggctcatgcttccatctccatgtggcctaggcctcacccccatggtcccctgggcctgagctaccccagccctggggctttgctctcttttaagcctctatcagagaaggcaggggtcccttctctgggtaaggcaatcagagacataaatgagagacaagagaaagagagactcttctgtatgtgaggggggtttgggaacagaagttgaaaagttgcaaaaccagtctgaggaagaggcagaaaaaagagaatggaaaagagagagtgagaagagaaagaagaaagagggaactggggttgaagaaaagagccgggtgtggtggcttacgcctataatcccagcactttgggaggccgaggtgggtggatcacgaggtcaggggtttgagaccagcctggccaacatggagaaaccccatctctactaaaaatacaaaaattagctgggggtggtggcgggcacctgtaatcccagctactcaggagactgaagcaggagaattgcttgtacccgggaggcagaggctgcagtgagccaagatcgcgccactgcactccagcctgtgtgacagagtgagactgtcttgggggggaaaagaaagaagaagaagaagaagaaaagaagcagggtgaggtaaagctgacagctgtgaattctcacttctcaggattttaggattgctactccattttcctggccctctgatcttttatgggtcccccaggtctagtgatgtagaaggaagtccaatactgtaaccagcacctctgggagaggactcccagtgtctatggtatcatcaccacctaccctgacacatctcagcttggtcccaccctccttgtcagagataggggttggagggtttagacatcggtgggggaagcagttgtggtggctcacgtctgtaatcccagcactttaggaggccaaggtgggaggattacttgaggccaggaattcaagaccagcctgggcaacatagtgagaccccatctctataaaaaacaaaaaaagaaaagacaagaaattggggctgggagcaaaaagtgagaggcacaaaagggaaggcagtacccactggggcagctctggtttctctctcaggacctcagttttttcccaagaccttggcacctgcccaaccattgttccttctggcctggccctcatgctcagtggcagcctgagcgtcatcccttgtcactgatgggaatcagaacaggggcccctttatctgacagtgagagcgactctgcccagtctccgtgactcgaatttcccaagatgctgcttattcctgatgtaaactgagctgctccaaggaaatcaaagcctatatctgagtcaacaagacagcaccagagtggcaagactaggccctcatgagatcacagatggcttctgttagagacccctgtctggggatttcttctcctactcactgtggttgcctgtctctacaaacaaaagactgctcttcaattccctcttcttgactccccatcaccaacatagtgataacaataatagcaaccatttactgggtgcccaatatatgccagaaaacttggtaagtttctttctctgtctctttcttcctattgagacaaagtctcacttgttggccaggctggagtgcaatggtgagatcatagctcactgcaacctcaaactcccacctcagcctaccgagtagctgggaccaaaggtatttgatacggcacacagctgatttttaaatttttagtggaggcaaggtcttgcaatgttcccacgctggtcttgaactcctagcctcaagtgattctcccacctcagccttccgaagtgttgggattacaggcacgagccacaacacctggctggtaagtttcttatgtacattatttcattgaatgctgcaacaacattatggaataatcaccattgtggagcgtggaggaggaaaccaaggactccagaagttgcctaagatttcacagcttgagatggagctgaaatgtgaacccagatctgtctaaattcaaatcctcggctttccactttgcttatttttatcttccctgcctcaacaatacatcctccttttgggttttgaggtgcaattcaaatcttttatctcccggaagtattcatccactcctccctacctcagctcttgctctcacctgcaccatccttaggaggcccctatgctgtccctcctgctggctcaggttagatatggagttcctcctgtggtccctggggctgaggtggtgaaaaaaatagtggtcaggccctcagttcccactctccagggaggaggaggggaaggtgaatgtggctggcatttcgcactaggaacaaccacacgcagttgttggagaggtttaggggcctgtggtgccttgggttctggttcccatcaggagacaactggccaggctccagagccccacaaatgggagtaaaagaatgtggaaaactaccgggtcctccaggaagcttggagtggggcaaaggtggaacaagagctccgtttccgccaggacctgtgtccctaagaaggctgatgctgttatttacccacagggaagtcacaatttctaatgcttgagacagaggcagccttcatttctaaacctgtgtccctcagggaaggggacctgtttcagaccttggaagcctcccaggcacctcctgatgagcttggtagaaacagtgtgcagctatggctttcaggccgtcccagagccacttcccaccagacaccgtttccaggcccatggccaagggcatgttctggaactacaccggaagactctacagaccagatatccctcagagactctgtcagcaagtgagggagagatctgcaaagagaaagaagagcagggcaaagacaactggatgtgctggcccaggaagaggagcagccacacagggacagagagtggaaacctggagatgaagcaacgcagcagagaacagccaccctcccttccctggggtctgggcactagcgaggcaaggtggcattaggcatgatttagggcaacccatcttttaaatatatgggagttggccaggcacaatggcttacagctgcaatcccagcactttgggaggccgaggcagatggatcacctgaggtcaggagtttgagaccagcctggccaacatagtgaaaccccgtctccaccaaaaatacaaaaattaggtgggcatggtggtgcacgcctgtaatcccagctacttgggaggccgaggcaggagaatcgcttgaacttgggaggcagaggttacagtgagccaagattgcacccttgcactctggcctggaagacagagcaagactccatctcaaaaaaaaaaaaaaaaaaagaaagaaaataggccaggcgaggtggctcaagcctgtaatcccagcaatttgggaggccgaggcaggcagatcacctgaggtcaggagttcgagaccagcctggacaacatggtgaaaccctgtctctactaaaaatacaaaaattagccgggtgtggtggcacatgcctgtaatcccagctactcaggaggctgaggcaggagaataacttgaactcaggaggcagaggttgctgtgagccaagattgcgccattgcactccagcctcggagacagagggtgactccatctcaaaaaaaataaaaataaaaaaattaaaaagtaaataaaataaaataaaaataaataaatataagggagttgaggctcagagggtggacaggaactgccctagatcatgccactcctgagtgagtctcccattcagtgttctgggagcaatgagaagaaggggtgctggctccgctgtcttctgggaagcaaggggacttgaaggggaggggtcacagtttctccacccccaccagactgcacctcccgaaggacctcagaggcttctatctctcatctatgaaatgtgcggggccctcagttccttgttaataaaagtgaggatgagaacacctgctttccttccgtgtagggctcctgtgaggctctgctggaaataatgcatggagaagagctttgtaagtgcagggtgttattaagtttgtgattaggccaggtcagcgagggctgcaggaataatgggaggattaatgcccaggacgtggcaaggaggaggctaaactctgccccatcctcctccctcggtcacctgccctgagaaaaagcatttggtgtttccaaattgactgaaataagaaatgtgtggtggcagcagccttctctcactcagccttcatttgcccaaggcagagagattttaattttcgagccataatgagaaaaagaaactcaggattaaagaatattccagtgaagcagtcaaaatagctgcccagactctgaatcaagccgagaaatataaattaaaaactccatctccctctagcatcagctgggcttgaagatgccaggctgagtggctggcaagggttcttgcaacccaggtcctggggtcagctggcgggcaggccccaccccagggtgctgatgggacagggaaccagagacgcacccacccactcacaggagagatttacctccaccaaggctggctcccccaagctacaagcctcctgagtcaggtcaggccctgaatgttgagctcaggaagtggggggtgactccctggcccccactgtttagtctcctaaggcacagagatgctgctgtctgctcttgtttgctcttctcccaaatgctggctcacatgctgcaaacctctttttgtttccccgaactcaggccagtggtcctgggagtgggaaggagctgcctgagaaggggggcacctgagccttcagcccggattcttctgagcttcagtctgttcccaagggaatgcccttccaaatgcacttgcactcaggatggtgggaatgacaaggagccctgagaaaggtgtgtgagccccagggccaggccataccgttccctgcccacttgaagcctcacatcccatggctccccaaaactgaacatctcttgccccacccagccctactatcttcttgattgcctttgaccatctcctttctccttctccttttctcatctacttatccaagaaatattgactgtgtggcctactgtgtgccaggatctgtgcagggtttagtggctacagaaataaaccaaacccaattcctgttgacaggcagaaaagaaagacaggtggcctgaggattataatatagcacagaacacactgggcagtggagttgggtgggtgaccaaaaactctggagtcagactgatctggttcaagaactgtctccatctcctacttcttacagtaagacctcaggcaaattgtctagccttgataagatgcagtttattcatctgtaaattggggatgataatgctttataggattgctgtgaagatgaaatgacataatcttggtaaactagttggaacagtggccagcatatggcaaacactcgttaaaggccagttggtattattgtaagtgtcttaatgacaacactgacattcattactctgtattgggtgctcactctgagccagccagggtgccatgcctacagcagtgactcaactgtggtccttgtcctgaagagttcacaatctattagaggtgacagatatgtaaacggatgactgaaaaagtgcaatcactgccattatcactcgaaaaaccgtcattttttgagccctgatcatgtgccaagtacaatgcaaagttttaaagatacattacctttaactccttgctaaccctgtgagggatctatcatctccattttacagaggtcccataatcattagtaacttgttcaagatcaggccatttgcagaatgaagtattgactcaaaggagagcaattagctagacctgaaaagggatcagatctgagaaggcttcaaagaagaggtgatcctgtttttttacagacagggtcttgctctgtcacccaggctggagtgcaatggcaagatcatggctcactgcagcctcagactcctgggctcaagtgattctcccaagtagccgagactataggcatgtgccactgtgcctgactaatatttaaatttttgtagagagagtgtctcactttgttgcccaggctggtctggaactcctgggctcaagcaattctcccgcttctgcctcccgaagtgctgggattacaggcaggaaccaccacatctggccaaaccggtgatctttgatcaggattttgaagaatgagtagttttccagaagccaagactggggaggaatggcatagcaccacacttctgtgggcctgcgggagcactggagcttcaagcagcatccacaggagttcccaggcctagaggtccttatgtccctaacagccattcggtcgtgtgcctcaacaccacattatagcctaaatcaaaggagggtgattattttagacagattctagtcaacagcttgaacccggaggatttcagctgaatcatggagctgaaataactgcatggagttgaagtccctcatcccccctgtccaggtgcccagcaagtcagggggtgtgggttgggctccctaggaagctgggaggccacagactgggctggagtcagggagacagtctcagtgaccttgggaacactccaccagatttggggcagaaaaaaatgaaatctgttcctgcatttcagtcctttcgcttccgctttctgcctgttcactcccctcatttcctgcccacagtcacaggggaggcggccatcttggcgcagtggcaggtctggaggctggagccaggatgtggcgctggaatccatctatctggctggttccacacccagggaaacctggactcatcatcattagcattctgtttccttgccccgagcaaggaggcgcagggcaacagcatagagggggcacgcctagagcaaagcagccctcagagctcagagcccgagtctcagggccacccatcctcagccagcgcagggaggcacttccgcgaggcgcttccggcgtagtgcagggttggaggaagaccttgggggtaactctaggaccataacgtggtgaggctttggtgcttgcgacggacagattgcagatggctctccaaacacctgtccgtataatgtggttttgcaggaaaggggatggataaggtccctccctgaggcggacctaccctccacccgctccttgaagcagctccagcagcctcacaggcctaattcattcctcacgttaagaagcagccctgggagagaagagcccctacagagcaggaagcacgtgcatattccaataaagcactcaaagaggtaattatttctgggctgcctatcccagcccagagaaccagcagccaaatttccagagctgctgtcgttgcctctggctgttggcaaaattaaacttcttgagaaatcagaatgagctggcccccagcgtgaggggttggaattattcccctgacctgggccctctgtgtggagctgggtgtgggtggggacagggggagattatggaggaagggagtgggttgtaggcttccatgagatagcacatgcctgttctgtgtacacattgaaacacacatggaggccaggcatggtgtaattgcagcactttggtaggctggggtgggaggattgctttagctcaggagttcaagaccagcctgggcaacatagcaagatctcatctctacaaataatttaaaaattagccaggcatggtgacgcatgcttatggtcccagccacttgggaggctgaggtggggggaatcgctggagcctgggtggttgaggcggtagtgagccgtgatcatgccactgcactccagcctggtgacagagggaaaccctgtctcaaaacaaagaaaaagaaaaaagaaacgtgtggagtgggtactaagtctgcctgtcacacactgggatgttatgcacagtaatggcagggcccactgccactcctccagcacccaggacagcgcctggcacatagtagatgctcagtagatactgattactgagtgaatgtgctagatctcatgataaatgcggtgagactcttccctagcctttcatccagcacgggttccatgcaggtaccttgagaaacacatcaataccctacctcctcatccttcccatggaatgatgctatgggactcttagtaaatgccccacaaagtgagagatgggctccttgagacatgtaggggtggcagtgccctgattgggcaccccacaaaagggaggcaccatctgatgcctcaaaccacaacttcctcttccacccacgtcagaaatatttgcctgccttgcttccaccctcttctcaggcaaataccactcacccctcctatctccagctgccatctccatcctcatgatgtgtctctcttactgtaccaggcacctcttgtgcaccacaaccagctccacgctggcttcaacctgttcatgcgtgatctggcagtgccacacccgcaggcccctgaatttacgcccctgctctttgccccagggcttctctgttggcaggaaactgcctggctttcctgcttgggcagcccagtggtgcagggcagttaattccttgggggaaactcttggcaagggggggcaggaaccactggataaatgcttctctctttcttgccctgggtggacagttgcgaattcttcatgaagcttttcagaatgctccctggttgcttgaagctgtgaccaactcaaaaactcttctcctttgggctctcttctgtcgtcacctgctccctggatcacagcctttgatcagggtcaactttcaggggaggttggcttaaatctccctgacttccctctgccctctctgcctcatccaccccggtttccttttagttcttcagctctttcccacaccaggccttgccaacaagctttccatattccctggagtgcctttctctctgcttgggaaatctctcagctgagacttgcatgaccggaaggaagcagtcacaagaacatcggggagaaaaagagttccaggcagagggaacagccaaggcaagagcactgaggtaggagtgaagttggcatgctcagggcagagcaggagggcctttgtggcttcagcagagtgagagaaagaggggcatagagtgcagttggagagaccatgtgcagttttgtgggccacagtaggccgtctggattgtattgtattgtattgtattgtattgtattgtattgtattgtattgtattttttgagacggagtctcgctctgtcacctaggctggagtgcagtggtgtgatctcagctcactgcagcctccccgccccccagttcaagagattcttgtccctcagcctcccgagtagctgggattacagttgcccgccaccacgcccagctaatttttgtacttttgtagagacggggtttcgccctgttggccaggctggtctggaactcctgacctcaggtgatctgcctacctcagcctcccaaagtgcagggattacaggtgtgagccactgcacccggccgtaagtctgcattttaaatacatcaggtaataagctccatgaaggcggggattctgcttgtctgattcactgctggtgccctgtatgtagcaggcacttagtgaatgtttgtgaaatgaatggatgaacagcttacctttatctgtatccatgtcctagccacccctcccccacacaaggtgacagagtagtcttcaacgatcacagctttcaggagggagagaagcaggttgtaggaggaggctggttgtgttttctcctaagagaatcctttgggagtgagagccgcgctggctctgggtgctgactcctctcctctcctgttttctcccactttcaattctgatcccgttgctcaattctctgctcccgctaggctctgctcctgacaccattagtcacctccctctgttctcagcttccttaatgagcatctgtcttgccttcagtctgaaacaggcctgcccctgcctgctgcttcctgggaaaaccaaggtctggggcgggagtgcaaggctcagagaaggctcccaatctttctccctgctcctcaccatgctctgagcaagaggtagtgggtgggggcagaaaaaaggattacctctgggcaaaggaagaggtaagtggaagactgctgaagttcaggggaaggttataaaagagccctggcttccctgctacgaagagtccatggaggacagagttgcacacttttcattaacaagacaaggaatcggctgagatggcagcagaaggaacagaagcaaagcagggtccaaagaacccatccttgggggcagctgaggccacagggcctctcctcagctgaaggcctttcttgggttggccagtctcagccctactactattctccatgtgtggaggcagggaggtgacagaataacctcttaagggctctgccaaacaccagagaacacttgattgagattccttgactgttgttctctctgaggcagccctgggcaagcaaggggctcagcaaggggccaaggtgatagggggcttccatgctgctgtgctatagtaagaggttgttccaccaggggcctgcagaaaaaaggtggctccttcagagggtaagctgaggagaggctaatgaaaagactagtgacaggcgactggggctgcaggaaactacgagggccgggaggcacccagggcctggctgcagaagaaagcccttagcacctggaggctggaaggggtaagaggaggcatggtgggttttttggttcgttcgtttgtttgtttgttttaagacagagtctcactctgtcacccaggctggagtgcagtggtgcgatctcggctcactacaacctccgcctcctgggttcaagtgagtcttccgcctcagcctcccgagtagctgggactacaggtgtgcatcaccacacctggctagtttttgtatttttagtgcagatggggttttaccatgttggccaggctggtctcgaactcctgacctcaagtgatctgcccgccttggcctcccaaaatgctgggattacaagtgtgagccactgtgcctgggcgtggtattggcagaacttggtgacagctgtggctgggggagagctgttgccctgtgggagctgtggccttctacagaggaaggcagctgctgccaacacccaggcccagcagtggggctgagggtgtggaatgagtgccctgacctctttctcatcccatcagctagtctcctgccagtggcttccattggccaaacccaacaggaagctgagggcaagaagccagggcagtaagtccacagaggtcagcttcctgtggctctgagcagggcagggaagaatggagagtgaatctagaaccttcttgtctcctcctcctgatgtcacattcttgtaagcccactcctccctggttcctgaagagcctacaagtccctttgcaacctgtgctcagaactcattccacctctcagactgagctgggccaggtctggacaaggctcagggaggctccaaccacaaggagaagatttcggttgccctgagtctacctctgcccccgctgtacagcatcaggatcccagatggtcccattttcctcgtgccaggctttaggaacaggcaggcttggtaattacactttcctaacaaacccccgcccccgtttgactctctttcaattgcatgaagcaggaggtttctccctacttctcccctgcgtgagcactggcctctgcctctgatcttctgaaattccatgtggtgtgaggggcctggggaagccgggggaacgcctgaccctcttggcatcctggagattgagaatgggcttactgtccatgcttgccatatcccaggaaaagccaagtccctccctcctcccactttggaactattaaattattcagtttcatgggttcacttctcaacactggcctggggttcccacctagaacctttttttttttcttgagatggagtctcgctctgttgcgcagtctggagtacaacggcgtgatctcagctcactgcagccacttagaaccttaacagccccttcttccacaccagctcacatctcaccctaacagtcctgaaggcccctaagggaggaatttgaagtagactctgggctctgaggcctagggatccagtcacaagggtacacctatcagttcaggtaactgctccatcctcccgctctccccagcctgcagcaccaactgggccctaggttttcccagtgcacacgtcctgtaatggagagccactgttttggcctgctcagtatccatttgccttggcatcagctttggagatttggcttggggcaactgtttcagctgctgtaatcttggtggactgtcaatgaaggctacctccattccctggctaagggattggcatgtgacccaagctaggccaatcagatgctctctcctccttgaatccttttttttttttaaatagagatggggctgggcgtggtggctcatgcctgtaatcccagcactttgggaggccaagacaggaagatcacctgaggttaggagtttgagaccagtctggccaacatggtgaaaccacatatctactaaaaatacaaaaattagccaggcgtggtggcaagcgcctgtaatcccagctactagggaggatgaggcaggagaattacttgagcctgggaggcagaggctgcggtgagcagagactgcactccagccttggcaacaaagtgagactctggttaaaaataaataaataaataaataaattaattaattaagtaagtaaaatagagatggactttcgttctgttgcccaggctgatctcaaattcctgggctcaagggaccctctcacctcagcctcccaaagtgctggcattacagacataaaccactgtgcctggccacctccttgaatctgaaatggaatgacatgaaaatgggacccagtgtagtggctcacacctgtcatctcagcactttgggaggactaggcaggaggattgcttgaggccaagagttcaagaccagcctgggcaacatagcaagacctgtctctatgaaagaaagaaagaaagaaagagagagagagagagagagagagagagaggaaggaaggaaggagagaaagaaagaaagaaaagaaagaaagagaaagaaagaaaggagaaagagaaggaaggaaggaaagaaagaaagagaaagaaagaaggaaggaaggaaggaaagaaagaaagaaggaaggatggaattaatgtatccccaaggcggcaccataaagggattgttccatagcccttgatttcaatgtcctgcttcctcctatttctgggacagcctctttagcattttctttgattctgtgagccaccctcatttctttctaatacgatcattttttgcttaagttagctagagtttttctgttgctggaaaccaaagcctcctcacccatacaaatttcaccttcttagaggagcagagggatatgcccctgtggtgggctcatatttggagtctctggcaggggttcaaatctcacctggtcctggaatgagaggaaagagagccctgctgctagtgggtgctgtcacacctcgcctcaggccagtctttgtggccagttttgccaggatccactcccagcctaacctccaggtctcaacactgagcccacagcctgaaatagctaagtttacccccatgactccctatcacaagtgctacaaatggctcaggctggtgtcatggttattttccacaaatagccatctcattcctgtgctgtgcccttgctcgtggtgttctgggacaccttatctcagggtaagctgggccccccgtgccctctgccccggcccctcccgtgccttcagaccttaggccacatcctgcctcttctgaaccaacacttcactgggttccctctgatgtgggatgggcagagcaagtgatttgtgtggttgagctctgtttcctttgtagactttagtctttgaggacttgactacaagctccaagtgccttgttacttttcttgcttggacctcagtgtcaagcaggaggctgggcacacagtgaatgatcatgttgatttctccacccatagtttgaaaattgttcccaccctgtgattcatattcttcattcattcatttacacatttatcaagcacctactaagtgtgggttctgccctaagtgctggaggtacacactgaataaaacatagccgaggaattcagtctcatggtgaagatttattgagaattaattgtagcagaatgacctattgaggaaataaccatgtctagtttttctcagctgcaggctcacctaaaaagaatgaaaggcatttcatccctggggcgaggggcaggagagaaccaggcttcatgtccttgaagtgtggactttcttgacccccatgaggattggtgtagttcagagtagaaaagagaagctgcaagcagcaggatacccagaagacaacttccaaacagacgttttaaacaaagattaggattggaggcttaatgcttcccagattaaagtgggatggtctcaactcaggagggttagttggaactctcaagatcagaaagggaatgaaggtatgaattccatcgatggcagaaacctgcactcatgaggatgcatcctctgagatgggaggacctaggaggaagaatatttgggtgaccacatgtgtgataataataatagacagcatttagtgcatacttactgtgcgccaggaggcactgtgttaagcatgttgtacgtattcacttatttctcacaagaaccctgtgaagtaggtactatcattgtttccatttgacagataaggcaaagaaagattaagtgaacttcctaaggttatggatccaagaatcaaacccaggcgatcagatttcactgagggccatgtatgcctatgagggctgagcacaaagggctatagttttgggagcctttgttctcaaaggacaccatgactgaacttgtcacagaggaggtggggctgcagcccccacctgcagatgtgcttcacaaccaggccgggcatacatattagctgtggcaactggccacagccgatggccagtactgaaggacatggtaatcttggtaagaaggggcttgtatcagttaaccatagtcccagtaatgagtgcggtagaacaatcacaaaatttcagcagcatacaacagtgtttatttagtgcatgtgtttggggaccagctggggttcattgctataggccagctttggctggcatgggttggcaccactctatgtgtccctcatcctcctttcatgaccagcaggccagccaggggacattcatggagatggcagaagtaccccagcaacagtcccagtgtgcacgcccattttaaacctctgctcatgtcacatctgctaaaatactgctgctcatggcaagtcacatggctgagccgaggcaaggtatggagaaatccaccctgctcacagttactgggtaaagaatgtggatagataaccctattacccaggagggggtgaagagatggaagcaaaatctagcattccacaaaacttaaactggatttaattttgatttcaagagagaatgaaatgctacgttatgttgtggagcagttcatgcttgttataaaatctatcttcggggaccacaaattttaccatgagaatatttaaattttagtttttattttagtgaaaatcttaaaataacttttagcaagaacatattttgggtggtctagaacagcggtccccaacttttttggcatcagggactggtttcgtggaagacaatttttccacagacggagggaggttttaggatgaaactgtactcaggcattagattctcataaggagcgcacaacctagacccctcgcctgtgcagttcacgatagggttcgcgctcctatgagactctaaggccggttggagcgtggctcacgcctgtaatcccagcactttgggaggccgaggtgggtggatcacaaggtcaggagttcaagaccagtctgaccaacatggtgaaaccccctctctgctaaaaatacaaaaaattagctggttgtggtggcgggtgcctataatcccagctacttgggaggctgaggcaggagagttgcttgaacctgggaggtggaggttgcagtgagccgagattgcatgccactgcaccccagcctggtcagcagagcaaaactccatctcaaaaaaaaaaaaaaaaaaaaaaaaaaggagaaagaagaatcgaatgccactgtgacctgacaggaggcagagctcaggctgtaatgcttacttgcccaccactcacctcctgctgtgcagcccagttcctaacaggccagggactggtaccggtccgcagcctagtggttagagacccctggcctagaagactatggtagtttggtagttgccttacagttttcagagccccagtgatctgctacagtgccagcatttaacttttttttttttttttttttttttggagacagggtctcccaggctggagtgcagtggtatgatcatagctcactgcagcctctaactcctgggctcaaatgattctcccacctcagcctcctgagtagctgggactataggtgcatcaccatgcccctctattttcttttaaaaaaatttttttttttttttttttttttttttagagacagtgtctctctgtgtttcacaggctggtctcgaactcctgggctcaagcaatcctccctcatcagcctcccaaagtgctgggattacaggtgtaagccaccatgcccagcctagcatttaacttttcagtgcagctttctcaaaccaagacctgtattctcagggagccatgcatttccaaggttggaaaactttggtgagaatgatacacagcagacaatatatagaaaaggcccagagacagaggcatttaaaggtgagggggcctaggacagctatggggtctctgggcagggtttatggtgctctgcagagaagcactggtagcatttgaataggtcttgaaggatggcagagtggggtcctggggatctccaggttccttcttctctgagtggacatatcagatacttgtctctagggcttctggaccacagccttgtccttcacctcacatctatgctactggctatagcatttgaaggagaggctgaggagtataatggctgaactttctggctttggagccaagtcaaccagggttcaaatcttgacttcaggacggacgtgatgtctcacccctgtaatcccagcactttgggaggctgaggcaagctgatctcttgagctcaggagttttgagaccagcctggccaacatggtgaaaccccatctctacaaaaaatacaaaaaattagctgggcacggtggtgtgtgcctgtggtacttgggaggctgaggtgggaggatcacttgagccttggaagtggaggttgcagtgagccaagatgatgccactgtactccagcctaggtgacagagccagaccctgtcaaaaaaaaaaaaaaaaatcttggctttgacatttactagctctgagcccttaggcaggttgcttgatttcttggagcccgtttcctcatctgaagatgggaattataacactctcctggggtgttttaagaattagaacttggccaggcacagtggctcacgcctgtaatcccggcactttgggaggccaaggcgggcagatcacttgagctcaggagttcgagaccagcctgggcaacatggcgaaaccccatctcttcaaaaaatacaaatattagtcaggcatggtggggcgtgcctgtagtcccagctacttggaaggctgagcctgggaggtggacgttgtcatgagccacgatcgcgccgctgcactccagcctgggtgacagagggagaccctatctcaaaaaaaaaaaaaaaaaaaagattagaacttgccagtgaagcctgagattttcttcctggagcatgtttgacttctgatttcatttccttaatggttataggattatcctgattcctgtgtcaaggtgagtcagttttgctaagttatgtattcaaccaatttgtctatttcgaatatacccttcagttttattggcacaaaattattcacaatatcctcttattttatttttaatgcctgtaacatccatagcaatacctttcttttcattcctgactttgaatatttttgccttctttcaactttttcttcatcattatcaccagggatttatcaattttcacacaattggcttgtggctagcttagctgatcctctctgctgcatgttagttttctgtttcttcaatttctgttctccactttgtcatttccttccctctactttgagtttatttgctgtgtctttttttctaatttattaagataaattcttagctcattaattttcaatcttttttcttttctaagacgtgcatttaaggttatacgtttccttttggaggcttaaatgaaaaacaaaaatacatttaaatgcctgctcccaaataggcactcagtaaatatcttatcttcaccatcaacatcattatgccgcatcatatgagatgggaccccagcacagtttgcagctctcttgctctctgatgcgatatgtattcactgagtgttcgccaggggactctctgaggactcattctgggcctcaggtaacttctctttttgggtcttcgggaggcttcctccacagggtaaggcagggcacagacaggagcatgtgcttttggccccatcatccttggggaccttaggccttgttctcttgggatggttggcaagtccatgggaagtatgaattctaacctgcaagcctttggcaaattaaattttctaaaaatgttcacaataatatctcccatcctacatgctcttctagaactttgttcttcccccatcaagagatagggtttaattctcctccccttgagtctggtgggcttatgtctcctttgtaactaataaattgcagcagaagtaatgctgagaggctgggtgctgtggctcattcctgtaatcccagcactttgggaggccgaggccagcagatcacctgagttcaggagttcaagaccagcctgggcaacatggcaaaaccccaactctactaaaaatacacaaattagctgggtgtggtggcacgcgcctgtaatcccagctactcaggaggctgaggcaggagaattgcttgaacccgggagggagaggttgcagcgagccgagatcaccactgcactccagcctaggcaacagagcaagactctgtctcaaaaaaaaaaaaaaaaaagtaatgctgagaaacttctgaggcttggagcaaaaaaggtgatgcagcttcctctttggtagctgaaaaactcatgattagatactgaattgccacatgggaagtctgactattctacagccgccatattgtgaggaagccaaaccatccagagaggccacatgtaggcactctggcctgcagtcctaatcttccagtcaacccagcccaggaaccagacatgttagtgactgaaccttcagtgattccagccccagttgttgagagacccacatcctttgaatcttgccagctgaggccccagatgttatagaacagagacaacccaccctccactgtaccctgtctaaattcttgacccagggaatcatgagcacaaaaaaatgattgttctaagctctcagctatcaaatattttgctacacagcaataaataattggaatgatgctaattgtattgtttggtaccctactcctccaccagaatccttcaacccccatcacatttcatagtctctggacttcgcacttagagacccaaacaaagtttgaagatgcaaagcacagtaaagatcttttgcaggagaactgtgggagcaaagatggcaatggaaatttctctgatcctatcgactttctggactgaatgctcctaagacccttgttcccaacatttccaagtgctaagacctcctttgtctcatcaaaaagcctgggtgtccctcatatgatattggctgtactttcagtacagccaatagatagctattatttattgggaccttacacaagtaccaggcactgtgctaagtattttacatatattatcctcataagaaacctgtggttgtttttattcccattttgcagatgtgaagtgaggtagtcagattaccctggcagtctgttctgcatatcaaatgcaaagctcacagagtctgtaggatggtatcctgatatgacactgcatagtgatgatgatggtgatatttattgagggcctattacaggcgcataccaccactcctggctaattgttgtatttttagcagagacggggtttcgccatgttggccaggctggtctcgaactcctgacctcaagtgatccccctgcctcagcctcccaaagtgctgggattataggcatgagccaccacgcctggctgccattttcttttcgcattttgatggcacctctagcaatggccacattgcttgctcttgggttcccactttcaagcagttcatttcctatacagcagcctccatggctcaggaattgattatgattaccaccatttcctattttgctcttccagccttagggctgagagtgaattcctttaaatactcctctttggataacctcatctccttctttttgctcctctacttcttccaacatgtttgttaccaattcttcaaattaaattccatctacttgaaatacctagaggaatttctgattttttttttttttttttttttttttttttgagacagggtctcactctgacacccaggctggagtgcagtggcacaatctcagctcactgcaacctcctccacctcctgggctcaagtgattctcccacctcagcctcctaagtagctgcgaccacaggggtatgccaccatgcccagctaatttttgtattttttgtagagttggagtttcgccatgtttcccaggctggtctcgaactcctgggctcaagctatctgcctgcctcagcttcccaaagtgctgggattacaggcatgagccactgcacctggccttctgattttttctaactgtctattggctaatttacttggcattacagaacttagcataatctgccattcaactctctaacctccatctccaattcattctccctttgcacctgttgttcctaatatgtacttagaatgcttgtcccccaacactttgtaaagctggctccttcccatgtctcagtctcaggtcttggtgtaaatgacagctttgcagaacaaacttccccgttatctagtgtaaacctactctgtacctaggtactcttatcacactactctttttttttttttttgagacggagtttttctcttgttgcccaggctggagtgcaattgcatgatctcgactcaccgcaacctctgtctcctaggttcaagcgagtctcctgcctcagcctcctgagtagctgggattacaggcatgtgccaccacacctggctaattttgtatttttagcagagatggggtttctccatgttggtcaggctggtctcgaactcccaacctcaggtgatctgcctgcctaggcctcccaaagtgctaggataacagacgtgagccaccatgcctggcccacactactcttttattgtcttcacaacacttactacttaccttatctagctcatttattccttaacttgcttactgtctgcttccaaggctaacagaaactccgaaacaacaggaagcatgtctgtattgcttattactgtattcagtgtctggcacagagttgatgcttaatacatatttttgagtaaatgaatgatggaatgagtcatataagctctccaccttccaggcctgagatgggtcctggcacctactgagatttttgacattggaggctcccatgggaggattcctctgcctcccctgaggcaggaccaccaaggtccgtggccagcagcagggtcctgagctccacttgtgccttcaggcaggcccctcctgggcagtgggaggcctccttgtggctctgactcttctcctggtacatcctagtcagactatttatttccatgcttccagcaggctgcagggcattaatgattaaaagtgcaagcctgcccagagccagtatcaattagaccacacgcccaccatgctggaagctcattaactccaacaagctaggacccactctcacaaaatttttcccatctgtgtactggatttgatagctacaaagaaaaccatcaagactgtgataaaattaattttactgatcatcacatttttatcacataataacaagcagaaagtttgttacataaatatttaactcaaatcattcctgtaataataagcagaatagaaaaaacacaatgaaattcatactgtaatgaatgaaactgtaaagagccattatatttttattctatgacattgtgaacaaaataaattatgcggttttatgcttttttttttttttgagacaaggtctcactctgtcacccaggatggagtgcagtggtgtgatcatagctcactgcagcctccgactcctgagctcaagggattgtcctacctcagcctcccaagtagctaggactacaggtgcatgccaccatgcagactaatttaaaaaaatttttacttgaagagatgagtctcagtatgtcacccaggctagggatcttattctacacaaaacaaacaaaaattaattttgctgttacagaagagagaagccagcagggtaaagactgaggcgtccctttgcaagcatgggcgctgcaccaaccaggttatttggtccatctgcctgcctttaggaagaccccttttgggttttaacatctcctagcttggaagcatcctctggataacaggctggctgaagcaggcagaggaaacaaacaaaccgtagaaacctttttaagaacattagaagcataattcccaacaggactttgagacgaggcattgagagagaaaagctgatgttgggctaacatctgggtttgatcaagccaggaagggcagaagagtccagcaaaaaaagcctgcccactctcaactcactagcaattacaggcacttccctagttcagaaaccccttgctggggagctagattgctggggtgggatattctgtaacctcttagaggtccgcaggctgactcatatggagtctcatccttccattatttcttctaccagcctggacaacatggtgaaaccctgtctctaccaaaaacacaaaaattaggcaaatgcggtggcatgtgcctgtagttgcagctacttgggaggctgaggtgggaggatctctggagcccaggaagtcgaggctacagtgtgccatgatcattccactgcactccagcctgggtgacagagcaagaccctgtctcaaaataaataaaaataaaatttaaaaaatatatttcctcctaattcccctacttcaggctaactaaaccatccacctttcctatctaagcattctacttttcctcttctatgcctttctcttgctgttcctttgctagaatgccctgccttcttctataaccatcaagatcctctaattctaggtcataactcaaaagccgtttcctccaagaagtcttctgtgatctccccaactggaaagtcttgctctacctttgtattcctaatgccctagatcataagactctgacctcttccttccttcctttttttttttttaaattatactttaagttttacggtacatgtgcacaacgtgcaggtttgttacatatgtatgcatgtgccatgttggtgtgctgcacccattaactcgtcattaagcattaggtatatctcctaatgctatccctccccactccccccaccccacaacagtccccggtgtatgatgttccccttcctgtgtccatgtgttctcattgttcaattcccacctgtgagttagaacatgcagtatttgtttttttgtccttgcgatagtttgctgagaaagatggtttccagcttcatccatgtccctacaaaggacatgaactcatccttttttatggctgcatagtattccatggtgtatatgtgccacactttcttattccagtctatcattgttggacatttgggttggttccaagtctttgctattgtgaatagtgccgcaataaacatacatgtgcatgtgtctttatagcagcatgatttataatcctttgggtatatacccagtaatgggatggctgggtcaaatggtatttctagttctagatccctgaggaatcgccacaccgacttccacaatggttgaactagtttacagtcccaccaacagtgtaaaagtattcctatttctccacatcctctccagcatttgttgtttcctgactttttaatgatcgccattctaactggtgtgagatggtatctcattgtggttttgatttgtatttctctgatggcctgtgatcatgagcattttttcatgtgttttttggctgcataaatgtcttcttctgagaagtgtctgttcatatccttcgcccacttgttgatggggttgtttgtttttttcttgtaaatttgtttgagttcattgtagattctggatattagccctttgtcagatgagtaggttgcaaaaattttctcccattctgtaggttgcctgttcactctgatggtggtttcttttgctgtgcagaagctttttagtttaattagatcccatttgtcaattttggctttcgttgccattgcttttggtgttttagacatgaagtccttgcccatgcctatgtcctgaatggtattgcctaggttttcttctatggtttttatggttttaggtctaacatttaagtctttaatccatcttgaattaatttttgtataaggtgtaaggaagggatccagtttcagctttctacatatggctagccagttttcccagcaccatttattaaatagggaatcctgtccccatttcttgtttttgtcaggtttgtcaaagttcagatagttgtagatatgcggcattatttctgaggtctctgttctgttccattggtctatatctctgttttggtaccagtaccatgctgttttggttactgtagccttgtagtatagtttgaagtcaggtagcatgatgcctccagctttgttctttcgccttaggattgactagggaatgcaggctcttttttggttccatatgaactttaaagtagttttttccaattctgtgaagaaagtcattggtagcttgatggggatggcattgaatctataaattaccttgggcagcatggccattttcacgatattgattcttcctacccatgagcatggaatgctcttccatttgtttgtatcctcttttatttcattgagcagtcgtttgtagttctccttgaagaggtccttcacatcccttgtaagttggattcctaggtattttattctctttgaagcaattgtgaatgggaattcactcatgatttggctctccgtttgtctgttattggtgtataagaatgcttgtgatttttgcacattgattttgtatcctgagactttgctgaagttgcatatcagcttaaggagattttgggctgagacgatggggttttctagatatacaatcatgtcatctgcaaacagggacaatttgacttcctcttttctaattgaatgccctttatttccttctcctgcctgattgccccggccagaacttccaacagtatgttgaataggagtggtgagagagggcatccctgtcttgtgccagttttcaaagggaatgcttccagtttttgtccattcagtgtgatattggctgtgggtttgtcataaatagctcttattattttgagatacatcccatcaatacctaatttattgagagtttttagcatgaagcgttgttgaattttgtcaaaggccttttctgcatctattgagataatcatgtggtttttgtcttcggttctgtttatatgctggattacatttattgattttcgtatgttgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgccaggctttggtatcaggatgatgctggcctcataaaatgagttaggggggattccctctttttctattgattggaatagtttcagaaggaatggtaccagttcctccttgtacctctgttagaattcggctgtgaatccatctggtcctggacttttttctggttggtaagctattaattttgcctcaatttcagagcctgttattggtctattcagagattcaacttcttcctggtttagtcttcggagggtgtatgtgtcgaggaatttatccatttcttctagattttctagtttatttgcatagaggtgtttataatattctctgatggtagtttgtatttctgtgggatcggtggtgacatcccctttgtcattttttattgcgtctatttgattcttctctcttttcttctttaatagtcttgctagcggtctatcaattttgttgatcttttcaaaaaaccagctcctggattcattgattttttgaagggttttttgtgtctctatttccttcagttctgctctgatcttagttatttcttgccttctgctagcttttgaatgtgtttgctcctgcttctctagttcttttaattgtgatgttagggtgttaattttagatctttcctgctttctcttgtgggcatttagtgctataaatttccctctacacactgctttgaatgtgtcccagagattctggtatgttgtgtctttgttctcgttggttttgaagaacatctttatttctgccttcatttcgttatgtacccagtagtcattcaggagcaggttgttcagtttccatgtagtcgagtggttttgagtgagtttcttaatcctgagttctagtttgattgcactgtggtctgagagacagtttgttataatttctgttcctttacatttgctgaggagtgctttacttccaactatgtggtcaattttggaataggtgtggtgtggtgctgaaaagaatgtgtattctgttgatttggggtggagagttctgtagatgtctattaggtccacttggtacagagctgagttcaattcctggatatccttgttaactttctgtcttgttgatctgtctaatgttgacagtggggtgttaaagtctccccttattattgtgtgggagtctaagtctctttgtaggtcactaaggacttgctttatgaatctgggtgctcctgtattgggtgcatatatatttaggatagttagttcttcttgttgaattgatccctttaccattatgtaatggccttctttgtctcttttgatctttgttggtttaaagtctgttttatccgagactaggattgcaacccctgcctttttttgttttccatttgcttggtagatcttcctccatccctttattttgagcctatgtgtgtctctgcacgtgagatgggtttcctgaatacagcacactgatgggtcttgaccctttgtccaatttgccagtctgtgccctttaattggagcatttagcccatttacatttaaagttaatattgttatgtgtgaatttgatcctgtcattatgatgttagctggttattttgctcgttagttgatgcagtttcttcctagccttgatggtctttacaatttggcatgtttttgcagtggttggtaccggttgttcctttccatgtttagtgcttccttcaggagctctcttagggcaggcccggtggtgacaaaatctctcagcatttgtttgtctgtaaagtattttatttctccttcacttatgaagcttaatttggctggatatgaaattctgggttgaaaattcttttctttaagaatgttgaatattggcccccactctcttctggcttgtagagtttctgcggagagatcagctgttagtctgatgggctttcctttgtgggtaacccgacctttctctctggctgcccttaacattttttccttcatttcaactttggtgaatctgacaattacgtgtcttggagttgctcttctcgaggagtatctttgtggtgttctctgtatttcctgagtttgaatgttggcctgccttgctagactggggaagttctcctggataatatcctgcagagtgttttccaacttggttccattctccccatcactttcaggcacatcaattagatgtagatttggtcttttcatatagtcccatatttcttggaggctttgttggtttctttttattcttttttctctaaacttctcttcacgcttcatttcattcatttcgtcttccatcgctgataccctttcttccagttgatcacatcagttactgaggattgtgcattcgtcacgtagttctcgtgccatggttttcagctccatcaggtcctttaaggacttctctgcattggttattctagttatccattcgtctaattttttttcaaagtttttaacttctttgccattggttcgaacttcctcctttagcttggagtagtttgatcttctgaagccttcctctctcaactcgtcaaagtcattctctgtccagctttgttccatgctggtgaggagctgcgttcctttggaggaggagaggcgctctgatttttagagtttctggtttttctcctctgttttttccccatctttgtggttttatctacctttggtctttgatgatggtgacgtacagatgggtttttggtgtggatgtcctttctgtttattagttttccttctaacagtcaggaccctcagctgcaggtctgttggagtttactggaggtccactccagaccctgtttgcttgggtatcagcagcagtggctgcagaacagtggatattggtgaaccacaaatgctgctgcctgatcgttcctctggaagttttgtctcagaggagtacccggccgtgtgaggtgtcagtccgcccctactggggggtgcttcccagttaggctactagggggtcagggacccacttgaggaggcagtctgcctgtcctcagatctccagttgtgtgctgggagaaccactactctcttcaaagccatcagacagggacatttaagtttgcagaggttactgctgccttttttttgtctgtgccttgcacccagaggtggagcctacagaggcaggcaagcctccttgagctgtggtgggctccacccagttcaagcttcccggccactttgtttacctactcaagccttggcaatggcgggcgcccctcccccagcctcgctgccaccttgcagtttgatctcagactgctgttctagcaatgagcaaggctccatgggcataggaccctctgaggcaggtgcgggatataatctcctggtgtgctgtttgttaagcccgttggaaaagcacagtattagggtgggagtgacctgattttccaggtgccttctgtcacccctttctttgactaagaaagggaattccctgaccccttgtgcttcccgggtgaggcaatgcctcgccctgctttggctcacactcggtgcgctgcacccactgtcctgcacccactgtccggcactccccagtgagatgaacctggtacctcagttggaaatgcagaaatcacccatcttctgcgtcgctcatgctgggagctgtagactggagctattcctatttggccatcttggctccacccccaggactataatcttttttttttttttttttgagatggtgtctcactctgtcacccacagtggagtgcagtgccatgatctcagcttgttgcaacctccaccttccaagatcaagttatcctcccgtctcagcctcccgagtagctgggactacaggcatgtgccaccatgcctggctaatttttgtattttttatagaggtggggtttcatcacattgcccaggctggtctcaaactcctgggctcaagccatctgcccacttcagcctcccaaagtgctgggattacaggtgtgagccatccaccatgtctggccacactttctagtatatgaagggcattcatttacttctacccttttgtgatgattatatcttctagctattcacttctctctgtaaaatattgcctcatattgccatgtgactgtcaatacttccctgtgggaggaagatactttaccactccattagttatcagtttggccatgtggcttgttttagccaatctaatgagaatgaaagtgatcagagcagaagttttaagggctatcacagtcccgtttaccatctgccatgagaatggcctgtgttagaatgaagagactcttgcaacagagctgaaactaacttgaagctgatgagcaagaaataaacccttgttgctataagccatgaatattttggtggtgttaccacagcatagcctggcaaaagctgactaatacatctttactaaagtgtaagtcttttttttaacttctaaaaaaattaaaaatacaagtcttttggtgggaaagatcacactgtattcatgactcgtcttcatgaccttggccttccaaagtgctgggattacaggcatgagccactacttctggctttttttttttttcactagagagtgatttgtctcttatccttcatgaacctagcacaaagcctcacttaaaggctcagcaattatttactgagagaataaataaataaatccagcatttactaagtgctactgttataatcctttaccttatagtactgtgaaattcagaacacaatttgacagacattgcctcactgagcctcaggacatccaggggagagcagtaggggagaaagagtattatcccacctgtctaacatctctgttttctttggagaactaccctccccccattccatgtggttctggtggggctgccagtcacaaccccagcccttctggttacaagagtaggcatatgacccaggtctgtctaatcccagtattgaatcctctgtacacaatgactggaccagagacaggaatatgacctaaatgggaccaagcatcagagcgctttcctgagaagagtggcagacccagaaggaagatgtctagaaagagtccgaagtatgagtgggaaatttcaagaggacacttaacactgctctgtaatcctccaccattcctctaatgtgtttactttctcactcttcacaacttatattccatacctcttcctgtctcttcagacatctttcactctctttactcctccctttcagctgatggtctcgcctcgtgcctcatggagaaaacagaagcaattagacagttgctccctcattttcctagcaccaattctacttacctacctgcatgcgtattcaaattatctgccttttttcttatacattggattaactgttcccactcctatcagtggccatctgctaccctagaacatgctcaatagcacgcaaacattttctaatatagcccagctttaaaacataaataaatgaccctaccctctatcttgtattgtcacccaatttttctactgtgcttcatggcaaaacttttttctcttttctttctttcttttttttttttttttaaagacagggtcttgctctgtcacccaggctagggtgcagtggtgtgaacatggctcactgcatcttccgcctcctgggctcaagcaatcctcccgcagtgctgggattacaggcatgagtcactgtgcccgaccaaaactgcttgaaagttgtgtatagttgctgccttcacttccttccttgcattctctcttcagtgaagaaaaaactccactgaaactgatcatcgttgggatcaccaatggtcagcatgctgccaggtccaaaagccactcctcactattgttgactgctgcttccatcttgaaacataatctcctcttggcttccaggacaccatactcttctggttgtctacctcactgggcacttcttctttgtctcctatgctggctccttctttaacaaactactaaatgttggaaagtgctggaactcaacctagttccctttctcttctctatctacatgtagtcccatgactgtttttcttttaagacagagtcttgctctgtcgctcaggccggagtgcagtggcatgatcttagctcactgcagcctctgtccccggggctcaagtggttctcctgctttagcctctcaagtagctaggaatacagtcatgcggctgggtgtgatggctcacacctataatcccagcactttcagagggccaggtgggtggatcacttgaggtcaggagtttgagaccagcctggctaacatggtaaaaacccgtctctactaaaaatacaaaaattagctgggcgtggtagtgcctgcctgtaatcccagctactggagaggctgaggcaccagaattgcttgaacctgggaggtggagattgcagtgagccaggatcatgccactgcactccagcctgggcaacagagagagactctgtctcaaagaataaaaataaataagtaaatacagacatgttacaccatacctggctaattttcttattttttatagaggtagggtctcactatgttgcccaggctggtctcaaactcctgggctcaagggatcctttcaccttggcctcccaaaatgctggaataataggcgtgagctactgcacccagcccccactagtgttttactgtgatggcgaaattagtgcttccaaactagacctctcccctgaatttcacctttgtatacctatcagcctacttgacacaccctttgatatctcttatgtgttgaattgtgttccctaaaaagatatattgaagtcctaaccccccagtacctgtgaatgtgaccttatttgaaaatagggtctttgcagatataatcaagttaagattgccattgattttgacttggtgtaaaataggttgataaataagtaaataatcaagttaagatgagatcacactgggttagggtgggccctaaatccaatatgactggtgttcttataagaagaggagtggtggtgcacacctgtagtcccagctacttgggaggtgaagccaggagaaccacttgagcccagcagttcgaggctgcagtgaaccgtgttcacaacacagcactccagcctggaagacagagtgagatgccgtctcaaaaaaaaaaaaaaaaaaaaaaggactgggcacagtggctcacgcctgcctgtaatcccagcactctgggaggccgaggcaggcagatcacgaggtcagcagattgagaccatcctggttaacacggtgaaatcccaactctactaaaaatacaaaaaattagctgggcgtggtggcgggcacctgtagccccagctactactcaagaggctgaggcaggagaatggcatgaacccaggaggtgcagcttgcagtaagtcgagatcgcgccactgcactccagcctgggcagaagagtgagactctgtaccccgccccccccccaaaaaaaaagacgagaaacatagagacagagacacacagggagaataccaggtgaagatagaggcagagactggagtgatgtgtccattagccaaggtttgctggccactaccagaaaataagagagaggcatggaacacattctgtctcagagtgtccagaaagaatcaacctgatgacaccctgcattcatacttctggcttccagaactgtaagataataaatttctgttgttttaagccacttagtttgtggtcatttgttatagcagccataggaacctaaaacaacatctaataggcatctcaaaaaaaaaattctgtttttgagacggtcttgctctttcacccaggctggagtgcagtggcataatcatggcacactgcagccttgatcttgtgggcccaagcaattctcccaaccaagcctaggactgagactacaggtgcttactaccacgcctggataattttttttttctttttgagacagagtcttgctctgttgcccaggctggagtgcaatggcacgatttcagctcactgcaacctccgcttcctgggttcaagcgattctcttgcctcagcctcctgagaagctgggactctaggcatgtgccaccattccaggctaatttttatatttttagtagagatgggatttcaccatgttggccaggctggtctctaactcccgatctcaaagtgatccacccgcctcggcctcccaaagtgctgggattacaagcgtgagccattgcaccctgcagcatctcaaatttaacatgaccagaatgtaactttttgttttgttttaaatttatttcaaatttttttttaagacggagttttcctcttgttgcccaggctggagtgcaatggtgtgatcttggctcactgcaacctctgcctcccaggttcaagcaattctcctgcctcagcctcccaagtagctgggattacaggtgcccaccaccacgcctggctaatttttgtatttttagtagagatggagtttcaccatgttggccaggctggtctcgaactcctgacctcagttgatccacctgccttggcctccgaaagtgctgggattacaggcatgagccaccacactcggccaattttatttttagttgacatgtaatgattgttcatatttatgggatacacagtgatgttttgatatatgtatataatgtgtaataacctaatcagggtagttagtatatacatcatgttaaatatttatcatttcttcgtgttgtgaaaattcaaaatattctcttctagctttttgttttgttttgagacaggatcttgctctgtcgcccaggttggagtgcagtggtgcgatcatggctcactgtagccttgaccttccaggctcaagcaattctcccacctcagcccaagcttcacccctcccagtagctggtaacacaggcctgcatcaccatgcttggataataataataattattattatttgagatggagtttcactcttgtcaccgaggctggagtgcagtgtcacgttctcggctcactgcaatcttcgcctcccaggttcaaatgattctcctgcctcagtcttccaagtagctgggattacaggcatgtgccaccacgctcggctaattttgtatttttttagtagagttggggtttcaccatgttggccagactggtctcgatctctgggctcaagtgatccacccaccttggcctcccaaagtgctgggattataggggtgagccactgggcccggccaaatttagttaatttttttaaaaaaagggtttttttttgtagagttgaggtctcattatgttgtccaggctttttgaaaatgtacactaaattactgttaaccaacattcaccctgcagtcctagagaacactagaacttattcctctcatctagctgtaactttgtatccattaaccaacctctccctctcctcccctccccatacccttctcagtctctaataaacacaactcttctcactttcatgagtttgagtttttttagctctcacatatgaatgagaacatgtgttatttctcattttgtgtctgacttatttcacttaacataatgtcttactgaaaatgacaggatttcattctttttttatggctgaatagtattccattgtgtataggtagcacatttcctttatccattcatctgttaatagacattcaggttgattctgtatcttggctattgtgaagagggctgtagtctacatagggatgcagatatctcttcgatatactgatttcctttcttttggttatacccgcaaagggattgctggatcatatggtagttctattttagttttttgaagaacctccatactgttcttcagagcggctgtactataataatttacattctcaccaacagtgtacaagcattcccctttctccacatcctcccaacttatgttattttgtctttttgataaaagccatttttagactgggtgcggtggttcatgcctgtaatcccagcactttgggaggccgaggcggacggatcacttgaggccaggagttgagaccaatctggccaacatgacggaagcctgtctctactaaaaatacgaaaactatcgggcacggtgacgcacacctgtagtcccagctacttggaaggttgaggcaagagaattgcttgagcctgggaggtggaggttgcagtgagccgagatgatgccattgaactctagcctgggtggcaaagcaagactctatctcaaacaaacaaacaaacaaacaaacaaaggccatttttaccatggtaagattatatctccttgtggttttgatttgcatttccttgatgataaatgacgttgagcattttttcatagacttattggctgttagtatgtcttcttttgagaaatatctattcagattctttatccatttttaaatcagatttttttttgctgttgagtgttttttgagttccttacatattatggaatattagttccttgttggatgaatagtttgcaaatattttcctccattctacaggttatcttttcactgttgattatttcctttgctgtacagagctttctagtttgctatagtttgtctgtttttttttttttttgctgcccatattagtctgctctcacactgctgtaaagatactacccgagactgggtaatttataaaggaaagaggtttaattgactcacagttgcacatgagttgggaggcctcaggaaacttacaatcatggtggaaggtgaagaggaagcaaggcatgtctcacatgatggcaggagagagagagagcacaggggaaatgccaggcacttatcaaacaaccagatctcatgagaactccctcactaccatgagagcagcacgggggaaaccacttccgtgatccaatcatcacctcccaccaggtccctactcgacgtgtggggattacagttcgagatgagatttgggtggggacacagagacaatccatatcattgcctatgcttttgaagccttacccatgaaatctttgcatagcccattgtcctgaagcatttcccccatgttttcttctaatagttttatagtttcaggtcttatgtttaagtctttaatccatttcgagttgattttttttgttgtttgctattgtgtgtgttttaggtttgctgttgttgttgttttagagacagggtatagctatgttgcccaggctggtctcaaacttatggcttcaagtgattctcacacctcagcctcctaaagtgctgggattacatacccaagccaccccatctagcccattttgagttgagagatagaaatctcattcttctacatatagatatccagttttcccagcactattttgttcttaatttttgagaccaggtctcactctgtgacccaggctggaatgcagtgatgcaatcatggctcactgagcctcaccctcctgggctcaagcaatccttctacttcagcctcctgagtagctgagtagagacaggatcttactatgttgcccaggcaagtctcaaactcctgggctcaagtgatcctcctgccctggcctcccaaagttctgggattacaggtgtgagccactgtgcccagccccagcaccatttattgaagagactctcctttccccagtgtatattcttggtgcctttgttgaaaagcagttggccataaatatgtggatttatttctggattttctattctgcagaacagaacttttatcatcacctcttcaaatctgctagactagactttcccccaagccctccttctattctacccctggtctccttttcacatagcaaacagagtgttcttttgaaaatataagttcgatcaagtccctcagtgtttaaaacccatcaaaagcctccccataatcctttggataaaattaaatttccagtggacatggtggctcaagcctgtaatcccagccctttgggaggccgaggcaggagaattacttaagtttaggagttggagaccagcttgggcaacagagtaaaaccctgactctattttttttttaagaaaatttcatttcttggcctataaggtcattcatgatctggcctgtatagaaaagaacaaactgttttctttctttctttctttctttctttctttctttctttctttctttctttctttctttctttctttcttctttctttctttctttctttctttctttctttctttcctttttctttctttctttctctcctttctttctctctctctttcttctttctttctctttcttcttcttctttttttttttttttttttgacagagtcagtctctctctttctcactcaggctgaatgcagtggcacaatctcggctcactgcaacttcccatctcagtcttccaagtaactgggaccacaggcatgcaccaccatgcctggctatttttttttttttttgtatttttagtagaaatgggattttgccatattgcccaggctggtctcgagctcctgagctcaagcaatccaccggcctcggcctcccacagtggctggggttacaggcatgagccactgcgcctggcccaaactgtttttcttctgctctcacaccacaacaaccatcatagaagacttctgtgaccaaatatgtgggggtttcttcccaccaataagcaagcagtgagttctgctgtggatatcaactgaatgtcctctaattcagttcaattgtgacactatttatctggagatagcatcagactcctgagtttgaaggctcagtccctaagactgcgtcctcttccaatgccaattgcaagccccaggttgtttcatctgtgcttctgactgacccccctccttgggtttggttaatttgctagagtagcagttttctgcaaggactcaaagaacacttactcatgtttacctatttattataaaggacattacaaaggacacagatgaagagatgcattgggtgagatataggaaggcatgtgaagcttccgtgctttcccagggagcgtcaccctccaggaacctccatgggttcagctgtccagaagctctctgaaccctgtcctcctgggccttttatggagactgcattggataggcataatagaagcatggacagccatgtagaactgtggttggacaagaaggggatgatctaatgttaacagactgagtggggaaacccagcaaagcctgtctgttcagattcttcttggcctctctgcagcctttcttcctccaaggtatggggcaggtcccttctgaaatgagggtcttatggtctacagtcagacaaggtaggtcagataatttctttatggccagctccgagacagaaagatgggtaggatttgagtcctgccttggagagaaaaaggagcaagtgaaaggagggcaggagtcagagagagattccattttctgaggcctgcttctgatgcctaaagcagcccaacattataaaaaaggcagtaacaggggctatgggagttatgagccaggaaccatggatgaaaaccattctatgctgtgtatgtcacatggccctgcctccttgtggttgtcacctcccatcatgccctcctggcatgtaggtcctttgcactgattattacctcttcctggggctgttctgtccacagatctggcatgacctgaccttcttgacctcccaacataaagtgggcccaggttttttgtttttttatttttttattttttgagacagggtctcactctgtcacccaagctggagtgcagcagcccaatcatggttcacttcagcctcgacttccggggctcaggtgatcctcccacctcagcctcccaagtagctgggactacaggcatgtgtcaccatgcctggctacctttttttttttttttaatatagtgatgaggtcttactatgttgcccaggctggtctcaaactccagagctcaagcaatctgcccatctcggtctcccaaaaagctgagattacaggtatgagccactgtgcctggccaaccactaggttttatttccttcatgggacagtgtttccctgcatgctgagcctctggttccagtccctgtggccttgattctgacagctcttccttcttcagactctgattagggtccttcccgagtctggtctcttgtctgcgagtcaatgcattccatttttgcttaagaatttgagggaggtggctgggcatggtggttcacacctataagcccagcactttgggaggctgaggtgggaggattgcttgagtccaggagttcaagaccagcctgggtgacatggcaaaactccatctctacaaaagatacaaaaaattagccaggcgtggtggcatgcgcctatagtcccagcaactcaggaggctgtggtgggaacataacctgagcccaggagttcgaggctgcagtaagctgtgatcatgcactgtactccagcttgggcaccagagtgagaccctgtgtaaaaaacaacaacaacaaaaaaacaaaaaacaacaacaacaacaacaacaaaaagaatttgagagggttttggcactttcagtagaagaatgtagcctaatcaaaggctgagcccagtctctacaaagaactaacccccaaggaaggctgctcagaagtccaggcccttcctgtgtaagaagccctgatgactttagcttagcatcattaaactttccattctgtgatgggaaaaggccatttccatcttccaccaagtgtggagggaggcagagctgacagtttatctctcaaatgccctcaccctgccaaacagacatcagagtttccctggtgctggcttcctcccggactgaggcagaagcagagcatgggacagaggaattaggggagagaggagtctcccagcctgtgtctgtgtgatgtggagatcgctatggtctccaaagagttgaaagaagctgcagctctgcgtatcctctggtggctgaatataacagtttcatttattcagcagattcctagccaggcactgagctagaacttcaatactaataatggcgtcaacggctcccatttggagatggcaggctatggaccaggcacagtgctgcacactctagaagcattatgtcaggaggctgaggcaggacaatggtgtgaactcgggaggcggagcttgcagtgagccaagatcgcgcgactgcacaccagcctgggcgacagagcaagactccgtctcaaaaaaaaaaaaaaaagaagcattatgtcatctcattctcacaacagttccctgagacaggtataattatccccacctaacagatgaagaaacaggctcagtgaacagaaggcacttgccaggtggtttctactgcaaagctgtgatctttcttctgcaaggaattgcctctttcctaaacctcctggcgcctggttcccagcatgagaacttgtgactaaatgtaggtgacgggggcctatggcggcccttctgtggcagccaatgagggagcagggtaaggacctgccagctcaggaacctgccctccatgaatctgcccccagttctttcacagctgtggggagacaccaagccctgagtcacttccctgggaaatccccgcagaggctttcctgggaataagataatgcaggaatctgggctggactgtccaaggggcccgattcctgccagccagcctatacgtcttggagcaagacctcagggtcttctccagatatggacaggcctgatagacataagctgcagtgggacaagcaacatgtgtagaaggcctctggagagaggggtctgggaaagggatggggtgggtatctctgccatcaagagaatgattgctaaggctccctcccaggccaaggcaatggcaacctgtgattctgtgggtcagggatgaggccacttcagtgaaaggccttcagcctgacccccccgtaggagacagggaggcaaatggctgagcagatgccatggccgagaactcaggttagaggccagttacggtggctcatgcctgtaatcctagcactttggaaggttgaagtgggagaatcacttgagtccagaagtttgagaccagtgtcagcaacatagcgagcccctgtctccacaataaaaatttaaaaattagccagttgtggtggtgcacacctgtagtcccagctacttgggagactgaggcaggaggatcgcttgagcccaggagttccaggttacagtgagtgagccagtgagctatgattgcaccactgcactccagcctgggcaatagagtaagaccctgtctcaaaaaataaaaataaagaataggaacatggattccagcctccttgatgcacagatggggaaactgaggcacaggtaggcgaaatgtcaaggtctcacagcaagtgagtgatagacctgccacctcccacacttctgtgccttcaggtaagaaagccttcatctccctgctttcatactaaaaatagagctttgaaaacatgacagggagtcatgtggagtctggctgctgtgggggtcccaagtgtctgagcccttgtgatgctgcctgagtatccctggaaagccgagttggcatctgaaggtgtggggatggggttcgtgctggtgccagtcacacaccagcccacctccaagcacagaagggtgttcctcaaaccctctgggcacggcgtctttgcctgtgattttcctctgatgatatcttgttttgccaactaaattaagactatgacagagaacagagactacctctagcagtttagttcaattaagatttcacatcaacaaattaaaatgcaccctcaccgtctgcaaagtaaatctgcctgcgtttaggaggaggcactgacatttgctgttcaggcacctagccgatgtgagctgagtgtcaaagagggcctaccctttctgggaccagtctgggggttcagagccaggaattgtctccagggacttacagcctctgggtcaggcttctcaagcatgagtgtgaagctccctctgagcctgtgagaaagtcttcactggttctccctaagataacaaaaatgagagtaatgtcatgtttttaaaacaaaacaaaacaaaacaaaaaaactaagttaatccaaattaaaggaccatcagcaaacacttttttttttttttttttttttttgagaccaagtcctggtctgttgcccaggctggagtgcagtggcgtgatctcggctcactgcaacctccaccttccgggttcaagtgattctcctgcctcagccttctgagtagctgggactacaggcacgtgccaccacacccggctaattttttgtatttttagtagaaacagggttgcactgtgttagccaggatggtctcgatctcctgaccttgtgatccgcctgccttggactcccaaagtgctgggattacaggcatgagccaccgcgcccagcctttgtaactttttgagggcttaatttgtcagtctcttttcaagggactgaggagacagcaatcagcaaaacagacaaaagtccctgctctcccggatcttttattctacagggacagacaataaacgacaaatacacaaaatatgcaataagttagagagtaagagccatggagaaaaataaagcagggaaagagggtggggagcgtggagggcagaggagtttgtggttttgttttatccgttagagacagggcctcactgtctgttgcccaggccagagtgcaatggcaacatcaaagctcactgcagcctccaactcctgggctcaagagattctcctgcctgagccttctaagtagctacaactactcagaagttgtagcaccaccacacctggctaagtttttaattctttatatttttttcttctcctccttgtaagttttaaatttttattttgtagagatgaggttttgctatgttgccccggctggtcttgaactcctggtctcaaatgagccttccccactcaaccttcctaagtgctggaattacaggtgcgagtcactgagctcagttgagtttgcacttttatttatttattttgaggtaagatattgctctgttgcccaggctggagggcagtggcatgctctcagctcactgcagcctcaatctcccagactcaagtgatcctcccacctcagcctccttagtagctgtgactacaggtgcacaccactacacccagctaatttttgtattttttgtagagatgggggttcactatgttgcccaggttggtctccaactcctggattcaagcgatccaccctcctcggcctcccaaagtgctgatattacaggcgtgagccaccatgtcctcccaagtttgcagttttaaatggggtagctggggaaggcctggatgagagtgatgattaagtcaagacctgccaagatgagggagtgagccaagaggatgtcagggcacaagggcagccctctgggcagagggaggcagagagcaaaggctggcgtgggattgtgggtgaggtgtggagcaggaagggagggcagtgtggctggagctggatgagcaggagggtggggaggagaggaggtcagaggaccagggctgtagcccctgtaggccattgcagggacttggttcattctctgggtgaagaagccagggcagggtttagagcagagaagagacaagctctgccttccttttaacaggatggctggggctgctgtgtggagaacagccaggagaaaggccaggttaggagtggggagaccagtcacaaggctattgcggaaaccaaagtgagacccgatgatggccagagcaacagcacaggagctggtgatatggggacactggctccgaatgtttgaaatcagtaataacctagaggctgggtgcggtggctcatgcctgtaatcccagcactttgagaggccatggcaggcgaatcacgaggtcaggagtttgagaccagcttggtcaacatggcaaaaccccatctctactaaaaatgtaaaaaattagctgggcgtggtggtgggtgcctgtaatcccagctacttgggaggctgaggcaggagaattgctggaacccaggaggtggaggttgcagtgagctgagattgtgccgttgcactccagcctgggcaatagagtgagactgtctcaaaaaacaaaaaacaagcaaacaaacaaaaagatcctctcaccttggcctctcaaagcactgggattacaggtgtgagccactgcacccggccatgcccctctcacctgttttttataatcccagaaggctgtttgtgtaagtgtggtttttgtttttttctgtgaatgtaaaggattattatcacatggatttggttattgcctctgaaggactggggcaatttgcaggtcgtctcttgttctcttgtctttcttcttctccctgtttccttctccctctgcctctgtaatcttagttggccgtcatgtaaaaccgaagagagttttatgcttcctagtcctactatttagagtggataagtggaatgtttttaatttctgtctcttagaaaaacaacagctaaattaaattctttgttacttgtgtaactctcaactgcttttcctctcactgtgcgtcagcacccccactttctaagactgagaagtcgatactgcttcccagggaaaaggaaaacacacccaacatgggcctttggatttcccaccacttcaaacttctcttctatttaacttgcatggtaatttgcatatatctacatatgttatgcaatcagcctgttctccttttacatttaagcctaaaataattttgcgtttctgatgttttccttctctactgccttctttatttctttctggacctgcaaaaggaattgatgaaaggccagtggtatggacacactacacacagcatgggggaaaggaagattggggaacaggatgatgagattgtctctggggcttattcattcgttcatcaaatatttattgagcacctactatgtgctaggccctgtgtcagttgctgggagtacagcgatgagcaaatcgatcacagttcttactcacatggagcttacactctagtgagtaaaatagtaagcataaataaaaagataacttctgatattaacaaattatataaagaacacatagtgactggaagattggtagcttatagaaggtctctctggagaaggaactttgggctgaggcctgaatgataagaaggggacagccatggggggatttggtggaatcctgttccagacagtgggaacagcaagtgaagacacctgaaatgagaatgaacttggagggtttgaggagcagaaaggaggtgtatcatttagaatgtttttagtagaaagagaagtcccaattcaaaatggcacaaacaagaaggaattttattgccttcacataaagaagcctgggggccatggggacagggttctaagtttgtttagtttagcaaatcaacattatcaagggctaggttatgtccttctttctgctcagccattctcttgggctggcttccttccagacaccaagatggcagccaaagctccaatctcccattacatcctcatctccatgcagtgtccaaaagcagagagaacagtgcaaactcgctccttttcagaacaaggcaacccttcccacaaccctgcacagattcctcttcacatctcatagcataagaaaattacacaacacgcccattcctaaaccagtcattagcaaaaggaatgggattactaagactggtttagagctgggcaagggagaaacctagcttctgtagaactttagtgaagaaccaatgttctccatttctgacaaaaaccaggcttctgtgagcagagtgcagtggcgtgtgccaataatcccagctactcaggaagctgaagcaggaggattgcttgagcccaggagttcaaggtcaggaaaatagtaagcatggaaaaaaaagaaagaaaacacaaacccccattcaacactgtactggaggtcctaactagtgaaataaggtaagaaaaagaaataaaagatgtatatgtaagaaaaataaataaatttaaaacccaggcttctggaagcaaaattaagcttcattaagcaaagaaatgggaaaggcctacctataagtaggtgatcaggagtatcagccacaggaggtcagtgtggccagagcattggtgtaagaggaggttatagaggtggaactgagggatggcagagcttgctttagcttctttgaatgcagtctttcgaactggataaatccctaagggccttatccttaccaggaaccccctccagcatcccccgctctccaggacccaccccacctctgggtgaggagccatggaaagactgcccagctcaggcaacagacaccgactttaatactaactgatgacactgggtgtcacctttccttccttcagtctcagtttcattatccataaaaatgatgcaataacgtttgtcctgttggccattcagggaggttgtaagaatcaagtgagagcatatctgcatgtcccttgatgtgccatgattattattattgctatagttgtcattcatcttacatgaaaaacaaaaggattttaagttttaagtagtcacatgctccagctcccgggaaggcacatctgtcattttggaaagctgtgtgttctgagggagtaaggagggtacccttgggctctttgttccccagaccttttctcagcacctcctgtgcccccacccccaccctaccagcagccttctgtgctttgcatcacagatgtccttggaaacaagctcagctgatgttcaataaaatgtaggctaaagctggctgagttattatccttttttcttgataaaaagagtggatgtattttcattactggcagagtgcttttagctagtgtggacaattaagccctggaaatgcagcaatccatttcacactgagagaagatttgagcaggactgtcaccaaaaatccaggaggagctgaaatcatggccatggtgcccaacaataaaaagccatagatatttggaggcagcccacagggatttgcccctccgtggaatgttgctgttgctggcttggaatgagagctgcgtcccctgatgcttctccactggcctcaagacccttcttagccaccctcttcctcattctcacctctcttgggcaggcaggcagggaggagcaccctgttattggcagcagctcctaccaaactttgccttttaggttcaggcacccttcttggttttcttcatgatctcctgatcatctccttcacctctggagacacattctgtctccaaagaattggacctctagaccaagagaattgtccattccaaagctactagatcaatgacgaagtcctcctgtagggaataacaaccctcctgcctcctctatccttcccttctttctttctcttgttcatttacttctttttaaaatggtggcccaggcatggtggctcacacctgttatccccgcactttgggaggacgaggtgggtggatcacttgaggtcaggagttcaagaccagccaggccaacatggtgaaaccccatctctactaaaaatacaaaaagttagccaggcgtggtggctaatcccagctacttgggaggctgaggcaggtgaatcgcttgaacccaggaggcaaaagttgcagtgagccaagatcacgccactgcattcctgcctgggtgacagagcttctaaataaataaataaataaataaataaataaataaataaataataaaatggtgcattagcagctctaatttccagctcctaaaggtaaaggtgagatgatcccccttcaacctccctgtccaacctaacccaagctaggggaagaggtgggtttttttgttttgttttgttttgttttgttgagagggtcttgctctgtcacccagtctggagtgtagtggcacaatctcagctcactgcaacctctgtttcctgggctcaagtgatcctcccacctcagttggctgagtagctgggaccacaggcatgtgctggcacacccggctaatttttgtatttttggtagagatgaaatttcaccatgttgcccaggctggtcgcgaactcctggactcaagctatctatccaccttggcctcccaaaaggctgggattacaggcatgagccactgtgcagggcaggggaagagtcttaaggggcagattcttgggagcaacacaatttgcaggtgctgtggcttatctggctacacatctactacacatctcatctgcctccccctgctgtttttttttttttttaagacagagtcttgcacagttgctcaggctggaatgctatggagcagtcttggctcactgcagcctcaacttcccgggctcaagccatcctcctacctcagccccctgagtacctgggaccacaggtgcatgacaccatgcccagctaatttttttgtattttttgtagagatagggtcttgccatattgcccaggcttgtctcgaactcctgggctcaagcaatgagcctgcctcggcctctcagagcgttgggattacaggcgtgagccaccatgcatggcctcttcctccccttattctaagagcaactggggggcagggatagtcccccacctccccatctctgcatctcctgcagccagtacaatgcctaggacagagtcagttcagatgcttgaggaatgaaaggaagaatgaatgaatgagtgaacaaagccatttctgtgttagttcctttctcacagctttgtctctttgttctgaaaaacacccacagctcctcccatcataatgtagaaagtataaattacttcagagatgtagggactgagtgacgatcagtggagtgatagcaatctgctacattattacgattttttatttaaaccacttaagctctagtctccctcctgtttactgttagaaatgatcccaaatcagttgtgaatcttctcctgccttgagggagtaagatgagaagactggggtggttgtccaggcttattatcttctccattactcaggcatgttcccctgagctttctcatgattttattttaatgcagttatttgtattaggcgagtctccagctcagccaggacaaagagggaggtgggggaaccagggagaagctggtggaaaaataaataccctgaaggttcatgatgatctgaccatggctttaatatgaatcaaatttgctccaacctgctttcccacagtcagcatttctgctagaaataatttgtaattatcaaactccaattaggccagaagactccttgtaaaagactttgatgtgattagggaaaggcttgaaaatataatttgcatgattctagccctctctgccaatgacattcctggagaagacatcttgtctctcttggcaggagaaattccaaggacaggagctgggggccagacttcagggtcactggggctgctgctccaaggctggcccaagaaggtgctttcctggaataatgagcctgagagattccttatctcagcattcaagagctgagagtcagtgagtggcccagagagggacagagctagatgcatgctgaccagcagctgtgcccagcactttgatgaaggccctttggtaactgcccagcatcagtatgggtcacccccgggggattcctggtcttgcccttggctgagaaatgatgacaacctctttcatcccttctcatatcttaacctttcagctctgtagcagctgagccacggcagtgcaacagtaatgcaaaggtactgaaaaataaccaaaaaggtctaaagaaattagcaaaaacctagataaatggaatgatatcctgtgttcatggaggacaatattgttaagatggcaatactcccagaatcgatctacagattcaacacaatttctatcaaaatcccagcttccagctgggtgcggtggctcacgtcttataaaccggcactttgagaggctgaggtgagtggatctcttgacgtcaggagttcgagaccagcctggccaacatggtgaaactctgtctctactaaaaaatacaaaaattagctgggggtggtggtgcacatctgtaatcccagctacttgggaggctgaggcacaagaatcacttgaacccaggaggcggaggttgcagtgagccgagatcacaccactgtactccagcctgggctacagagtgagactccatctcaaacaaacaaacaaacaaacaagaaacagcttccttgcaataaggaaaaagtcaaaaagtcaaataaatggaaaatcaacaacttttatttgatccatcagagagctgaagtcacagaacaaaatgcctccctgaaaatgagacagatgaatacggatcagtttatctgaaacagaagctgtttcagccaggagccagtgggaatgaagtgctgaaacatggaggacgcttaaaaacatcacagtgagtgaaggaaaccaaacaaaagattacatagtgcatgattttatccataggaaacgtccggaataggcaaatccataaagacagtagattactggttgtcagagctgacgggtgactggtaatgggtacagggtttctttctggggtgatgaaaacgttctggaattagatagtgatgatggttgcacaatttgtgaatacgttaaaaaccactgaattgtacattttaaaatggtgaatattatggcatgtgaattatatctcaattaagaaacaaacgttaagcaaagataatttgggatgggaagtcgaaatttcccttcaaattcagtttgcagaccattttcaggaacagaaggcttttctactgactcatgagttagtagtagtcagagcccagtcagagcccagcctctgaccaccctgctcccctgtgatttgctgacttgagaagaggaagtctgggaaatggaacagagagagccaggagtagcctgaagaaaaggagccaggactgggaaatgcttgaaacagacttcagagctttgtgatgctggctgagggctctgcaggaggccttactgctacagcatgccgccacctcctccatgaagtctccctgcctctttcttcccataaggcactttatctggcatacatcgttttcacccaaagacctcacactggatcctttactgccttgttgccttgcaggttctctgactgttccacagagagctattctacttggagatatgtgtcccctccacaatgacatcacaacctcttccaggatgggatgcctgtcttggactcacagacccccttaatgcaggaaaaaactttaggcatcacctggccccctcttccaaatttaaatgtagcccaactatgagacacttgggttgactcgagtctcccagcctcctggggtcatccttccctctgtgttaagctagatggacacgcactgccccctatccccatgtacaatggaaaactcatgtcctgaatcctgtgcctttgagggtttctgaggggcggaagtgtgtgattttgttgttgtttttaagaggtgtgggtctcactatgtagcccaggctggagtgcaacgagtatttataggcatgatcatggcacaccatatcctggaacttctgggctcaagcaatcttcctgcctcagcctcctgagtagctgagactacaggcacgtgcctctgggccctgctagaagtgtgtaatgtgtaaggaaatggctttggaacctgggttcacatcctagctctgccatttaccttggacaagttatttaacttatttgtgtctctgtttccttatctataaaacggggataataatacttcctccttttgttgttgttgttgtcgtttgtttgtttttgagatggagtctagctttgttgcccaggctggagtgcagtggcacgatcttggctcaccacaacctccgcctcccaggttcaagcaattctcctgcctcagcctcccaagtagctgggactacaggcacgcgccaccatgcctggttaatttttatatttttagtagagatggggtttcagtatgttggtcaggctggccttgaactcctggcctcgtgatctgcctgccttggcctcccaaagtgctaagattacaggtgtgagccaccatgcccagcctacttcctcctttgtaagattggtatgaggattaaatgaattaccagtaatataggaacataaagcatttagaactgtatttgccatcccataagttctataaaaatatttgaccttatttcttgtttctgctgaattcttgacctaccgtgtgtcttgcccctttctcctctcctgctgcctccatctgccccctccgaagcatccctcattcaaggccacgtgtggcagacttttgctaaaagctttgaggggaacagaaggggccacacaacacagctcagccagcaacttaaaattgtcttggaccttgctgttcctgaaagtgccctagtcgttcctaccacaaggcatctctcagacactgcccatcttctcttctctaatgccagcttgctgccttgctgcactcgctcactttcctccttctcatacctcctctctctttcccccagcccctcaccctgcaaactctgctttctctccgaacaagcctgaacaagcctcgttgtagcccatctaagtcctgcgtcaggggaaatggggaatggggagtggcagggagatcgacctttagcatccaaagaggccttgcaggtaatttctagtaaagatgcttctctcactatcaggactcaaggagataggagaggcccagggatgggaagagacactcctaccattcccagacagagagaagtttccatctccccacgaaaagcactgcacagcctgctgggtgcagtgggtcacacctgtgatcccagcactttaggaggccaaggcggggagatcacctgagagcaagagttcttgaccagcctgggcaacagtgagaccttgtctctaaaatatatataactatgtacatataaaacaaataaaagcactgcaccccccaaaaaagcaacacaaagcccacgctggacaaaggaccggccagaaagctgcctaagtaaaccagcctcctcctgccgctcaccctgcattatctgttactaggcccagacgactggggagttattgtttcgggggagggtcagaggtgatattttagcccattaaggccgctgctttccaaggcctgattttcctcaggcaccgcatcaaacttgttctctagctgccaaagaaggcaggatttcagctgaaggtaatttatgttaatttttcccctttctggtccgttaagttttgtgatgttaatatatctttttgggggcctcttcgcagggtgctgctgggtgggctgggggtgggggccacctgctggcatgacatctgggaccctgtgtctcccttcctctgctgcccggggactctccattgctgagggccttgttgggaggctgctttgggagggcaaagacctttgtatttttcagagttctttccttaccacccctgttccaagctcagtttttcagggatgtactgaaagaagcctaaggtgcagtgcagtcaactgagcaacaaatattttgggagcgtcaagtaagtgccaagctactgtcttgggaagttttggggattcaaaactgaataaaacatagtccctgtccttttttctttttctttgtcttttttgagacagagtctcactctgtcacccaggctggagtgcagtggcatgatgccggctcattgcagcctcaacctcctgggctcaagcgatcctcccacctcagcttccagagtacctgggaccacaggcatgcaccatcatgtcagactaattttttaatttttttatagagatgtggtctccttatgttccccatatggtctcaaacttctgagcccaagcaatcctcccacctcagcctcccaaagtgctgggaatacaggtgtgagccagtttgcctggccagtccctgtccttaaggtgctttccatctagttgggatttgggagagaggttaggtgtacccaagtgtagtcaattatgttataaggtgacatgtgtgcacctagaatatcaccaagctatgcaaaatccctcagggcttatgggaagaaatggggcacaacactgaaaacttcatcagtgacacattgaaaactagctgggcacggtggctcacgcctgtaatcccagaactttgggaggccaaggtgggcagatcacctgaggtcaggagttcgagaccagccttgccaacatggagaaaccccgtctctactaaaaatacaaaaaaaattagccaggtgtggtggtgggcgcctgtaatcccagctacttgggaggctgaggtaggagaatcacttgaacccaggaggtggaggttgcagtgagccaagatagctccattgcactccaacctgggcaagagagtgagactctgtctcaaaacaacaacaaaaaaaaacaaataacaacaacaacaaaaataatagcagagctttacagatgttaagtcattaagaaaaacataaaggccaggcacagtggctcacacctgtaatcccagcactttgggaggccaaggagggtggatcacttgaggtcaggagttcaagaccagcctggccaacatggcaaaaccctatctctactaaaaacacaaaaattagctgggtgtggtggcgcatacctgtaatcccagttactcaggaggctgaggcaggagaattgcttgaacccaagaggcggaggttgccgtgagccgagattgcgccaccgcactccagcctgggcgacagagcaagactctgtctcagaaaaaaaaaaaaaaaagaaaagaaaaacataaatactatagtaaatatggcactttcccttgaaaaagacctgaagtttgcttgtggaagtaggtatcagaacagttgcagcttgcgagttattgtgaagcagtggaaggagagttatctgaaatgtagtgggaagttaacaccacatgcagatgtgttatgcatgctgtttgtccaggttttatgtattcctctgtgggctggttcagctgggtgtggttttctgcacttaccagaaacaaacatgaaatttgcatttttctttgggaggccgaggcgagtggatcacttgaggtcaggagttcgaaacccgtctggccaacatggtgaaaccaagtctctactaaaaatacaaaaattagcccggcatggtggcgcatgcctgtaatcccagctactcaagagactgagacacgaaaatcgcttgaacccgggaggtgaaggttgccgtgagctgagggatcacgccactgtactctagcctgggaaaccgagagagactgtctcaaaaaaaaaaaaaaaattgcatttttgctcaaattgctccctaatatatcaatcgctttggaacaaattcacattttcaaaacaagccttacagaagcataagacacagtgtatataccaaattctataatatagacttacaacaggataatttattaaggagactcaaggaggtaggagaggcccagtgaggggcagagacacccctatggttgccagacacttgttccctcttcatttttttcatcttctccattccaagaaggtagctaagtcttatgtaattatttgcctcagaggcatctgcagagccattcatttaatcaatcaataaccattcactgagtccctcctgtgtgccaagtggtgttctgggcacaagaagatagtgcaatgaacaaaaccacaaagactctgtcttcacggagcaagggttgtagtgggagagacagaaaataaacaaatgaatatattatgcaatgttaggcagtgagaagtactactgaaaaataaagagcaggccgggtacaggggctcacgcctataatcctagcactctgggaggccaagatgggaagatcacttgagcccatgcattggagaccagcctgggcaatatagcgaaaccctgtctctacaaaaaatacaaaaagttagctgggtgtggtggagtgtgcctgtattcccaagctacttgggaggctgaggtgaaaggattgctatatggagagagacagagagagacaaagagacagagacagagagagagagaaagaacagacaacgtaactagagagtgactaggagtggagggagaggatgtgactccttttcagggaggggagatttgagcagagatctaaatgaagtgagagagtgggtcacgtgattatttaaggaaagagtgttcacagcaaagagaacagcaagtgcaaaggccctgaagaagaagcaagctcggtgtattcaagagatgtcggctgggcgcagtggctcaagcctgtaaatctcagcactatgggatgccaaggcaggtggatcacgtgaggtcaggagttcgagactagcctggccgacatggcaaaaccccatctctactaaaaatgcaaaaattagccaggcatggttgcacatacctgtagtcccagctactcgggaggctaaggcacgagaattgcttgaacctgggaggtggaggttgtagtgagccaagatcacaccactgcactccagcctgaggaacagagagtgattctgtctcaaaaaaaaaaaaaaaaaaagggatgtcaaggaagccggtgtctgtgtctggaagtgagtgagaggcagagagagcgataggaaatgagattggaggcatagcagggggcctggttacataatgtctgtagattatggtcaggtctgaatttttttctaagtgtaatgggaggtcattggagcattttgagtaggtgagagacatgatctgactgaaatattaaagggctcactctggatcagttccatccaatagaactctggcaatgatgaaaatgcccggtgtctactctgcccagtacggtagccactggccatgtgtggctatctttattattttgagagatgggttcttgctgtgttgcccaggttggcctcaaactcctgagctcaagcaattctccagcattagcccccctagtagctgggactaaaggcatgagccaccacaccttgctgaatatttggctattgagcacttgaaatggtgcaagtatgactttggaaatgaaattttaattaacataaatttattttttatattaaataaacaatttatttttatttaataataaattatttatgaaataataaattatttaatttatttatattaattatagctagccagtgctgttctagatgttgtgcagaaaatagactgaaagggagaaagaatggaagcaggggcacttgtccttcaagttgcctgcttgggtatcttccaagtgttttttgtttttttgtttgtttgttttgtttttgttttgagtcagagtctcactctgtcacccaggctggagcgcgatggcgtggtctcagctcactgcaactttcaactcccaggttcaagcaattctcctgcctcagcctcccaagtagctgggattataggcgcatgccaccacgcctggctaacttttttttttttttttgaaacagagtcttgctctgtcgcctaggctggagtgcagtggcaccatctcagctcgctgcaagctccgcctcccgggttcacgccattctcctgccccagcctcccaggtagctgggactacaggcgcccgccaccacgcccagctaattttttttttttgtatttttagtagagacagggttttgccgtgttagccaggctagtctcgatctcctgacctcgtgatccgcccgcctcggcctcccaaagtgctgggattacaggtgtgagccactgagcctggccaatttttgtattttcagtagagacggggtttcaccatgttggccaggctggtctcgaactcctgactttgtaatccgcccgccttggccttcccaaagtgctgggattataggtgtgagccaccacacccggccgtatcttccaagtgttctaaaaaaaaaaaaaaaaaaaaaaaaaaaaaaaaaaaagagtgaaagcaggaagactagttaggagtacaagaatccaaataacagacaatggggactttgagatgatagcactggagatggtgagaaatgattagattctggatatattttaaaggttagaggcaacaggctaatggacggaattttttttcttttttctgttttcgagacagggtcttgctctgttacccaggctggaatgcagtggcatgatcacggctcactatagcctcagtttcctgggctcaagtgatcctcccacctcagcttcccgagtaactgggattacaggcatgcaccatcatgcccaggtagttttttaattttttgaagagatggggggggggggtctctctatgttgcccaggctggtcttgaactcctgggctcaagtgatccattctcctcggcctcccaaagtgctgagattacagatgtaagccaccgcacacagctggattgaatattattatagtgtataagagagagaaaggaattgaaaatgatgaagtttttggcttgcaactaagtgagtggtggtttcatttcttgtaatgagcgataatggagaatgagctgaaagcttccattttgcattgctccccctacccccagtcccaagctcactgatgagactgtaccagagtcctagagagggcagggagagaggagggtgccctggagggcagccagattgagaagagatctgaagtcaggggtcttttgagctgggcaaaactgaatcccttgacagtgtccctcagcaaaggcaaagagaggctggactcccacaaacccgctgcttcaagtttagctccaaaacagcagagcttcctgatctgattctccagactcagcctcccaagtagctgggattacaggcacccaccatcatgcctggttaatttttgtatttttgtagagatggagtttcaccacattggccaggctggtcttgaactcctgacctcaggtgatccgcccacctcggcttcccaaagtgttggaattccaggagtgagccactgcgcccggctgagaataggtatttggagtcatctttaagagaattcaaagaaaaagaagtgtaggtacttgaaaaggattgtggatgggatgatgtttagacttgatgatgaggggttgatgattcgggggcagaattagtgggtgcttctatggcatagactgtagattctgtgtccagtgaagttcagagctttttctgggaccttctcaaggggtatgacaaatttcttacattcaggttattctataaacatgttagaaataatctttaactttctgtgtgggtgtcacacactggaggatgtctatgtcaaggcaaagataataaatacctctctctagcagtaggtaaaatagagaatgtgggaaatctgggtttgaatcccagatccttcccatactacctgtgtgatttgggacaatcacctcagttaattaattacttctttctgagcctcaatttactcattcacaaaatgggagctcacaggttttcaatgagaactaaataatatattaaaatatcatcggcagcgcctgacatatagtaagagctcagtaaatgctaatttgcttccctatggaattgaacaaagctgctcctagtggctttggtccagaaccttcttcgatatgctgcccaatgtctcctctggttttgacctggattctccactgtttgctcagattccttcatggctttttctcccttgcattaattctaagcacctgcttgttattaaagtaaaatcctctctttgcctagtccctgtgatctgaaaaagcatctgtaaatagaaggtatgccccctatgacacagcactattggcattttgctcttttttttttttttttttttgtgacggagtttcactcttgttgcccaggctggagtacaatggcgcaatctcagctcaccgcagcctccacctcccaggttccagcgattttcctgcctcagtttaccaagtagctgggaatacaggtgcccaccaccacgtctggctaattttttgtattttttttagtagagacagggtttccccacgttgggcagcctggtctcaaactcctgacctcaggtgatccgccagcctcagcctcccaaggtgctgggattacaggcgtgagctaccaccccctgcctggcattttgctcttcaagggttaataatggtcagggctgtacctttagaaaactcagccagcagggctcaccagaaataattgcaatagcagggacgcagggaggtggggctgagaggatgtggggtgggtattgaagaaggcctgcagagcaggacagtgagcctctgtagggagaatggtatattccagggggaaaaaatgacgggccattggaaacccctggccatgagaggtagcagcggtttggcttcaacctggcccctttccaagaccacattcttattgctgatcccttgctggtcagcaagagcccctgagaggacttgctgtgataatttggtgccagatcatgcttcagttgcaatttatttaaagttgacaatagggttcctgtcttttacaagcagattccctgcccttgaatgtctgcaggctggattttttgccttgatgaaaaggtagttaaatttcacacttattatagcacctggcacctgacatcttccagagactttataaagactaatgaaatgaaaccctcagcgctattgtaaacagggaagaagagagagcagactcatatcctctctctgcaggaaacaaagaactaaacctgcctcatctccaccccaccagtggacccattttttttaggctaatcttcaaagggctactgactggttatcagacaggtcatggctcagagcatctttggagagcaggatctgcctgaaaaatgggtcaataaggcaccagcatacaggtctgcgctgctggagatgaggcctccagacccagagattctgttccagcttttttcactcagcatcagacatcaaccagtcagggaagctggaccgatctttgccaatgtccccaggaattgaagtgtgtgagcgtgtctgccctgtgatgagaaggtgagtgcagaatttggggtatggtttaaatgaggaaaagtacaacagtatgattccctcccccaacccagttagtcccttcaccccatcctttattgtgtctgtagtgggaaagatggagtttacagtcaaacagacctgcgtgcaaattgtcctgtcacttgccttaaaacttaatttctccaagtctcagtttccacatctgtacaatgggaataataatactgctatgattacctatggttgtgcaacaatctcaaacttagtggcattaggggaaaaaaaaaaatgggctgggtgcagtggctcacgcccataatctccacaccttgggaggccaaggcgggaggattgcttgaggccaggagttcaagaccagcctgggcaatatggggagaccctgtctctacaaaaaataaaaaaatttaaaaaatttatcgtgctcacagattctatgggtcagtaatttggacgcggtacaatggcaattcctgaagcccctggttcatgatgtctggggctttagctggcatacctgagagggtgggtgtctttaatggctggaattaactggaggctttttcatttgcatgtctggtgcttgggctaggatgacttgaaactgggctcaactgggactgccaaccaaagcatttctatatggcctctgcacacagctggggcttcctcaaagcatggtaacctttgggacttcttacatggtgacttcaggttccaagagtgagtgtcacagccaacaaggcaggaacttcatggccttttataccctggccttgggagtcacatgtcatcatttccaccatcctctataggcaaagatgtcaccaacctgtacagattcaaggaaagaggacatagaattggcccccacttcttgatgagagaagggtcaaaaaatttgaagccatgttttatttttatgtatttatttatttttgagacagctctgtcaccaaggctggagtgtagtggcgtgatctcggctcactgcaacctccgcctcctgggttcaagtgattctcctgcttcaacctcctgagtagctgggattacaggtgcctaccaccatgcccagctaatttttcgtatttttagtagagatggggtttcaccatgttggccaggctggtctcgaactcctgacatcaagtgatctgcccaccttggactcccaaagtgctgggattacaggcgtgagccaccatgcctggcctgaagccatattttaaaactaccaccaggccaggagcatttggctcctatattataatgcctataatctcagcactttgggaggctgaggtgggcagactgcttgagcctgggagtttaagaccaggctgggcaacatggcaaaaccccatctctacaaaaaaaaaacaagaagttagccaatcgtgacagctcgcacctgtggtcccagctatttgggaggctgaaatgggaggatcatttaagcccaggaggccaaagctgcagtgatccatgattgtgccattgcactccagcctgggcaacagactgagatcctgtctcaaaaaaacaaaaaataaaaaaaaggctgagtgtggttgtggcggctcatgcctgcaatcccctgtaatcccagcactttggtaggctgaggcaggggaatcacttgaggccaggagttcaagaccagcctgggcaacaaagtgggactccatctctacaaaaaaaaaaaaaaaaaaagataaaactgtcctcaattccttcttccttcacttggttcttgtgaagaataagagaaataataatcttatacataaaagcgtttcagtaaatattattctgaatcctcccaactccttcaggcctttcagatcaatttgtactcactccaaaggagcagaacacaatcaatgatgcccaaaataactaaaactggttctcgcttttctgccttatcttctaccctgaattatcataaagtctggagaaatgatcccctcaatgccaaatcttagggtggtgacttggggtacgtaggtggtttaatatcccttgagaattttcagagctgcttctcaggacagaaaattaaaatgaaaaggggaagccaaactctagagcttgaaccccctgctgagagactccagtcctatgatttggttctaagcatgccaagtcctgtgctacagcacaaagatggctctgcactgagtgtgtatctcatcctgacctctgaggacgccaccctgggaagtgtttgtgaagctccaatggaaaaagcagtccaatgaggcagagcgactgaatcagagcagggcaagaaagctgccaagcttggaccccactcagagaacacaaattccaggtttaaaatcaaactccaacagtttttggggtctaagttgcatttattcttggcaagctcacttcttttgttcacagagagagtagaagctttaaggggctccaagaaagacctctcacatcgaatcactctcacaaagccacagggaattggggagtgtaaatgaatcaggaaattatggcttcttttttcctttgaattgtataagggaacataaattaaggagaaaaactgccaagagaaagaaaaagtatgcagtgtttcagccaacttcgagctttgaaagcagcttcagaaccatgctgtaacactttctgttgggcctaccaagaaatgctggtgagcaggtgaacaaagagatctgtaggaggcaagcagcaaggccctgcctattgaggggaagggcatatggtaaaggcagtgtattagttgtctattgctatgtaacatagtaccccaaaatgaagaaacttaaaacagtacactttttttttttttttgagacagagtctcattctattggcagactggagtacagtggcacgatctcagctcactgcaatctccgcctcccagattcaatcaattctcctgcctcagcctcccgagtagctgggactacagttgcatgccaccacacccagctaattttcgtatttttagtagagacggggtttcaccatgttggccaggatgtctcgatctcttgacctcgtgatccacccgcctcggcctcccaaagtgctgggattacaggcgtgagccaccgcgcctggccaaaacagtacacatttattatctcacacagtttctgagggccagaaattgaggagcagggccgggtatggtggctcacccctgtagtcccagcgctttgggaggcagaggtgggaagaccatctgaggtaaggaattcaagaccagcctggccaacatggtgaatccctgtctctactaaaaatacaaaattagcccggcatggtggtgggcacctgtaatcccagctagtcaggaggctgaggcaggagaatcacttgaacctgggtggtggaggttgcagtgagctgagatcatgccattgcactccagcctgggcaacaagagtgaacctccatcccaaaaaaaaaaaaaagaaagaaagaaagaaaaaaagaaattggggagcagcttagcaagatggttctgacacagggtctctcaagaggtttcattgcctggggctgcagtcacacaaacacctggggcgctgcctgagggctttgttctggccacaggaacacacctggcctctctacaaagggaaaggagggagtgccagagagtgaatggctcaactcaggaagcagctcccaatcaatgacagaagtgtatgtgtgtgcatacacatgttgttgggggagtggggggtgttggtgttggtgttggtggataaatgcccccgcttcagcagtcatctgaaggcttgactggggctggagggtctacttctaagacgagtcactgacatggctgtttactgcaagtctcagtttctctatagaggtacttgatatggcaactgatgagagagagagactgagactgagaagagagagcccaagacagaagctgcaaagtcttttttttttttgagacggagttttgctctgtcacccaggctggagtgcagtggtgcgatctcagctcactgcaagctccacctcccaggttcacgccattctcctgcttcagcttcctgagtagctgggactacaggcgcctgccatcacgcccggctaattttttgtatttttagtagagacggagtttcaccatattagccaggatggtgtcgatctcctcacctcgtgatccacccaccttggcctcccaaagtgctgggattagaggcgtgagccatcacacctggcctgcagcgtcttttataacctaatctcagaagcgaaataccattacttctgctatgttctatattggtcacatagatcaactctggcacagtgtgggaaggaactacaccagatgtggataccaggaggtgaagattgttggaggctggatacaatagatgggtagaggcacagaaaccaggaggataggtggccctaggctcctcctccgaatgcttactggttcagagaagggcagccttcctgtgatctctaccccatctctctcttctccatccctgatgggctgtagactctctgaggacagggactgtgtgactgtgtctgtcttattaactactgttcccctagggctggtccatgcctggtatatagtaaagccctcaatacatgttggttgattcgtgaggtgcgtaggaaagacagaagtagatgagatagaaacagtaaatcggattaaggtattgagttccaggctcagggcttggactttgtatcctggatgacaggaaggcattgggcgggggcccccttagaccctggataagagctggctgttgctcttcctctgcctgcaacattctccctttagatctactgtccatcattcaaggagggttactgacagaacaacatcttggaggaagtaggatgtgtgtgtctgtgtgtgcaaaagctcacgtggaagggaaaggttccaagctcaaagcaaaggaaaaagaaatggggggagatgtgaaggcattttgagatggggaggagggacatttgagggcaacagggacaagagaaaggagagagggtaaggaatatttgtgcttatctaccgggagtaatgaggaaaaggggagatagcttagtgagggactgtttagcttcaagggatagaaacccactcaaactggctcaagttaaagggtgcaagttggaaggctacaggggtttgtagcagatgttgttgcctcacttaaatcttcttagtcctcacctctctacccagagactgatcacgcaaacacctggggcgctgcctgagggctttgttctggccacaggaacacacctggcctctctacaaagggaaagtagggagtgccagtgagtgaatggctcagctcaagaagcagcttccaatcaatgacagaagtgtatgtgtgtgcatacacacgttgttggtggggggtgaggggtgttggtgttggtggataaatgccccagcttcctcacccctcagttgctcagttgggatagccctgatgcatgttcctcattgtcttctagggcccccacccccagcagtccttgcagtgagttaatatacaccacttagtggtttccttctcttttatttttttattttttgagacaaggtctcgctctgtcacccaggctggagtacaatggcgcgatctcggctcactgcaacccccgcctcccaggctgaagcaattctcctacctcagcctctcgagtagctgggactataggcgcatgccactgtgcctggctaattgtttgtatttttagtagagattgggtttcaccatgttgcccaggctggtgttgaactcctgacctcaggctacctgcccgccttggcctcccaaagtgctgggattacaggtgtgagccacgcgcctggcccaacatttggataagaaagagaagagcattccggttagtgagaacagtacatagcccgacctgcccttctctttttatttcttacttcctcactcccctaccaatgtttcctggaatcacctcctaaataaactatttgcacttgaacccctgtttcaggataccccaaaccaagacagatgtctcacaaaacacaagcagagatgtcagtcttcaggcctcgcatggagaagatgaaagagaggggtggcttttccaaagcccagcgtcagcacgaagcttccacgagatgattttccctcttattttgaagtcctggtgagtccctctcttctctccattttaacaaaatctgctttctaattgcccagtttggtatatgctatggtccccactttgtcatcaacgctcctgaactcatcttatgcccgatgtacccgaaagcacttcataaactgtaaagtgctgaacaaatggagcaggtgagaaagagggggagaagaagaaaaagaagggaagaagaaagagacaggaagaagaagaaaaacaagtggaaggaagatggaaggctaaaaagcagaaatatagtgcagagtcagatgaagaaagccagggcaggcaggggaggcaggttgaagaaaatggccagcacttttgtaggaagccagtgttgaaaacaggcctgtgaggccaggcacggtggctcatgcctgaaatcctagcaatttgggaggccaaggctggtggaccacctgaggtcaggagttcgagaccagactggccaacatgaggaaaccccgtctctactaaaaatacaaaaattaactgggcaagccaggtgcggtggctcatgcctgtaatcccagcactttgggaggccgaggcacgtggatcacaaggtcaggagtttgagatgagcctggccaacacagtgaaacccagtctctactaaaaatacaaaaattggctgggcgtggtggcgcgcgcctgtagtcccagctgatcgggaggctgaggcaggagaatcatctgaacccgggaggcagaggttgcagtgaaccaagatggtgccactgcactccagcctgggtgacaacagcaaaactctatctcaaaaaaaaagaaggcaggcctgtgaaaagcagatgcggggctctgcttggagccagttcttcagctctccttgacttcatttgaagtaagcccttccactaggctggtatatggcagactggagtagcagagatgatgcccagatgcccacaactctcctgggcgttgtgcaagagcattgtttcttcatttccctcttttgtttctgtatccactggcaactggcagggacaggcactgacagtctggctcagagggcccgcagggctgagacatgtgctctcctgggtatgtggttctcagagcacttggacacccctagcaaccctcccacctcccattatagaacaccagacacacaagatctgatttcttcagggctgaaatactggatgtgggtacagtaggtgagagccggctgggggtatggtgagggtggccttgaattgaaatgtcagcaaggccaaccttgccttctgggctttctggggagataaggccaggactgcaaatgtgatcagccaaagaatgcagggttggctggggacaaaagtgccccccggccctttccccaagaggagactttgtgcttcccgccttccaggaatcctccagtcaggggagctggacctgaggaaaaaggtggggtttgctgttcctgcaggttgggaggcagagtcacaaaagaaacaagcctggggagagagggaaaagggtccaaaccacagagcaagaccatgttagtgtggggagcgcatctttgttgcattcattcacgtgtgcatgcattcataacttcatttactagctggcacgcaagaaatgcctacaaggtgccagaccctctgccaagttctgagcctgcccagatgcacagagcttcctgacttggtgtcagattgctgccctggggatagctgggcctcctgctgtggtgaaaccagtttttctattctctgaggggcaaattactattgcttaggcacaggaggtgctccctctggaggagagtgagcttacagggtaggcggcctggggagaaggtgtggctcacttttcacgctcagtccccacattcccctgtgccagggagggtgttcctttttacttgggtgatctgccttagagcttctgcagttctccactccacagaatgggagggacttgcaggatgacgcagtccgcccaccttccatcctttctctttcctttccttccagtatttactgaatgtctgccgagaccctggcacgttactaggtgcctgccttgaagccatttaggagaaatggcgttctccaaacaaaagtattccgttgccattcacgtttctctctctccccctctctggccacatggagctgggcagaggtgtttttttttccttttctctttttctctgtctctgcttgtttctctgagaagataaaagctggcctttggctccccgctaggggacaggcccattacagccctctgttcctttccctgctttctctgacactgtgaggctgagacacagtgagtcctgctcagctgggcctgtgttcatcccattagcattgtggccacttcagggcctctgggattgagttctctggagccagaacagtttcataacccctagaggaggccaaagtcgtcccagccttctgggtccaaaggttctctcccatgtggctcctgcctcaataacctacctccattttttttttttagtttgtttctgcctcaggcacattttctctgtaatttttggaacccaaatataagggaaatctcatttgctccgttctgactcatttacaattaaatacacttgttcccatctgtgtctgtatacatctgcatatatttgctaaagcatcgcccttaattttggaaaatgaggcggctggtgttatttttatcctgactgccaagttggctgagaagaccagtgggtgttcacccacccagtgacgacccctggccaggcctgtgcctgagggaggtggtgacatttctcccatgcatagaacatgcagacccctggacagttgtggccttcgtgattgctgtctttaggggtccagttaccatgactaggcgtgttcctgtccatctcggtgccgaggcttcactgaccacagagatgggccatgactctcttgtcttttttacacagtttcaatctgtcacctaggctggagtacagtggcacaatcatggctccctgtagcttcaaactcctgagctcaaacaatcctcctgccttagcctcccaagtagctagaaccacaggcatgcaccagcatggctggctaatttttaaattttttgtagagacagagtctcactatgttgcccaggctagtcttgaactcctggcctcaagcaatcctcccaccttggcctcccaaagcactgggattccaggcataagctaccacgcctggctgagcctggactctccatgtcactttctggcagctgctttgacaagcatgggctttggagatgagagtggggggctggctgatcctcaaggaaggcttcactgaggaagcaatgccaggtcatcacagccccatcccctccaaggccaggagaagagaagagatgtctttactgttcagaaggatgtggtggcatgtgtgggcgcctgcctcacctacgtacctaaaaataccatactgtggttgtctacctctttttttttttttaaatcgagttacactgtaaagatattcacatttaatgagatggtggtgcctgtcagcacacttagaacccttttgatattatcattgaatacttttatttatgcccaggtgctaaaatagaacttggccaacaagaattacaggatgcagaaaataaaatgtctactcctgacaataaaaaaaaaagttaacatcaaaacaatactggaaacaacacttacttcctgctgacctacaaccttctcttgaaaattctgtgatgggcagtgctgctgctgacattgataaataattcagattgattcagggaaatgctgggcttttacattttttctgcaccacttccaagatgctagactccatacttcatgttgaaccaaccgcactcctgagaagagatggcttagaatgatcccaggattgtccaaagtgtcttcctcttacctgaggtctctttagagaaccagtgatgccatgggcactagtcacaactgagggtccttgttgtacgtggctttgtcttgggcctatgaactccacaagggtagagaagctaccatttctgcccttagagagcttaattcttggctgatatttccagtctaagcctgtggatcaattagctcctctcctcccctggagggtgtgtaagtatctgctttttccattcatagcctctgcccaagagttcttgactggttaaagtcttatcccttgctcagtctgagtggctgctacaaacacacacacacgtactcaatcatacgcgcagagtcagtaatcgtgtttggtggttgtagatagagtcatctgctccttgagcaaccaagcctattgtacatggcccctatgcctaggttctagcttgacaatgtctctcgtaaattttcctctttttccttactaactcctagctgttcctcaagatttaaacactacaatttaaacatcactttctccaggaaaccagattgcgctgggtggccctcctctcctctcagtctacacagcagtgttttgtaattgactggagatgtgtgttgatagccaccactaaagtgtatgttttccattgacaaaggctgtgtttatcttgtattccttgtgctgaatagtgtttgttaaatgaagtggatgaattaatgcactcctaaattaggtcagtttatgaaatccgagctctacagagtcaactgtacccaattaatactatgagagtagccagtttcctgaaaaagaaagatatactggatatgtacacataaacatctacagagatgcaccccaaaatgaaaatctagggtaatggaataacaggtgaatttaattttcttctttctccttatctatgttttctaaattttctatattgaaatagctacatatctacatgtatacaaatatgtacgctaggtagcaaaagaaattttaaaaagaatatatgatccacgattattctatataactatcttaaattgtttttacaaatttaaatacatcttcctttttccaagaataataatgataaataatatttattaagaggctgttgtggccaggcgtggtggctcatgcctataatcccagcactttgagaggctgaagcgggtagatcacctgaggtcaggagttcgagaccagcctgaccaacgtggtgaaaccccgtctctactaaaaaaatacaaaaattagccaggtgtggtggcgtgggcctgtaatcccagctactcaggaggctgaggcaggagaatcacttgaacccaggagtccaaggttgcagtgagccgatcgatcgcaccactgcattccagcttgggtgacagagcaagattccgtctccaaaaaaaaaaacagaggctgtcatgtcagtacagtcctctaagaaacaaacactaagctgagtttaggcatgcaagacattaatggggctgggtgtggtggctcacgcctgtaatcccagcactttgggaggccgaagcgggtggatcacctgaggtcaggagttcgagaccagcctggccaacatggtgaaaccccatctctactaaaaatacaaaaaagccggacatgagagcgggtgcctgtaattccagctagtggagaggctgaggcaggagaatcgcttgaacccaggagtcggaggttgcagtgagccgggatcatgccactgaactccagcctgggcaacagagtgagactctgtctcaaggaaaaaaaaaaaaaagaggctgtcatgtccatacagtcctctgagaaacagacaccaagctgggtttaggcatgcaagacattaacaagggaacatctgtgaaggataaaagaggaggagcaggaaaaggtggtgagagctttctgactgtgatgcaggcgtgacaatctgtaaaaggaggtggagaatgagggaggataggtaggaggaacgtcagactgaagtgacgttctgaaaaagtctcagccaggctgatagagagtccttgagcaaaggttgcccaccagatgaatggataaacaaagtgtggtgtacacatgccatgtaatattattctgtctttattttactatttatttatttatttatttattttgagacaaagtcttactcttgtcccctaggctgaagtgcaatggtgtgatcttggctcactgcaacctccacctcctgggttcaagtgattctcctgcctcagcctcccgagtagctgggattacagctgccttgccaccacgcccagctaatttttgtatttttagtagaatggggtttcaccatgttggccaggctggtctcaaactccttatctcaggtgatccgcccgcctcagcctcccaaagtgctgggattacaggcgtgagccaccgcgcccggcctattctgtctttaataggaaggaaattctaagacacgctacaacgtggatgagccttgaaggcattatgctaagtgaaatgagccagtcacaaaaggacaaatactgcatgattccactgatatgagatatctagagtagtcaaattcatagagaaaaagtataatccagcttggccgacatggcgaaaccccgtctctacgaaaaatacaaaaattagccaggccatggtggcgggcacctataatcccagctacttgggaggctgaggcaggaaaatctcttgaacctggcgggtggaggttgcagtgagctgagattgtgccactgaactccagcctgggcgaaagagtgaggctctgtctcaaaacaaaaacaaaaacaaaacaaaacaaacaaagtacaatcgtgtttgctaggggtaggggaggagactaatagagagttactgttttttgttgttgttgttgttgttttcgagatggagtttcactcttgttgcccaggctggagtacaatggggcaatctcggctcaccgcaacttctgcctcccaggttcaagtgattctcctgcctcagcctcccgagtaggtgggattacaggcatgtgccaccacacccggctaattttgtgtttttagcagagacggggtttctccatgttggttggtcaggctggtctcgaactcccgacctcaggtgatctgcccgcctcggccgcgcaaagtgctgggattacacgtgtgagccaccatgctcagctgagttattgtttaatggatatggagtttcagtttgggaagatgaaaaagttgttgagatggatggtggatggtggtaattgcacaatttgaatatacttaatgccactgaactgtatatttaaaagtagttaaatagttggttttatgttatatatattttagcacatacacaaaaagtgctgcttattggaagatctcatgttaggcaggagtggtctaactctggtactccaccgtgctcagttattggctgacagcggctcaggggaagagtgtagcctttatgtgaatgctgtgataaattccaaggtcagtcaactctgcacagcggttctctcaaagggaaatgtgagcagtgcacttctatagttgccatggttgtgtagtataatggttaaaaggttggcctctggactcaggttgcctgggttcaacaccctgcgctggcactttctgtctgtgactatggtgaaattatgcaacttccctgtgccttacttactttatctataaaacaggggtgatgatgctagtatctaccttgtagaattattacatacatgaacgaatttgtgaatgttcctagcatgttgcctgtcaggccaggtgcaatggctcacgccttgtagtcccagcactttgggaggccgaggcaggccgattacctgaggccaggagttcgagaccagcctggccaacatggtgaaactctgtctctaccaaaaataaaaaagtagctgtgtgtggtggtgcacacctgtaatcctaactactcaggaggctgaggcttaggcaagaaaactgcttgaaccaaggaagtggaggttgcagtgagccagcctgggtgacagagcgagactcagtctaaaaaaaaagaagaatgtatcccgtcataaagtatgctgcatgtaaggatttggttagtatcactgtaaagcattttttgtgtatagacaatgtgataacgtgataatgttttacagagattacttcaaaagagcctcctcaaaaccctttaattcatgtaataatttctccatttagaaagggggaaactgaggcttggtggaccacacagccagtaagaagtagagtcctgaggtcacagatggcccaacttgagggtccagctcaactgctgggcaatgcaacatcctgatcagccctttgcctgtgacactggctccggctccattatctttgtgttttgttttatttgtttgtttgagatggagtctcacactgtcacccaggctggagtgcagtggcaaaaccttgattcactgcaacctccgcctccagggttcaagcaatcctcccacctcagcctcctgagtagccaggattgtaggcacccgccaccacgcccagctactttttttgtatttttagtagaggcagggtttcaccatattagccaggctggtctccaactcctgacctcaagtgatcttcccacctcggcctcccaaagtgctgggattacaggcatgagccaccgcgcctggcctggctccattctaaggtaagagttccctctggacctggtcttcagggacatcttcatcatcatcattatcaaaattgccatcatcctcagcatcatcagcatcagcatcatccaaaatggctttattaaaagcaactaattacacattctgctgttctatattttagacaacaataattacacagacttcgaggagtttagcaactgaaagttggatgagcctgttaagggctcccaagtagcataataaagacacagctattaagctattgagtcttagagaggtccagcagcctgcccaactagacaccaacaggagtttctctgagactgacagataggctgaaacctacgttccttgcccctaggccccagtgagataaggatagaggacgtgcttggtggagtggggagcactttgcaaacttcagctggcacttttctgggcctctttgatagatcctgccagagttgatagtgagaatgcttctatacttctcacccagtaattaactgctctcttccacttggcagtaggcagatagtgagaagcagggtctttttggccacatccacctctttttgctcttaattttgagaatttaatatggtgttattttcctggtttggcctataggaaggggttgcctctctgctgtaggcttaaggtttatgacagctcttcctaccattgctataaaaatgactagtgtcctaatccatgtttctctgaaccacatcttggtatttggtcaaccgacaaacattagtgaagcacctgctgtgtgctggttattgtgttgtgtgctgggcgtcaggaagcgaaaggatgtcttcctgcagcttacagacaggtgatacagatgtcagataaacatgtcattgcagttcagtgagatgagccttgacagaggtatgtgctaggattgaatatgtgggagaagttcagaatccggaataaaagggagaataagcataggagcaaggaggtgggtgctgaggagagaaggagagacagtccaggctgaaggaagtagtggcctcaattactgaggcaggtctaaagacctccatccctccaaagctcagggagcaaggacaggatggaagggaatgaggctgcaaatataggctaggaccaatccttcgttcattcagcacctacaatgtgccacacgttgttctagatactggggataaaacagtgaacaagacagacaaagcctctgctatcaggccacatcctggaagacgaagaccaataagcaactggacaaacagataattttataatggtgatgtgctatgaagaaaatacaatagggtgatgggaaggagagcaactattcagataccttagactgggtggtcaggaaaggcattttgaggaaggtgacatttgatttgagacctgaatgcaaagaagatactgccacaggaagatctaggggaagaaccctataggcaggtggacagctggtggaaagaagcagctcccaaagggccctgcaggccacactgcattgttgagattcatcttataaaaatgggaagccatgggggacagaggacctgcctagaccacgttttagaaagcttaccctggtctcctgagcttcagcctcagtggagacacaggtccctggaagggcagagcagtcggaagacaatgcccagcacccggtggaaaaaaagtctatgggctgggcacggtggctcacgcctgtaatctcagcactttgggaggctgaggtgagtggatcatgaggtcaggagatcaagaccatcctggccaacatggtgaaaccccgtctctactaaaagtacaaaatttagctgggcgtggtggcgcatgcctgtaatcccagctacttggcaggttgaggcaggagaattgcttgaaccagggagtcggaggttgcagtgagcctagatcgcgccactgcactccagcctggtgacagagggagactgcgtctcaaaaaaaaagaaaggactgctgggggtgaatgatagtagtcaggggtgtcatggcctcaccctaagcaaattattgaaggacctttgataactaaagagaccttgcattgtggtgcaacattatgctccattaggcagaggaaactggagtccctggcatgcccagtcctggagtcaacgatgggttgttgctcagtacaacaagcagatgcctccaaattcagggctcttgctgttccaggcctgggccctggacagtgaggagaggcagtaatggggtggccagtgtcatttgccaaacgggtcctcacccatctcaaaaaaaatcccaaaaggaattttctgagggcataacgcccactctcagtagaattgccatgctggataaagtgtggcatcgtgtgggggcttagcccagcctcctctctgcggccagagcagtctctaatgctccatctgaccaggtcactctcctgcttgaactccttcagctattccttactgcccttagcatgcccttcttagcatgttaggattttgatccaggtgatttctccattctgaccacatctcccactctacagcccagcttattgaaccactttttttttttttttatgatggagtcttgctctgtcgcccaggctggagtgcagtggcatgatctccgctcactgcaagctccgcctcccaggttcacgccattctcctgcctcagcctcttgagtagctgggactacaggcacgcaccaccacgcctggctaatttttttgtatttttagtagagacggggtttcactgtgttagcgaggatggtctcgatctcctgacctcgtgatctgcccgcctcggcctcccaaagtgctgggattacaggcatgagccactgcacctggtctgaaccacttgtttttccttccaatccactatgttctgttgcctccatgcttttttttttttttttttttttttgtacagggccttgctctgtcacccgggctggaatgcaatggtgccaccatggttcactacagcctcgacttccctcccacctcagtttcctgggtagctgggaccacaggtgcacgccaccatgcccagcttctttttttttttcaattttttttttttttttttggtagagacagggtttcactatgtcatccaggttggtcttgaattcctgggctcaaacggtccacccatcttggcctcccacagtgctgggattacaggtgtgagccaccacacccagctgcctgtgtgcctttgcacaagctatctgctgctctggaatgctttccttccaccccagctcctcctcagctggctcactcctactcatccttctggactcagcttagatgctggaaagtctttcctgacccacagagttggagctgggctggagctcaatgggtccacagcactcttcccctctctctctctctttttttttctcccgaatccctgatatgatagtacccctctcttttacctactcaactacttacatgcaacccgtcttcaggcatcagctcaaacagcttctcctgagtcatcttagactacactaggcccccctcttacactctatttccttccttccttccttccttcctttccttcctttcttttttttttttttttgacagagtcttgctctgtcacccaggctggagtgcagtggtgcaatctcagctcagtgcaacctctgcctcccaggttcaagcgagtttcctgcctcagcctcccgagtagctgggattacagctgcctgccaccatgcccagataattttttttttttttgtatttttagtagagatggggtttcatcatgttggccaggctggtcttgaactcctgacctcaagtgatccacctgccttggtctcccaaagtgctgggattacaggcgtgagccatcatgcctggcctgttatttttctttcataactcatatgacaataggtaatgataggtctgtaagagcatttcattaatgtctgtctcccacactactctgtaaacactgtaggtggatgtgtcttgtctgcttaggtcaccattgggtcccaagagtttggcacataaatatttactaaacgaataaatgaatgaattcctctgggttcccataacatatggatatttcccctagcaccatacttagctcattacaagggcccatgttcttctttgtctccccagctgacctataagctccttgagtggcgggatgatattttgccagtgtgacttgccagtgcttgtcccattgcttagcaattaggcactcaaagaatatttttgcatagatgaataaatgaataaatgatgataggccaggcgcggtggctcatgcctataatcccagtgccttgggagatggaggtgggtcgatcccttaagcccaggagtttcagaacagcctgggcaacatggtaaaacctgtctctataaaaacacaaaaatttaccttagggtgtggtggcatgcacctgtagtcccagctccttgggaggctgagttggtaggacctcttgagctcttgagcccaggtgctagaggttgcagtgagccatgattgcgccactgcactgcagcctgggtgacaaagtgagaccctgtttttgaagaaaaaaaaaaaaagatgacaggcattcactcatgttctcttatactttatactttattctttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttttttgtatttttagtagagacggggtttcaccgtgttagccaggatggtctcgatctcctgacctcgtgatccgcccgcctcggcctcccaaagtgctgggattacaggcgtgagccaccgcgcccggcctatactttattctttatacagcaaagtggtcttaaaaaacacaggccaagttcgtgcggtggctcacgcctgtaatcccagcactttgggaggccaagaggggcggatcacttgagtccaggagttcaagaccagcctgggcaacatggtgaaaccctgtctctacaaaaaaatacaaaaattagctgggcatggtggtgcatgtctgtagtcccagctacacaggaggctgaggtaggaggattgctttagcccaggaggttgaggctgcagtaagccgtgattgtgccactccactccaccctgggtgacagagcagagtgtacatttcatgaaggctgttcaccactgtatctcctggctcagtacaatgcacagcacatagtaggtgctccaaaatatttgttgactgggtcaacaaatgaatgaatgaatatgataatagctttttgtgatagagggcaggtgctgccagacttgcaggcagacagaagagtgatttattgtgcttaaagaaaaagagaaactggactgctaagaactgatggagggagccaggaaggaatctaggtttgccagactccactgtgagctcatggaatctgggaatcccagggccagctcatgccacctgactccagtcaacccataatgaaattcagtatgcaaaaaccaaaaccaaaggctgggctggcttctactttaagtccacctgtattcagagtgtccatacagggatctacgggggcatgtaaagattcctggcagatgtacctctttgctctgttccagaaggttttctttttctccaagtgtcttggaattcacaagagattgttgttaggcaacagaaacaatgaaagaagacaggtgactcattcaccaatacatctgaaatctaaaatgtattaatttaatttggtttatattaccatgagacaattcttattttgatagcacatttcctacccctataaaaatctaaaaatgccacacaaaaaaagaatttttacaatggtgaatacaaagagccaggtttccaaaataaagcccactgatactttaaagagaagaagaaaaacacatacctcctcctccaaccctctctcctttaaaactatttcttttcagatataattttgcttggttgtcacagtctttaacgtttcccccctaggttctttttctcctttgttatcaacaaaaatatgagcatgaaaggggcgggaagtgtttgtttttatgtacacatctttgatcatatcagaaagggaagaatcatgaacacccactgctgactgattttaagaactaaatcttgattctagtttctacagggaagatgaataacatgaataaagagaagcttacacatctttcataagtgtcaagggcctaagtttggttctttttatttaaaatttaactcactgggtaaagccaatggcatcctctgttagaagaggcctgaaagggatgcaagtgaagccctcgtcctgggaccccctaactccccaaacagccccacctgtcagaccgcttgaagctgtgcaaaaagacaagacgtatatagcataaaaacgaggcatttaaatcacctccattatggtatcgtcttgacaggaaaactattttgaatgtggcttttcaagaaagatttttaaaaacccattgacatttcagaggctaagtgggagtggttaagagcatggttctgggctgggcgcagtgactcacacctgtaatcccagctctttgaaaggctgaggtgggtggatcacaaggtcagaagttcaagaccagcctggccaatgtggtgaaaccctgtctatactaaaatacaaaaattagctgggtgtggtggcaggtgcctgtaatcccagctactcgggaggctgaggcaggagaatggcgtgaacccgggaggcagaggttgcagtgagctgagatcgcgctccagcctgggtgacagagcaagacttcatctcgaaaaaacaacaacaactaaaaaagagggtggttctggattctggcagatctgggccccagcactgccacataatctcagcatgacctaagtctctgttttcttatttatagaatgaggaatacaacattaactactgtaggattgttgagaggcctggatgaaatatgaagcactttgcctggagcagtggctcttgcctgtaatcccagcactttgggaggccgaggtgggcggatcacgaggtcaggagatcgagaccatcctggccaacatggtgaaaccctatccctactaaaatacaaaaaaaaaattagccaagtgtggtggcgtgagcctgtagtcccagctactcaggaggccgaggcaggggaattgcttgaacctgggaggcggaggttgcagtgagccgagatcgcgccactgcactccagcctggtgacagagcaagactctgtctcaaaaaaaataaaataaaaaataaagaaatatgaagcatttagcacagagcctggcatacatcaaagacttagtaaatatgaactattattatttttactcatcgagtgtgttaattattgtatgagcaaatgaattaataagttttaggtatacatgactttgttttctgctcaggcttatattaggtatcagtgattctcaactccggctgcacattagaatcacccagggagattttttaaaatgctaagttcctactgaagaacaattgaatctgagtcctgggggtggtgcctgagtatcatattttttaaaagctctccaggtgattcttgtgtgctgccagagttgagaattactgggctctacagaaatgaggaaatcctctgatgttaactaaaccaacagacaaaactagggtgggcaggcctcccctgcttttctcccactcatctgaaaataaactgaaaggcaaccagggccatcaggcattggctaaccctgatgtggcccacactttggttttaccttttgtttttactgactcttgtctaaatctaactccttttgctggctttcctcaggctaaaccaagagtccctttaactttttctatggaacttaattggcggagggggtgctcaccacttcgtggccacgagtaaagattttccaatcttcattacaaagctgccaagtcagctcttgtcttcatcattccgacatctttactcattttagttctacctttctttttttgttttgtttttttttgttttttgtgatggggtcccctctattgcccaggctgggggagtgcagtggcgccatcctggctcactacaacctccgcctcccaggttcaagtgatttctgcctcagcctcctgagtagctaggactacagacgtgcgccaccactcccagctaatttttgtttgtttgtttgtttagtagagacaggctttcaccatgttagccagggtggtctggaactcccgccctcaagtggtctgcctgcttccacctcccaaagtgctgggattacaggcatgaaccatcttacccggccagccggcctgcctgcctgcctgccttccttccttccttccttccttcttccctcccttcctcttcctctctctctctctctctctctctctctctctctctctctctctctctctctttctttctttctttctttctgacagagtcttggtctgttacccaggctggagtgcagtgacggggtttcaccttgttagccaggatggtctcagtctcctgacctcgtgatccacccgcctcagcctcccaaactgctgggattacagacttgtggaggccaggcactgtggctcacgcctgtagtcccagaactttgggaggtggaggagggcagatcacttgaggttgggaatttgagaccagccatggtgacaccatgtctctactaaaaatacaaaaattagctgggtgtggtggcgcgcacctgtaatcccagcaactcaggagcctgaggcatgagcatcgcttgaaccctggaggtggaggttgcagtgagctgagatagcattactgcactccagcctgggcaacaaacagagtgagactttgtctcaaaaaaaaaaaaaaagttgtggagtacctttcttaggggtttggagtgcctcaaatgagacaatatccaggaaagtgctttttaaactgtgaagctatttaccagcatgataatgaaacaattatgacaggtaggtaaataataacaaagtcctcatgatgtagagaatctctaaaatgatctttgatagggtttttgttttgttttttccttaatattcttggcacagccttaaatttggtgggtatgggcattatgttcggcaacctaaagtaagttgaaatctaaagtttcaacccaaatgccatcaattgaaatcagtgaccaagtccttggctttaatgacacttgatttttctcctacgtctatagcccatattctttcagcaaatatttttaaagtgcattttatgtttcaggccctgtgttaaattatgggagcaaagaaatcaaaaaatgagacaagttcttgtccttatggagctcctcctaatggaggaggcagaaaataaaccagcaggcaaacaagacaattctagagcagaacaagtgctataaagaacaaaaatgcagtgatgtggtagagagagactggggtgtttgaggtgtggtcaggaaaggcctctctgaccagatgatatagaaactggccctcagtcgggcgcggtggctcatgcctgtaatcccgcactttgggaggctgaggtgggcagataacgaggtcaggagatcgagaccatcctggctaacacggtgaaaccccatctctactaaaaataaaaaaaattagccgggcatggtggcaggtgcctatagtcccagctgctcggaaggctgaggcaggagaatggcatgaacccaggaggtggagcttgcagtgagctgagatcacgccactgcactccagcctgggtgacagaatgagactccgtctcaaaaaaaaaaaaaaaaaaaaaaaggaaagaaactggccctcaggaatgagaaggagccaggctggtgaagagttaaggcaaagagatttccaagtagagagtacaacaaatggaaagatcctgatgtgggaaaggaattgatgcattttaggcaaaaaggagggctctggtgttgcagagggcaacacagtctcctgttttggtttctctttctcttaaatgttgggtctggaccttcatgctttcctagcacacattctctaagtgcaggtgacttacacatctttctctccacactgggtctttcctgagctcacgtctggatatttccctgtctatagaacatttcctcatatatgtttggtaggcactgaaactaagcatgaccaaaaataactgtctgcatgactctccacccacttccccacaagctttacctccagggctctttctctatctctctgggtaaatggcaccactatttcctcactgatcaaatcagaaacctgaagatgattcttgacttctcctttcccagaacctccatatccaatccatcggcaaggcctaggctcctctgttcttctgcgtagctcccaaatctatccacttctttccatccccacgacacttacatactatatactacactatgtactctaaaccatctaatctgttttaaagacccctctgctctactctactcccctcccctccctttgtttaactactggaacatttgctgtgtatcctcacagacttaactactcattaattcaactgagttcctgttaactgccaggcactgctttaggtgctagagttataacagtgagcagaggccgggcatagtggcctatgtctgtaatcccagcactttgggaggccgaggtgggaagattcttcaggtcagcagtttgagaccaggctggccaacatagtgaaaccctgtctctacgaaaaatacaaaaattagccgggtgtggtgttgcatgcctgtaatcccagttacttgggaggttgaggcaagagaattgcttgaacccgggcggcggtggttgcagtgagctgagatcgcaccactgcattccagcctgggtgacagagtaagactccatatcaaaaaacaaaacaaaaccagtgagcagaagagaaaatatctgctttaatgaatcttacattttattgagggaagacagacaataaataaataaccatacaatgtgttaggtcagcagtctccaacctttttggcaccagggactggttttgtgggagcagggggaatggttttgggatgaaactgttccacctcagatcatcaggcattacaggcattagattctcataaggagcccacagcctagttcacaatagcattcatgctcctacgaacatctaatgccgccgtgatctggcaggaggtggagctcagaccttaatgcttcctcacttgctgctcacctcctgctgggcagcctggttcctggcaggccacagacctgtaccagtctgttgcctggggtttggggacccgtgttaggtggttgtaagtgctctgaagtacattagggtaagggaatgaaatggggaggaggaaagggaaatgggtgctggttttattttatttctttaaattttgagacaggctctcactctgttgcccaggctggagtgcagtagtgcaatcatagctcactgcagccgtgaccttctgtgctcaagtgatcctcctgcctcagcctcctgtgtagctgggactacaagtgtatgccatcacacttagctaattcttaaatttttcatagagacaatttcttgctatgttgctcaggctggtctcaaactcttgagctcaagtgattctcccactttggcctcccatagtgctgggattataagcatgagcctctgtgactggctgctggtgctattttacagagtggtcagggaaagcctgttggacaacgtgacatttgggcagagatctgggtgatggagtgactaagggctatcagagggatgaccattccaagcagagagaactggaaaggtaaaggccctgaggtctgagggtgcttgatgccttacaggaatgtctagaccacaacgtgggcttgaatggaaagatagagagaaaaagccaaagacgggtctgagatgactgggtgagatcaaataaattttattcagagtgagatgggaagcactggagggtgattttttttttcctttactttccaacttttatttttggttcagagggtacatgtgcatggataaattaattgtatgtcatgggggtttggtgtaaagattattttgtcacccaggtaataagcgtagtaagccataggtagtttttcgatcctcacgctcctcccaccctccgctctcaagtaggcccaggtgtcttcggttttctcctttgtatccacgcgtactcagtgtttctggaggggttctgaatagagtggtgtgttttcaatggctctgccactatgagaaaagagcattaagataatatgtatatgctgttcaaacgtaaatgcaatattatgtgcattgcttcactatcttctttcttccaaagtgaatttttttaaaaaacaaaatatgatcctgtcatcctttgtttagaatcctttgtggttctccattcccctaagggtcaagtctaaactctcaccaagccctcccgagtctggcctctacctacctcagcagctcccaaatcacagaaagtttttcctagatgggactcggggccttcaaccttccttgttcccttggtctaaaatgaagttatttccttccctccccatctaccttgtcaacatcgtgccaagcactattctaggcaccagggatacagcactgaacaaaatagacaaaaactctagcccttgtgtggctgaaattctaacaggaataagacagaagaaaagcaataaattatataccatatatgactattttaaattttaaatatgtattaaatatatatttttaaaatatgattttatatatcaggagggtgatataagctaaggaaaacactgaacaaggaagaggggggtgagatgttgagaaacgggttgcaattctgaataaggtggccaagcggaagcctcactgagaaggtgcctggcagaggtgagggagcaagtcaggcagctatttggaggagagcattccaggcaggaagcaaacgccctaaggcaagagcctacttgatagcaaagaggacactgtgtcagagaagagtatcggggcaagtgaggcccttataaggccctcacttctctgtactttgagtgagatgggagccactggagggtctgggtggagcaggagtgacatgcttggactttttttttttttttagacggagtctcgctctgtcgcccaggctggagtgcagtggtgcgatctgggctcactgcaagatctgcctccctggttcacgccattttcctgcctcagcctcccaagtagctgggactacaggtgcccgccaccacgcctggctaattttttgtattttagtagagacggggtttcaccgtgttagccaggatggtctccatctcctgacctcgtgatccgcccgcctcagccttccaaagtgctaggattacaggcatgagccactgtgcctggccacttggacttactttctaacaagatcactcaggctgctgaacttaaactagactgagggaggcaagtgcagaagtagggagaccagttgggctcccctggcaaaattgaggctaagagatgatggtggcttgattcaggatggtaacaatggtgatagtaaaaagttagtggcttctgggcctggtgcgttggctcatgcctgtaatccccgcactttgggaggccgaggtgggtggattgcttgaggttaggagttcgagaccagcctggccaacacagcgaaaccccgtctctactgaaaaaaatacaaaaattgctgggtgtggtggcgggcacctgtaatcccagctaatcgggaggttgaggcaggagaactgcttgaacctgggaggtggaggttgcagtgagccgagattgcgccactgcactccagcctgggtgacagagtgagactccgtctcaaaaaaaaaaaaaaaaaagttagtgggttctgactctatttcgaaggcagaagtacagggtctaaggaatcagatttgaaatgcatgcaagaaataaaatagccaaggataacgccaaggtttttggcctcagccatggccaaaatgagaggatggagttgccatctaaggaaattaagaaaactatgggataagtaggtttggacagtggtattaggaaatcagttttggacatacagacatataaagtttgagatgggctgggcatggtggctcatgccatttaatttctgtaatcctttgggaggccaaggcaggaggatcacttgagctcggagtttgagacctgcctggggaagatagcaagacctcatctctactaaaaaaaaaaaaaaaaaaaaaaaaagctgtgcgtggcagcacatacctgtagtcccagctacttgggaggctgaggatcatttgagtctgggagatcaaggcttcattgagctatgatcaaaccactgtattccaacctaggtgatggagtgagaccctggctcaaaaataagataaagtttgagatgcctagatgcctattggctatctaagtggaaacatcaagtagggagctggataagtgagctgcaaattcaggggaaaggttcaggttagggatatatacctggagttgtcagcatatttcaagtcaaaagactggcatcaatgggttaatgacagctattagtagaaaaagaagtccaaggacagagccctgggacactttaacagaaatttataacttcaggctggagtgcactgcaaactccgcctctcgggttcaagtgattctcctacctcagcctctggagtagctgggattataggcatgtgccaccacacccagctaatttttttttttttttttttttgagacagagttttgctcttgtcgcccaggctggggtgcaatggtgtgatcttggctcactgaaacctctgcctaccaggttcaagcgattttcctgcctcagcctcccaagtagctgggactacaggcatgtaccactatgcccagctaactttgtatttttaaggagatggggtttcaccatgtctggtctcgaactcctgacctcaggtaatctgcacacctctgcctcccaaagtgctgggattacaggcatgagccaccacgcctggccataatttttgtatttttagtagagatggggtttcaccatgttgttcaggctggtctcgaactcccaaccttgggtgatccacccgcctcggcctcccaaagtgctgggattacaggtgtgagccaccgcacccagccaaagtttttaactttttttgatctcaagactcctttacactataaaaaatttgaagatctcaaagaactcttgcttatgaaagttttatctatcaatatttactataggcctggcagggtggctcacacctgtaatctcaacactttgggaggctgaggcagcaggatcactgaggcttggagttcaaaaccagcttggtcaacagagtgagacccctgtttctacaaaagaaaaatttaaaaattaaccacacgtggtggtgtgcatctgtagtcccagctactggggaggctgaggtggaaggattgcttgcacctgggagatcaaggctacactgagctatgatagcaccactgcactccagcctgggcaacagagcaagaccctgtattagaaattaaaataaacaatttcaaaatatttattaattcattaaaaaataacaatagcaagtccattacatcttatcaataaataacatttttgaaaagaaaaataaccatgttttctaaaacaaaagaaaaattcagggagaactgttgttgttttgcatttttacaaatctctatctgacttaataaaagatagctggattctcatatgtgctttcacattgcatgtgatgccacatcatacatcatttagcctgtggaatactctactgtacacccgggagaaaatgagcataaaaaagcaaatgatattttagaattattgtgaaaatagtttttaccacattactccctgaaaagttatcagtgatgtccagactatactttgagaatccctgctctaacatttagaggttaggaggaattagaagtcatcatcaatggagactaagaagcttagccaggaaggctggatggaaatcaggaaagcctggtgccctggaggcccaatgaagaaagtgtttcaaggaggagagtgaccaaatgctgctgattgtacaagtcaactgaggaaggacggaccattggattttgcaacgtggaggccatcagggaccttcataaaagcagttttggtggaaaggcgaatgctaaagccagactggagatgagtcaccacataaaggtcacttctcaggtctccgaatcccagggtagttaatttacccacaaacctacatgtatctctcccctatcttcacacttgcctttcttttttcctggtttacgtgtgtgcctgtgtgtgtgtgtgtgtgtgtgtgtgtgtgtgtattgacacagggtctcaatctgttgctcaggctggagtgcagtggtgcaatctcgcctcacatcaaactccacctccctggctcaagtgatcctcccacctcagccctctccacatagctgggactacaggtgcatgccaccacacccagctaatttttgtatcctttgtaaagacagggttttgccatgttgtgcaggctggtctccaactcctgaacgcaaacgatcctccgcctcagcctcccagaatgctggaattaccggcatgagccaccgtgcccagtcagtttacctgttttagtatctgtcttcatcattacctttaagtggtgtgaaaacagggatcaagtcagtctcagtttttattcacttcctcagcacacagcaagtgcctgggatatagagaatgctccagccttccctggtaagcttttcacgatttctcaggagtaggaaactgactctctttaggcacactgcaaatctctcatatcttcctgtcaccttacccttcttttcccaaaacaaaccctgtaatttcatcttcagggtcccatgcttagagagatcccatgctggctgggcgcagtggctcacacctgtaatcccagcactttgggaggctgaggcaggcagatcacaaggtcaagagattgagaccatcctggccaacatgctgaaaccccatctctactaaaaatacaaaaattagttgggcgtggtggcaggcgcctgtagtcccagctacttgggaggctgaggcaggagaatcgcttgaacccaggaggcggaggttgtagtgaaccgagatcacaccactgcactccagcctggtgacagagcaagactccgtctcaaaaataaataaataaataaataaaaataaaaaaataataataataaagaaagagcccatgcttggtttaatactctgctgttgctgtcttaaaatggttaatagtttttgaacaaggggccttaaaattaagaatcttgtcccgagtgaaatgatgaatatacaaagttatggagcataatcctttaactctgtctcttgttactttatccaaatactttattgactgattactattgtgttaggctgttcttgcactgctaaaaagaaatacctgagactgtgtaatttataaagaaaaaacaggccgggtgcggtggcttatgcctgtatcccagcactttgggaggctgaggcaggcggatcacctgaggtcaagagttcgagaccagcctggccaacacggtaaaactccgtctctactgaaaatacaaaaattagccgggcgtggtggtgtgcacctgtaatcccagctacttggtaagctgaggcaggagaatcgtttgaatccaggaggtagaggttgcagtctgggtgacaaaagtgaaactccgtcacacacagacacacacacacaaaaaaaaaaaaaaaagaaaagaaaaaagaaaaaacgtttaattggctcatggttctgcaggctgtataagcaaggcctgggcatctgctctactttctggagaggcctcagggaacttttactcatggtggaaggtgaagctggagcaggcacattacatgctgaaagcaggagcaggagggggctgaggtgccacatctttttgtttttgagacagggtctcactccgttgcccaggctggagtgtagtggcacaatcatggctcactgcagcctcaatctccccaggctcaggtgatcttcccacctgagccccccaggtagctgggactacaggcacacaccaccatgcctggctttttttttttttttgagacagacttttgcttttgttgccaaggttggagtgtaatggcgtgatctcggctccacctctgcctcccaggttcaaatgattctcctgcctcagcgtcccgagtagctgggattacaggcacatgccaccatgccctgctaattttgtacttttagtagagatggggtttcaccatgttgccccaggctggtcttgaactcctgacctcagatgatctgcccgctttggcctcctgaagtgctgggactataggcgtgagccacggtgcccagcctgcttggctaatttttttgtatttttttgtagagatgggtttttaccatgttgcccaggctggtctcgaactcctgggctcaagctatccgcccaccttggcttctcaaaagtgttgggattacaggtgtgagccactgtgcctggccggtgctacactttaaaacgactacatttcatgagaattcccttagtacctggaggacagcaccaagccatgagggatcctcctctattacccaaatgcctcccaccagccccacctccaacactggggattacatttcaatgtgagatttgggcagggacaaatatccaaaatatatgaattatgttctgagttagccaggtgaagtagagggacgccaaagccactctaggcagaggagactacaggagcaaagaccctgcagccagaaacaggacaggggtagttggacaagaatgaccttgtcagggtttgcctttttctttttctttttgagacagagtctcactgtgttgcccaggctggagtgcagtggtgcagtcatggttcactgcagccttgaactcccaggctcaagcgatcctcccacctcagcctcccaagtagctgggactacaggtaggtgccactacacccagctatgtttttgtatttttttgtagacaagggttctatcattttgcccaggctggtctcctgagctcatgtgatccacccatcttggcctcccaaagtgctgggattacttgtgtgagccactgtgcccatcctctttttcttaaaggttgttctctccccacttcatggtcctattgccctttgtcagcatctgttaactagcacaggcccacagtactttgaattacagtgggcacattcacccacagatgttcactaggcactccctaggggatgggcaatgtgctgggtgctgcaggagatacagctcctgctttccagaagtttatattcccttgggggagagggagatgtgaggagtagagggtaaacacggtaagggcaggtctccctagcaccctgctctctattcagcacaaggccagcagtggacatcgtcgtcttgcattattcaggtttataggccaatactgaaatctatcttattcatcatcccgtgagcaggggaaacatcattagggttttctataccaggatgatagtgagcatgtagtagtttttgtttttttgtgttgtttgtttgctttgtaattttgttttcttttgtttttggagtattcactatgaagataagaaagggtaagaataaaatgccccaaatgaccagaggaatagagatagaagtcaggtccctcaaatttgttggaggagggggacaagctgggaggggggacgtgctgggggcggggcgggaacaagcccaaaaagggacagctgctgcggtgcctcttttgtgtttgtaaatgtcctccccgcaaggtggctctagcctgtaatcccagcactttgggaggctgaggaggatttcttgagcccatgagtttgagaccagcctggcaacatagtgagactctgtgtctgtagttccagctactccggaggctgaggtgggagggtcggttgtccagggatttgaggctgcagtgggccgtgatcgcgacactccaccccagcctgggcgacagagggagaccccgtcttaaaaaaaaaaaaaagtccttgatcaagagggcttcgggtgtttccatctgtggagtgaggggacgggttaggtgaattctaggggcgcttccacctcacattatgaaaggtcctgagagtcagattctagttccactgtgtcccgaagctgtggggcctttccttagcctccgcttctccttctgtaaagccaggtagttggcctagatcacttttccagaagactgtgactccgggacacctgtgacactcttgaggggagcgtgcccagtacccctggtcgcgtctctgggattccgccggggtgggggcccgcgcgaggccgcccctgagcctcacctgtgcgcggagcggtgactcacctgccctcgcgcagccctctccgcccgcgggctgttccaggagtcaccgctcctcctccctctcaggggtcactcccggcctaagctcccactaggggccggggaggaaggaattctgaggtgggcggcggggaggaagaggtccctcgggggtcccggtccggcgttgccagactctcttcgcggtgggggccttccctttccccaaaagcggaggccggaacggccgggaggagcgggcggggcggcggcgggaggcgccgggaagagcgagtcggagggaggtgccaggaagggcgggcggggccgggacaggggcgggggccgcgggcggggggcgggccgggggcgggggcgtggggcggcccatttcctcctcctagccggactggagggagacaaagcagcgcccgtctgcttcgggcctctggaatttagcgctcgcccagctagccgcaggtaacttcgtacctccctcctcgcgggcgcggtctctcgggccaggccgagagggtccttgggccgggccgtcccaagctgggccccgcgagccgcgggcgggcgagcgggcggggcgcggtttctttggcgacgtcgccgggaattgggccccgggcgggcgtgggacccgcgtcgggccggcggtcccttcccccgcagggcccgagtatggggcccgggcgggcacggccggcgcttcccagcgctcgggaagtcggggggccgcctgggctggggaggagaaactataggcccagcgccgccgccgcgtttcctcttggaaaagttttctcgcggtttccaaactttgttaccgcggcctcggcgcgcgcggcagccccgcgccgggcccctcggccgccttccttccctggggcggcttgtctgggagccgctttcccgggaagtgattgtcgtccggctccgaggcgttcctgccccctcccccttcccggccgctgagacttcccgatggggcggcggggacgcgggctcggcgaaccgggaggctggagcccgggcttctcccatacagcttcgccgtaggtgggccacacccgtgtggacttttggcgtgaccgtccacttggactcggggattactcagctttcctgggtttcttgtcggttggacgcacttagctttcagccctagttttcaggagtggcattagagaggtttttttttttttttaattgttgttgacttttaaaggagcgtgtgtgtgcgtgcgagtgtgaagcacttgttggaaaaaatgttgcctgaatgaatgcctgacctttgcttggcagcagtggcttcccagtaatgcaggcggcggttggcccagttccaaggttgactccctcttacgtcctcttgcatcttggtgacatttttttggtgcgtgtgttttgtacagaatttacaattatttggaaaagagcgagatatgtcaagtctacgactaaattcggggcattttatatttatgatgaaggaaatgcttacatcattgttgggacaggataggcattttgtggagcgaatatttgtgtttagtcagcagtgatttttaaatactggacaggtgggtgttactttaaggaacggaatttataaatcgaattaattaggatgtgttattttgttttacaggaagaatgaagaatgagtgtaggagttacctatagtttctgcctaattatttaccaatctggacttttgaacaaacattttttttaaagacggggtctccgtcgcccgggctggagcgcagtgacacgatcatgactcactgcggcttctgtctcctgggctcaagtgatccccccacctcggcttccgaagtagttgggactacaggcacgcgccaccacatccgtctaatttttgtatttttggtagagatggtgtctcgctgtcttgcccaagctggtctcgaactcctgggctcaagtggtcctcctgcctcagcctcccaaagtgttgtgattacaggcctgagccagggtgcctgaccccatctggatatttattcagcgaaagaataattttttaatccacctaagagctcacagtgtaataggggagacacacaccccaggtgtagtacagagcggactgcagtaagtgccttaacagtactaatgaaactattgtctgagtcaaatcttacctaatagtaacaacaaaagaaacttgtagaggcacggagagggggctaataagttttacttgggtaagtccagaaaggctttcaggaggtggtggcatttgatctggatgaaacatgagtcgagttttttttaagtgaagggagaaagtcatgagaagcataaaagggcataggagtttggggaattgtgatatcactctcctggttttcttttccttttgactcatctcagtttctttcttttcctcgccctcactctttcctctcgtacccagggttctttccaaagtatctttgtcctccacaccactgatgtggcatcaccttcactcccatcagtgatatctcatttcatatagtgacttagagatgagaggtaccctcctccaagatgagaatcactgctctgtgcagtctcttctgtcatcagccttatgtgctaaaagtccaagcctttgagtgcaggtgtgtctcctgacccacatggtcacctgtgcattgggaagctttttgggtgtcccaggcttctcaaactcaaggtgtccaaagtgggactcctgtctcttctggagacatgaaccagatgtggagatccagggtaactgccctgcccgggttttgggatttccttctttttttttttttttttttttttttttttttttttgatggagtctccctgtgttgcccaggctggggttcagtgaggtgatctcagttcactgcaaactccacctcctggggattcaagcgattctcctgtctcagcctccggagtagctgggattactaagtgcaagctaccacgcccggcttatttatttatttatttatttatttattttgagatagtcttgctgtgtctcccaggctggagtgcagtggcataattgcggctcactgcaacccgtgcctcctgggttcaagcaactctcctgcctcaacctcaaggagctgggattacaggtgtgtgccaacatgcctgcctaatttttttgtatttttgatagagagggtttcaccatgttggccaggctggtctcaaactcctgacctcgtgatccacctcggcctcccaaagtgctgggattgcaggcttcagccaccgtgcccagcctgattttttaatttttagcagagatggggtttcatcatattggtgagtctggtctttaactcctgacctcaggtgatccactcgcctcagcctcctaaagtgctgggattacaggtgtgagccaccgcactttcggatttctttgagaacgtaactcactgtggggcataacagacagccctgattgttgggggtagtgttgtgtgctggtgagaatatggagagaaggaacagggccctctgcatttgtagaggtcctgagacaggaaagactccgtgtgtttagagacttgagagaagacttgtatagcttgggtactttttcagtggggagaagacctcacatgagattgccagagaaggcagaggccatgttggggttttattctagaggtgtaagaagccattgtagggagtttcatgatttgatttcctttttaagactcctgctagtgcttggagaaggcttgtgtttgtgtgcatgtggaagcagagagttgagctaggaagatggtggagtacgaggtggtagggatgaagggagctgtattttggagaaatgagacaggacttaaatatggattggggctggacagggaggctcatgcctataatcctgtttttttgggaggctgagttgggaggatcacttgaagctaggagttcaagaccagcctgagcaactttatgagaccccgcctctaaaaaaaaaaaaatcaaccaggcatggtgacacgctctgtagtcccagctactcaggaggctgaggtggtaggattcattgcttgagcttgggaggtggaggttgcagtgagctctgatcatgtcacactgcagcctgggtgacagagtgagaccctgtctcaaacaaaagaaaaaaagggaggaagggagggaggaaggaaggagaaagaaagaaaacagaatggtggttgttaggggccaggtgaaggggaatagggagctattgttatgggtacagagttcggtttgggaagatgaaaaaagttctggaaatggatcgtgaatatatgtaatgccgctgaggcatacagtatttaaaaacagttcaaggctgctgtgaactatgatcatgcccctgcactccagcctgggcaacacagtgagaccctgactcagaaaaaaagaaaatggactggatgttgggggcctagggtaaagttgcttcctcagtgattcccttctactctcccaacataacctttcatgatgagcttttagtcatatcttaagactcagcactttcgtttctggtagcaaattttttagcactgggtggtgcattacattatgctgtacgttattattgatgtacctgtttgcctttactgctaggaagggagccttgtaagctccttgaaggcaggaactgagagtcttagttcttgtcttggtgcttagtacctggcatggagggcaaattagatgcttgttgagtgaaggaggaaaaagtcttttctgcctggagtctagcttgtggatggaatgataacagatgaggcaacagtcagattatggagggcctccaataacaaatttgggcaaactgagaaccatctacagcccattcttcttccttgccacccagatctaatcactgatgaaatcctctccatgcagtcctcagcttatgtgtaatatattctttttttctcctatttcttttttttttgagatggagttttgctcttgttgcccaggctggagtgcaatggcgtgatgtcggctcactgcaacctctgtctcctgggttcaagtgattcttctgcctcagcctcccaagtagctgggattacaggcatgtgccaccacacctggctaatctggtattttaattttatttattttatttatttttatttttttttgagatggagtcttgctctgtcacccaggctggagtgcagtggtgcgatcttggctccctgcaacctccgcctcccgggttcatgccgttctcctgcctcagcctccctagtagctgggactgcaggcgcctgccaccacacccggctaactttttttgtttgtttgttgttgttgttgagacggagtctcgctctgtcaccaggctggagtgcagtggcacgatcttggctcactgcaacctctgcctcccgtgttcaagtgattctcctgcctcagcctcgcaaatagctggactacaggcacatgccaccacgcccagctaatttttgtatttttagtagagatggcatttcaccatgttggccaggatagtcttgatctcttgacctcgtgatctgcccacctcggcctcccaaggtgctgggattacaggtgtgagccaccacacccggctgatatttttatttttaaaatacattattttcttgatttttcccataccttcctttagttttttgaacatctgtaagacagttgttttaatgtctttgtctagtaggtcttccatctggtctttctctgggacagtttttgttttttttttgagatggagttttgctctcgttgcccggactggagtgcaatggcgtgatcttggctcactgcactgcctcctggctttaagcgattctcctgcctcagcctcttgagtagctgggattacaggcatgcgccaccacacctggctaattttgtattttaagtagagacagggattctccatgttggtcaggctggtcttgaactcctgacctcaggtgatcagccagccttggcttcccaaagtactgggattacaggcatgagccaccgtgcccagcaactgggacagtttttattggttaattttttttttcttttaatgggtcatactttcctgtatctttgtatgacctgggactttttaatttttttttgaaaactggacatttgaatctaatgatgtgctaactctgaaaattggactcttctcattcccagggtttgctggatttttttgtttatttgttacagtttgtttttatgctgaggatcagcctgagatacaaacttaaggacttctcaggtcttttttgagcctgcacctttccctgggcgcatgcaccatggtaacttttttccttatctcccccgcaccctcatgattgcttttgaatatcctagtctttaaagtctagctcctaaagaggaaaaagagaaaaatgaaggaagtagggaggtgggggcccttggcccattaaatttcctggaagtctacttcagctggagggggaggacttgcagtcatggagggggtgcaataatggctatccttctcagtgtctgcctatccctgattataagcagcaatcagcaattagaatacggatccctaatatttggaggacagggtccttattacccatcctggttcccaaaagctgcttgcaagctgtttcaggaatgcattgtaggttgtctgcccgtggctgggggctagggaatggggtagctgctgctcagctaagggctgaaattgactgaaattaacccaatttactgtcccagtctttccttggaagttgcaagctttcttcaacagtccccagaattacatctgactaattatgccagtgtaattgtctaggtggggagactgatcttggtgcttcctactctgctgttttagaatctggaatcctctcccagaatttctttcctttttttttttttttttttttttttttttatgagatggagtttcactcttgtcgcccaggctggagtgcaatggcgcgatcttggctcaccacaacctccgcctcccgggttcaagcgattctcctgcctcagcctcctgagtagctgggatacaggcatgcgccaccatgcctggctaattttgttatttttagtagagacggggtttctccatgttggtcaggctggtcttgaactcctgacctcaggtgatccacccgcctcggcctaccaaagtgctgggattgcaggagtgagccaccgtgctcagccggatttctttccttttaaaggctgaataatgttccatttattgtatgtatatgccatattttgtttatccattcatacttttttttttggaggggacagagtctctgttgtccaggctggagtgcagtggtgcgatcttggctcaccacaacctctgcctcccaagctcaaaacgattctcctgcctcagcctcctgagtagctgggattacaggtgtgcgccactaccacccggctaatttctttatttttagtagaaacggggtttcaccatattggccaggctggtctctaactcctgacctcaaatgattcacctgcctcagcctcgaaaactgctgggattacaggcgtgagccaccacgtctgacctatccattcatatgttgatggacgtttggattatttccaaggtatgctacttttttatagctcttaaaatttttccaaattcctctccagaaatgtactttatcatcacctgtggtacatcagggtattttccactttagacattcttgatctattgtctgagtacttgaagtggtgtgactgtaggctgactgttgaatgaagctgaaaggggggttttaatagcaggtcacaaacttggatagaagaggagatgtctctcgggctggttggatatataataagttctggaaggccacatgctggtgatgatgtcatccagaaagggtttggtactgaatttctgttcaggaacgttccttgtcagggatgttagggatctgccttgtcaactgtagtccttcgtcagcctcttcagaagttgatgcccacttagctcttgaagcaggtgttctaagtaaataatattttgtactcttatattctgtggattagttgtaggtacatgctgttgtgaaaataaattcatttgacttctctgtatcttgattgtggaggtgatcacacaactgttatttattttttttgagacagagtctcaccctgtcgcccagtctggagtgcagtggcatgatctcggctcactgcaacctccacttcctgagttcaaatgattctcctgcctcagcttcctgagtagctgggatttgcaagcatgtgtcaccacgacctgtttaatttttgtacttttagtagagacggggtttcaccattttggccaggctggttttgaactcctgacctcaaatgatccgtccgcctcctaaagtgctgggattgcgggctttagccactcacctggcccacacagctgtttttagattggtatacgagagagtgaattttattgtgcataaaaggtggaaaaatgaacaggtaaaaaaatttactcaaaaaaattttgggggtgagtttggccttctatatggagataataaataagtagtgaaaaacatgaacccaattattctttctaccttctctgcccaaatcatttttttctcaagtgaccaaaaccacacactttgaggtctttttgttgttgttgatacagggtctcactcagtcatccaggctggagtgcagtggtgcaatcacacctcactgcagccttgacctcccgggttgaaagtgatcccctcaccgcagcctcctatggagctgggactacaggcgcctgccacaatgcctggctaatttttgtgttttctgtagagacagagtttcaccgtgtttcccaggctggtctcaaactcctgagctcaagtgatccacctgccttggcctcccaaagagctgagattacaggcgtgacccactgcgcctggcccactttgaagtcctaaagaaatttaggttattattctatgcatgttggaggatttaagtcttattagcagcttctgttttctgtaaggaaaaagttaaaacacatctggaagagtctcatagagcagcactttctgaaacttgcctgggtaccagtatgcctgcttccagaccttgaagatattacatgtactgcttggtgatctgccctgtcccccacatgttgtgggcctggattgaatggactgaacagtgtggggaattagtccagcgtgacttgccttgtctcatgctgtttgctcacttgtgagagcactatactgaattatccattattgaaagttccaagtgtgcaaagaaccacacttcaaaaataaaatgtcaacattgccctttctctgttagagccttaaatgttcattattttctttagtttttttttataactatcaaacttatttttctccatgtggaagtatgccacaactccatttctaatggagcttgaaattagcatgtatttccacttacttgttgatgggctgtcatcgatcaacccctctttttgattgggatttaatttgtggttttttttttttaccagctgtaagtttggagtaatgcatgtaatgtaaatacagttcacagggcaacttcggatgttctaaatacttgtaacatttgctcattttgaacaatattgtatgagtagtgtgaagtgatttttaaaatgtctgtcatttttttcatgttcccattttattaaaaggagggatggaactatattgtggaagctaatgtaatttttgtctctaagaggtttttttttctttttagactaaaagggcttaacagaagaaaaatttatctttcttaattgctaatttaaaggctaattttttccctagattgcttagttttgactatttgattccatcatatcaagctgtgaatttccttcattttcttgttttgaggtttcattattaaatattgtcaaaaataagtggctcatcaactctcttgaaagtgtcttattgctatgtttttttttgtcagtatttgacattctgaattgaagatgtgagttggaaacctggttaattaccaagttacataatcctgtatttattaactaggttagactacatacagactgttcttgaaaatgaaagtgctgttataactcagaaaacacattcactatggcccatttcaagttaattgaaggattgagcctttgatagtgcatttgccctgtgcggctctgttacatgcattctttctaggcaaagatgcattgttaccattctctcatggtatgttgaatatttcattagattcaatatttcaatattaatccaagctttttttttgagacagggtcaagccatcctcccacctcagccttctgaatagctgggaccataggtgtgtactacgacacccagctaattttttacatttttagtagagacaggtctcaccatattgcttaggctgatctttgaactcctgaactcaagcgatctgcccaccttggcctccaaagtgctaggattacaggcatgtgccactgtgcctggcctgagtttacaatccaaattctaaatcatggtttgtgaaatatgatggtgcagtgaataagctagaggctaaaagggagaagcatgttactattactgatgaaacagtgtttgtgggttttatattcctggggatctctaaattggcaaaaggtttcatgagggattcatttgttgtcattctcttgcgtctgtggacctgggttatcatatttttagaaaagctttggactgacttttaagtgtgtctttagaaacctgccatttaggctgggtgcggtggctcacgcctttaatcccagcactttgggaggcgggcagatcacctgaggtcaggagttcaagactagcctgactaacatggagaaacaccgtctctactaaaaatacaaaaaattgcagggcgcggtgtctcacacttgtaatcccagctactcctgagtctgaggcaggagaattgcttgaacccgggaggtggaggttgcagtgagctgagattgtgccattgcactccagcgtgggtgacagagcgagaatctgtctcaaaaaaacaaaaaacaaaaaacaaaaaaataattagccgggcatggtggcacatgcctgtaatcccagttactcgggaggctgaggcagaagaatcccttgaacctggaaggcggaggttgcagtgagctgagatcgtgccattgcactccagcctgggcaacaagagtgaaactctgtctcaacaaaaaaaagaaaccttccattttgcagagaggtaactaagtgaaatgtgagtttgatcccttgggagggaaaaaaaagtggaaatggaagatggcaacttttttctttttttttaatttgagacggagttttgcttttgttgcccaggctggagtgcagtggcatgatctcagttgaccgcaacctctgcctcctgggttgaagcgattctcctgccttagcctcccgagtagctgggattacaggcatgcaccaccacgcctggctgattttgtatttttattagagacggggtttctccatgttggtcaggctggtctcgaactcctgacctcaggtgatccgcccacctcagcctcccaaagtgctgggattataggtgtgtgccactgtacctggccagatgacatttatttcgggtctttaagaccagtgaaagatgtgatgttttctagttgctttgagttagtctaaagcagtaatttgctgtatctctctcttttttttttttttttttttttgagatctcgccctgtcgcccatgctggagtgggagtgcagtgatgcgatctctcttcactgcagcctctggctccaggattctagcgattcttctgcctcagccttccgagtatctgggattacaggtgcctgccaccatgcccagcttgttttctttttgtttttttgagacggagtcttgctctgtcccccagattggagtgcaatggcatgatctcggctcactgcaacctccgcctcccaggttcaagtgattctcctgcctcagcctcccaaatagctgggattacaggcacccaccaccacgcccagctaattttcatatttttagtagagatggggtttcaccaggttggccaggctggtctcaaactcctgacctcaggtgatccgcccgcctcggcctcccagagtgctaggattacaggcgtgagccaccgcgcccggccccagctaattttcttatttttagtagagacgaggtttcaccatgttggccaggctggtcttgaactcctgacctcaagtgatccaccagcctcttcctcccaatgtgctgggattataggtgagagccactgtgcctggccattttgctgtatctcaattgcatcaggaaaggctcacttaaatacagttcatttattaagtctgccttgcaaagcagtgtgctgtgtgctggagggatgttaatgtgtaagccaccattgctaaccccaggaaatttatgaactcaggagatcaggtttggtaaaatagctgataggtaagaattggcgctgggcgaggtggctcatgcctgtaatcccagcactttgggaggccgaggcaggtggatcacgaggtcaagagatcgagaccatactggccaacatggtgaaaccccatctctactaaaaatataaaaattagctgggcatggtggtgcatgcctgtagtcccagctacttgggaggctgaggcaggagaatcatttgaacctgggaggcagaggttgcagtgagccaagatcgcgccactgcactccagcctggcgatagagtgagactctgtctcaaaaaaaaaaaaaaaaaaaaaaaaggcagtttatacccactttttgctaatctgtcatgagagatgtttcttatttctttgtgcatagagcagttgagctaattcagttaaacatgtatagagtgttagattagatgaaagttaccatgatcaaaaaactcgaaagagctctcagtttcatgggagacacacatacacacacacagataatagtgctatgtgacaagtgctgggggaacatggtatgttgtgtctctttgtgaggcagagatgacagatgtctgagtcttgaaggaaaattgtagctttccagtttgagaagacttgaagggtgctctgggcagaggaacagtcttgtgtatagatctggaggcatgcaggtgcattggggaatattttcttggagtggagacaggtgataaggctgacaggctagagtaggcgaggcttgtaggagtttttggcttcatcctgtatgtggtggggaagcaataccatgttttgtttttttttttttttcagagggagtgacccaatgataatgataactggggctccctggagaatgattggaaattagaagacaccttgatattctcaaccagagataacagagccctgagagcaggaagggggttagtagggtgagtgaggtgtttactgaggtacggaggagaaagaaaatgaggctagagtctcattctagggacctggattggtggaactttggtcagcggagaaggggaaggccacagggggaatgcagtggagtatagaggggatgcttggtttggggctcatggagtttgaggaactcagctttgcagttaagtgcagggagaagccctatacttgtgaaaatgcagctctggtgaaggcatgtctcgtcacttcccaccttcactgtggtaacgggaagaggtggggtttgctcctttacctttgttttttagggggcagagggaaggggttgtttcagtgttgctcaagtagttgttatgaacagtaagaatacagtgggtccaaatatttttaagataggaagaataaagctgaaccctccaatgtcttctgaatttcataacttttctttctttcttttttttgagacaagagtctcgctctgtcgtccaggctggagtgcagtggcgtgatcttggctcactgcaagctcctcctcccgggttcacgccattctcctgctcagcctcccgagtagctaggactacaggcgcccgccatcacgcctggctaattttttgtattttttagtagagacagggtttcactgtgttagccaggatggtctcgatctcctgaccttgtgatctgcccaccttggactcccaaagtgctgggattacaggcatgagccaccgcgccaggctgaatttcttagcttttctttcagcttattatctgccacttcactgtgcatcctctatttttcactcactgtggttgccggaaggtgctggtgttctttggcgccattgtccttcacaacctgaaacagcctccctgccctcaaacagtacgtcagatactcagtgagtccttcctgactatttggggaccgtcttttgggtgcccctggagcacttagaacattataccttctatcgtattataactcttttcctgtatagactgttgtaagcattttccccctactttttttggggaagatcttcaaacctacagaaaagttgaagtacagtgagtgcttgatttaccagctgaccattgttaacatttttcaaattttctcaattactcgatagaaactatttcagagtcatttgaaagtaaactgcagacctcatgggacttcactctttagcatgttattctgaagaataacataacaggccctgcataaccctgacactactgtcacactcaagaccttttacattgatacagtaacatgtaataccttttaaagagcagtctgagggttagcattggctctccctgggagctcttgagaaatgcagaatcttaggccttaccctagatatattgaatcagaatctgtgttttaacaagatccgcagaagtactgatttttttgtgcagtccatattcagattcagattctcacagttgttctagtgataccctttatggtttttctttctctttttaaaaatcaggaatcaataaaagatcacatattgcattcgattgtcgtatgtctttagccttcacttccagctttcccacttgggacagtggcatttttgtatagtttaggccagttttgtagatgttctccattttggatttgtcaaataggtgtgatgatgtttttttgttgggtttttgagatcgagtctcgctctgtcacccaggctagagtgcagtggtgcgatctcggctcacctcgacctctgcctcccaggttcaagtgattctcatgcctcagcttcccaagtactgggactacaggtgcacaccaccacacccagctaagctttttttttttaaagtagagatagggtttcaccatgttggccagggtggcctcaaattcctaacctcaagcaatccacccaccttgtcctcccaaagtgctgggattacaggcatgagacaacggtgtctgttttttttttttttttttttttttgagatggagtcttgctgtgttgcttaggctggagtgcagtggctgtttgcaggcacaatcacggcatgctaaactcctgaactcctgggtacaggtggtccttctgcctgagccttcccagtagctgggactattggtgtaagtcactgtgcctggcttgatgatgtttctttcttagggcattcagtgggtcaggttgttccactggtgatgatgctaagtttaaacacttggttaagtagcatcttccagatttctgtgttacaaagacagaatggtcttttggtcttaataattaattgctacagtgatctgctagcaatttccaattcatctagcatctagcaggatctgacatctagcaggatcccagaactgataattcgtcagtcattgatgaatgaatgactgaataggtcatccaggatatataccacaagttttagaggccattctttcttgttttctttcttttttttgttttgatttttgtagagatgaggtcttcctatgttgcccaggctggtctggaactcttgggctcaagtgatcctcccgccttggcctccaaagttctgggattacaggtgtgagccactgagcctggctccttcttgttttcctgctcagtctgggtaacttctcagactctagtcaagtccaggcatctttttgcctggctttccaacaaaaatacctcactcttctccctgtgggcttcttagctgtgtgaaaggtttctcctcccttagtcccactgtgtttttaaatttttatttttatttattatttttgggttattattattattattattattttttgagatggagtctcactgtgtcgcctaggctagagtgcagtggcatgatctcggctcactgcaacctccgcctcctggattcaagtgattctcctgcctcagcctcccgatatttttattttattattttattttattttttttgagacggagtttcgctcttgttgcccaggccggagtgcaatggtgcgatcttggctcaccgcagcctccgccttctgggttcaagcgattctcctgcctcagcctcccgagttgctgcgattacaggccctgcgccaccacgcccagctaattttgtatttttagtggagacagggtttctccctgttgatcaggctggtctcgaactcccgacctcaggtgatccgcccgcctcggcctcccaaagtgctgggattacaggtgtgagctactgcacccagccgcttattttatttattatttatttatttattgagacggagtttcggtcttgtcgtccaggctggagtgcaatggcgtgatctcggctcattgcaacctctgcttcttgggttcaagcgattctcctgcctcagcctcccaagtagctgggattacaggcgcctggctgatttttctaatttttagtagagagggggtttcaccatgttggccaggctagtcacgaactctgatctcaagtgatccgcctgccttggcttcccaaagtgctgggattacaggtgtgagccatcgtgcccggtgatacttttattttttaaaaaatgatttttggttcaaggaagtcagttcggtccaattgttctaaaacaaaaatgtcttctgtattttcttttttctcttgtgcctccagtccaggtgcttgtttcacattctttgctttttagactagtcattcagtctcatggaaacagggacttcctctgtatccattatcagttgttaggagggcttgatgcagctttctattaaacactcttccattgttaatgttctcaactataatacgatggaagctgaggaaatgaacatagatatccagtccatacagcaaactgtcacttcaccccaggagcttgttttgttttccttcacttgacctcctactgcttcttgccctgttccagctacactggccttctctttctgtcagtccttgaagatactgcctcatctgtgttccctctgcctggaatgctctcttcctccagatactcacttgattagttctttcctgactattagattttcgctcagatgttgtcaagacagaaagacctcgccgggcgcggtggctcatgcctttaatcccagcactttgggaggccgaggcaggcagatcacgaggtcaggagagtgagaccctcctggctaacatggtgaaaccccgtctctactaaaaatacaaaaaattagccgggcttggtggtgggcgcctgtagtcccagctacttgggaagctgaggcaggagaatggcgtgaacccgggaggcagggcttgcagtgagccgagattgcgccactgcacccagcttgggcgacagagcgagactccgtctcaaaaaaaaaaaaaaacacaaaaacaaacgaacaaaaaacagaaagacctctaaggaccctacttaattccattgccattacactgcttaattttcttcctagctctcatactgtcttctttgtttagttatttatgccattattgcaatgaaggcttcatgaaggcagggttctttttttcttgttgactgctttctgggatagtgactatacaaaggaggcactcatatttgtgagtgaaggctaaatggttggctgaattttttttttttgtttactttttgtcctttgatgagtgccttttgttgtagtgtctcctgatgcttgtagcacagcagttccaactgctcccattgcctttggtgccctcaagaaaaataagaaaaggagcaaaataaaaatgattcaagtgttttattattattatttatttattttttgtatatttttgaaacagaatctcccccatcactcagcctgcagtgtagtggcatgatcatggctcgctgcagccttgacctcttgggttcaagtgattctcccatctcagcctcctgagaccacaggtgtgcacctccatgcccagctaattttttttttctttttaaaagttgtttttgtagagacgaggcctctatgttgcccagactggtcttgaactcctgagctcaagtgatcctcccaccttggcctcccagagtgctgggataacaagtcagagtgtgtcttaattataagttaccttgatttttttggcagttaccaggagatttgagagttgaggttccaaaggctgtgttaactctgcttgatgcagatgcaagctggcatacctgtgacagcactgagtattccacaatcttctgtcttgtgcagtgtgacagttaacgttgcttcgggtacttttaatttctaaatttcctgatttgcatttaaacgaaccatcctaacatttcattaagttaactttgctgttaaaaaaaaaattggcattgagtagcatggttaaggtagtctaaatctgccacaatataataatgaaaattcaggagcagacacattttaagcatgatttggccattcttttataagtgaatgctgaacatctttggagaaggtacgtagttctttgcacaaatgaggcagtttgccagttatcagcccccttggttctgatagaactatgcttttattttctcctcattgcttctcaatttctctttctgttgtagattgctagctaaatgattgcatctctgcccctttctgaatttatagcaaacttttgctttatagccaggattaccatttataaggtaatgaagaccagataagtacagtttaactgtttatttagttccattaagcatgatccctcctggaaaaacctaaggttgctgtaattcattaaggttggctagctctagtaggttttgtgatagatcttgcgaaggagtgctctgtaagttaattggaaaagtagaaactgtcaagagtttaaaagttatttgtttagttactctgaacaataccattaattgtagagaaccagaagatacgactaagattaaggcaggagctttgtcttgggaggcttgtaaatatttgcaaattatgttgcataaattcagctcaactaatactatctgccctgcataaagctcccagccagcaacttacgggatataaagaaacataggcatggttatcatccttacacttaaaatatagctctgaagaccatatgctaaacctgagaaaattaagtttaataaaacaattcaatggctgttgagtgacaacataaatgaaaagagcaccagaatttcaggactagagggatttggagtatagaattcaacttctttcattttatagatagatgaaaagagcaccagaatttcaggactagaaggatttggagtatagaattcaacttctttcattttatagatagatgaaaagagcaccagaatttcaggactagaaggatttggagtatagaattcaacttctttcattttatagatgataaaaccaaggatccagaaaggtgaagtgacttaatcaaaagtcagaggataagtgacagtgctggttccagaagctgatgtttcaagtagaacatgttctctttagattttaagatacttttattttttgaaatccttttaggattgggatcactaaaaacatgccttggctctgtagcatcatttcatgatgttcagcgtcattcttggcaggaccctgcgctcatgaaacttacactgtaataatggcataaataagtaaacaaagaagacgatacgagctaaaataaaattaagcagggtaataagtaatggaattagtaggatctttagagtgcctttctgtcatgacggcatttgagctgaaatctgaaagttaggaaagaactggtcttctgagggaagagagcattccaggcagagggaacacagatgaggcagtgtcttcagggacttacagaaagagaaggccagtgtgactagaacagggcaagaagtaagtgatcaagtgaaggaaaaaacaaaaacaagctccttggcacttttgattaaaggtgctatacagggcagtctgcttgcattatggttattgaaagtcttgaaaatacactgagttctcaattttcaagtgttagtgtattttaagtttcttaatgtaagtgagtgattagagtcctttgccttaactcgtttagaagcaggattagggaggctgagtctggtgaattaattttttttttttttttagacagagtctcactctgttgcccaggctggagtacagtggcaagatcatggctcattgcagcctccaccttctttggctgaagcgatcctcctgcctcagcctcctgaatagctggactatggatgcacaccactacacctggctgattgttttgtttttgttttgtttctgagacaaagtctcactctgtcgccctggctggagtgcagtggcgtgatctcatctcactgcaatctctgcctcttgggttcaagcgattctcatgcctcagcctcccgagtagctaggatcacaggcatgtgccaccatgcccggctaattttgtatttttagtagagacagggtttcaccatgttggccaggctggtcttgagatcccgacctcaggtgatctgcccacctcagcctaccaaagtgctgggatttcaggcatgagctactgcgcctggcctgttttttatttttaaattatttgtagagatgaggtctcgctatgttgcccaggctggtcttgaactccagggctcaagtgattttcccatcgtggcctcccaaagtgctgggattacaggtgggagccaccacacctggctttttttctaatattaaataatttatttttgcacagtaagacttcttggaagttgtcactaacgttaaagttgggagattccatgtaaaaatctgcatccctggcctctcttgaaaagtcagatggtctggaaaccctggatttatgtggtaaagattgcctggagttgatgaacaagtgggcacaagctttctgattttgaagtcctggctcctcctagtggtccctgtccccagcctggagaggccaggtgtcatttgcaattcattattgtgctgttgtgcatattgtgctgttgtgccacctttttttttttgaggcggagtctcgctctgtcgcccaggctggagtgcagtggcgcgatctcggctcactgcaagctctgcctcccgggttcacgccattctcctgcctcagcctcctgagtagctgggactacaggcgcccaccaccgcacccagctaattttttgtatttttagtagagacggggtttcaccgtggtcttgatctcctgacctcgtgatccgcccacctcggcctcccaaagtgctgggattacaggcatgagccaccgcgcccgtcctgtgccaccttttttaagttaagaagtaagtgaaattatttgtactccaaagtatcaaaattaggaaaacaaaagaccaagaatgttttttgttcaagaaaaaaatgaaagtctttttttgagaaagtgaaatagttatgtgttgtacctgtttaataattaaacacaaatgtgaccacatatacctaaatgtctgcttgcagctagcttcacttaactttcctcttggctctctccctttgcaaccctggaaggttctgtgttttgtttgtgttaatgcagtatctctggaatgctaggatatgtaggatccatagggcaaatagttcttctgaaatgtcttatctgtgacatttgatgacatttggttgagctgttgtcaaacctttagcaatctagagcattccatttcctaaggttcactgacttgggttgatcagttgagtggacaaataacctttaaaaaccaaagtgtaggcctgacgtcacatgaatgtagacagcaaattcatctaccttcaatgaaacagatgactgggacacaggcattctgtgttaccagattaggcaaatgcaggttccttttggcacccctatctctagtgattctagatttgatgacagtataatgacagtataatgatgaaaattcagaaatttaacattgatacaatgctactgtttaattcagtacccatagtcaaattttgtcaattgtctcaatgtttttccctttctcaacacaatttcagtccagaatcactgtgtttaagtctctttagcctcctttaatctggaaatatttctttttttttttttttttttttttttgagtcggagtcttgctctgtccgcccaggctggagtgcagtggcgcgatctcggttcactgcaacctccgcctcccaggttcatgccattctcttgttttagccttctaagtagctgggactacaggcacctgccaccacacctggctaattttttttttgtatttttagtagagacggggtttcaccgtgttaggcaggatggtctcgatctcctgacctcatgatccacctgccttggccttccaaagtgctgggattacaggtgtgagccaccatgcccggcctctggaaatgtttcttttttttttttttttttttttttattgatcattcttgggtgtttctcacagagggggatttggcagggtcacaggacaacagtggagggagggtcagcagataaacaagtgaacaaaggtctctggttttcctatgcagaggaccctgcggccttccgcagtgtttgtgtccctgggtacttgagattagggagtggtgatgactcttaacgagcatgctgccttcaagcatctgttcaacaaagcacatcttgcaccacctcaatccattcaaccctgagtggacacaccacatgtttcagagagcacagggttgggggtaaggtcaccgatcaacaggatcacaaggcagaataatttttcttagtacagaacaaaatgaaaagtctcccgtgtctgcctctttctacacagacacggcaaccatccgatttatcaatcctttgcccgcctttccccccttttctattccacaaaaccgccatcgtcatcatggcccgttctcaatgagctgctgggcacacctcccagacggggtggtggccgagcagaggggttcctcacttcccagtaggagcggccgggcagaggcgcccctcacctcccggacggggcggctggccgggcggggggctgacccccccacctccctcccggacggggcggctggccgggcagaggggctcctcacttcccagtaggggcggccgggcagaagcgcccctcacctcccggacggggcggctggccaggcggggggctgacccccccacctccctcccggacggggcggctggccgggcgggggggctgactcccccacctccctcccgggcggggcggctggccgggcagggggctgacccccccacctccctcccggacggggcggctggccgggcggggggctgactcccccacctccctcccggacggggcggctggcctggcgggggctgaccccccacctccctcccggatggggtggctgccgggcagagacgctcctcacttcccagacggggtggctgccgggcggaggggctcctcacttctcatatggggcggttgccaggcggagggtctcctcacttctcagacggggcggctgggcagagacgctcctcacctcccagacggggtcgcggccgggtagaggcgctcctcacatcccagacggggcggcggggcagaggcgctccccacatctcagacgatgggcggccgggcagagacgctcctcacttcctagatgggatggcggccgggaagaggcgctcctcacttcctagatgggatggcggccgggcagagacgctcctcactttccagactgggcagccaggcagaggggctcctcacgtcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaaccagactccgtctgcaatcccggcacctctggaggccgaggctggcggatcactcgcggttaggagctggagaccagcccggctaacacagtgaaaccccgtctccaccaaaaaaatacaaaaaccagtcaggcatggcggtgcgcgcctgcaatcacaggcactcggcaggctgaggcaggagaatcaggcagggaggctgcagcgagctgagatggcagcagtacagtccagcttcagctcggcatcagtgggagaccgtggaaagagagggagagggagaccgtggggagagggagagggagaggagggagagggagaggagggagagggggaggagggagagggggaggagggagagggggaggagggagagggggaggggaaatgtttcttaatctgtctttttttttttttttttttttttaaacagagtcttgctctgtggcccaggcaggagtgcagtggcaccatctccactcactgcaagttctgctcccccaggttcatgccattctcctgcctcagcctcccgagtagctgggactacaggcgaccgccaccacgcccggctaattttttggtatttttagtagagacggggtttcacagtgttgaccaggatggtttcgatctcctgaactcgtgatccacccgccttggcctcccaaagtgctgggattacagacgtgagcctccgcgcccggctgctttgacatttttcaagactacagccagttattttgtagatcgtctcacgctttgaatttgatgttgcctcatgactagttgaggttatgtaattttcaggcgaaataacacagaggtgatgttgtatccttctcagtgcatcgtgttaggagatacgtgatgtgggtttgtgtccttattagggacagtaattttgattacttggttaaggtggcatctcaggtttctggactgtgaagttactatttcccccatctgtcataaataaataatctgttgggagttactatgacactagatcacgctactgagaaactgaatgctaatctacttggttagcattctttgattcttgcctgaggcaattaatattatggttcctgaatgctgatttttctaaatacattgttctttctacatttattagtttgtttcctattgtttggaagaacttttccttctttattcatattagcatggactcatgcattagtcaatggatcatactttgttctatctaatctccactaaagctctctgaagaaggcagtggttggtagtcttttatgagggatctagttcaaagttacgttttttttttgagatggaatcttgctctgttgcctaggctggagtgcagtggcatgatctcggctcattgcaacctctgcctcccaggttccagcgattctcctggctcagcctcatgagtagctgcgatcacaagcaaccgccactacgcctggctaatttttgtatttttagtagagagagggtttcaccacattggccaggctggtctcgaactcctgacctcaggtgatccacccactttggcctccctaagtgctggaattacaagcatgaaccaccatgcctggccagttttcacccagtagttttgacattcattgctaatccttggctggatcagtttttaccagtgggggttgcaagatggtcattttctaattctattctagattcatggtaaagaaattccctccccataccctttcttttgaggatccctatggtcttaaggatatttatttaattatttagttacagacagttacagtcattattctctttgatagttgtcctaaatttggctgatgggagcccttgcttcctgtgtcttttgatatgatcttgttagtcttgtcccctttccgcacaatacagtgcttcagacctggaactttggtttctattaatgggaaatggtccgttttttaaaaaaaaaataagtagaaatgggatctctctgtgtggcccaggctggtctcaaactcctgggcttaagtgatcctcctgccttggccttccaaagtgctggtatcacaggcatgaaccaccatgcaaatggtatttaatagaaataaatacttgggcactgataacactggtttttttttgtttttgttttttttttgagacaagagcttgctctgttgcccaggctggagtgcagtggtgcgatcttggctcactgcaacctccacctcccaggttcaagtggttttcctgcctcagcctcctgagcagctgggattacgggcgtgtaccaccacactggactaatttttgtagttttaatagagacggggtttcactatgttggccaggctggttgttttgttttttaatttgccaacattgtttttaagagtaacattgtagcccgttgtgtcattgttacataatttattgagtgatctgttgtttgaaatttaggtaatttataacttttaatgtttatataaagcagtgttgtgaacatcattgtatcccagtttttacatgttccttaactttagaataagattttagcagtagattttctgggtcatacaaatgtactttttaaagattttattttatttatttattttattttttatttttttgagacggagtcttgctctttcgcccaggccggactgcagtggcgctatctctgctactgcaagctccgtctctggggttcacgccattttcctgcctcagcctcccgagtagctgggactacaggtgcccgccactgcgcctggctaattttttttttgtatttttagtagagactgggtttcaccgtgttaggcaggatggtctcaatctcctgacctcatgatctgcccgcctcagcctcccaaagtgctgggattacaggcgtgagccactgcgcctggccaagattttatttttttaatttttattattattattattttttaagatggagtttttttcttgttgcccaggctggagtgcaatggcacaatctcggctcactgcagcctctgcctcccgggttcaagcgattcttctgcctcagcctcccgagtagctgggattacaggcgtgcaccaccagcctggctaattttgtatttttagtagagacagggtttatccttgttggtcaggctggtgtcgaactcccgacctcaggtgatctgcccgccttggcttcccaaagtgctgggattacaggagtgagccaccacgcccagcctttaagcttttaaatgtctaccagcagtttgttgtctagaaagtttatattagtgtttacctcagcttcatgccttttcttttctttttttctttaataattgaaggcactacttttagaagaaaagactaactgttattttcgttgatgttttctccctattcttaaagccgctgtctgacagaagtttctcttgacactgatacagtgatatttgactaagtgtgatttgaaatttcttctggctatgagtgataatagctgtgggtgcagagggcagctgatttaaacattatgttttaatagaataagacaagtccttctctaggaatccatcaaaaaatgaagtgaagcataccttttagatactactgtaccatgaatgttgtggagtaggaaaaatcaggatcttctgtattcgtttttgaagcagtgtctttgaaagtagcttttggccgggtgcggtggctcacgcctataatcccagcactttgggaggccgaggcaggtggatcatgaggtcaggagatcgagaccatcatatcctggctaacacggtgaaaccccgtctctactaaaaatgcaaaaaaattagccgggcgtggtggcgggcccctgtagtcacagccacttgggaggctgaggccagagaatggcgtgaacccaggaggcggagcttgcagtgagctgagatccaccactgccctccagcctgggcgaaagagcaagactctgtctcaaaaaaaaaaaaaaaaagaaagtagctttcattcactttagcttttcatcttgtttctaaaggtggggcagataaagtgagtaggaactgaggtaggaagtcttggtgctagagaagcccaaagggaaacattctgtgtgtttgggaatgccctcttgtagtacccctcctatttgtaagcctgaaatcattaaatattaagaggttgtaaggtttactgggtcttcatgtgtaggctagttagaattttttcatctatagtgaatatagctttcctgatgcaaaagtcccaaagtaggagaagatttgttacatatttcatgtttgtgtttgatgtttgcctgactgactttttgtttcttatttagaaatgactgctgtccatgcaggcaacataaacttcaagtgggatcctaaaagtctagagatcaggactctggcagttgagagactgttggagcctcttgttacacaggtaagaatctgaaaacacaaatacattgtaacatggttctatagcacaggcctgggtaacaaccataagagcaaggttatttagttcaaagccttaattccagtacttgagtttaggtgacagttcttagatgatttgaatattgatgcatgggtttagttaacccttgagaacgctgctgctgtcgttttcttcagtcttattgctagtaacgggtccatggtatgtagtgcaactttgcaaatgtttgtgctttgcagatacttcacctttcttcagaggggaaacccaagaaaggtggagtctggatccttgattgttaaggtctctcactctgcttaacacacctttcattgtgtgggattaattagcaggtaattcaacttgagggtttaggtttggtatgctacaaatgtcacaatgttagggtagttcataaactgttagcaactagctgtgtacttttagtgttttacaatagtatgtctattgtttgtatgtgagagattcagagagagagagagaaaatgagtcttgtttggcaaatttacactataacatatattcatcatctttaacctagagataatctggtattatgtgtattaatgatggtaatgttctaagacataaagcgtcatcactgtaggcttctttgggcaatcattcgtttattgggacctttactaattgctgagatttgtgtgaataaactgtcaaaagacttcagaagcaaattatcttaaaatgttttgcaaagtttgaaaacagtggcagtgtgatctccagataaagctaagttcattgttaacctctttctggaacatcttggtgacatatagtagagacatctaacttgtctctaatcattttttaatttgtaaaatcaaactaaaaacctaatgatcatatttgagaaattaaaatatgtgttaaataattctctgtacacattaagaaagctgaattattttggaaattaaatatagcatcattgctgtatatcttaaatatggggaattgtatgttaatgttcagtggaatctcatgtgattttttaaaagaataacttaatcttgctgtctttaaagatattagtttgtcattttaattgactccagtttaatgttaaaaatgaaacttttaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtaggtcattactgctttttaggtaaagagaggcaggcctttctagaaaatcagtgtttgaagattttttttgtggtcagtattctcattcttatgcttgccaattgctcagtaacttacttagttattggagatgtattaagttggactggctcatattttaattctcattcttatgcttgccagttgctcagtaacttagttattggagatgtattaagttggactggctcattttaatcatgagagatgcttgcagagggacatctggagaatctgaatccacttctcttgggtatttcaagtaatagttaagtcttagaaatgttgtaacacaaattgataggaaagaaatgggaccgaagtttacttttcatcctgtgtaatacttctttttagttcatgctgaagagatgggtgtgataaaatggaaaaatatctacctactctgaaaatactctagaaattgtcctattgtgtcagaatagtatgttaaatcagccatgcatatttgaactggttggagcttgacataaatctgggtataaaggaatcatgttttgggaaattcagaattgataaaaagtaaaatggtaatccacagtttactaataattaatgctagaaaaattgtccttattatgttacaaatgtggaaggaagactttaaatacggaagataaacttcttgaaacctgcagtttttatttttagtagagatggggtttcactagttgcccaggctggtctcaaactcccaagctcaaacaatccgcctgcctcggcctgccagagtgctgggattgcaggcatgagccacagtgcccggccttgaaacctgtagttgtgtgttaggtttcttttccagtcggagaatttcaacaatgatgtaggttttttaggttattggatatcagctaaggtaaatcgagccctgctatttacaggtgctttactaacccttgggagaacttcatagatctttcgtgcctgatggtagattgcatagtccagagtcttatgtcaaattcatccctgtggcagtacccataaatgggcagtgccttagatggagataacatctccaattgttttctgaatttgtgaacaaataaccttcaatggtaaatattttttcagttttcaggctgaagataaatatttctaatactgaaaatgatgaaattattagaattccacagtactaattaggcaggtatattagtttcctagggcttctataacataaattattacaagcttggtggcttagaataatagaaatttattctctcatcattctgaaggccagaaatctgaaatcaaggtgttggcaggcttgattccttgttgggacttaggaagaatctgtggatgcctctttcctagcttctggtggttgccagcaattcttagcattccttggcttgcagacatgttactccagtctctgcctttgttatcatatacttttctttttttgtgtctctgtgtccaagtttccctcttcttataaggacatcaaccattgaattagggcccaccttaatccagtataacctcatcgtaacttgatatcatctgcaaagaccctgtttccaaataaagttgcattcacaggttccaggtggacatgaatttttgggcaatgctattcaacccagtacagtgagttttgaattaattaattaatttttttttttttttgagacggagtctcgctctgtcgcccaggctggagtgcagtggcgggatctcggctcacttcaagctccgcctcccgggttcacgccattctcctgcctcagcctcccaagtagctgggactacaggcgcccgccactacgcccggctaattttttgtatttttagtagagacggggtttcactgttttagccgggatggtctcgatctcctgacctcgtgatccgcccgcctcggcctcccaaagtgctgggattacaggcgtgagccatcgcgcccggcctaatttattttaaagtagtttaatggtccagttcaggacagtttttgagcttgctgttgaggaaatcaggctattacttaattgtattctgtggtacattctcctccccagcccttcttgtcttctataacgaaactcacaatcatattaacagatgagtttgggcagtgtttgctggctctagtgactgacgtttcttttcttttctttctttttttgagttggagtcttgctctgtctcccaggctgggatgcagtggtgcgatcttggctcaccgcaacctccacctcctgggttcaagcgattcttctgcctcagcttcccaagtagctgggattacaggcatatgccaccacacccagctaatttttgtatttttagtatagtatagtgtagtgtagtgtagtgtagtatagtatagtatagtattgccttgttggcaggctcgtctcgaactcctgacctcaagtgatctgctcgccttggcctcccgaagtgctgggattacaggcatgagccagtgcgcctggccacatttatttttaaaatgcatttaattgttgtaggtaattttaatttgactttatatgtttcttatttcagaagtttctccagtgcaaatatgtagcaatcatggtataatatacattccctgctccccaaaccccccacaattttgaatgcatatctgaattgcttttgttatttttgtttgtatatgataatcttttatgtggttctgaatcataaggacttttctgtcctagtccacttttgcaattatttattatcatgacctgtccaccataatttgccttctctttggaaaaaaagagccaaaaccaaaatataacttcctcccatcatcattattgcatcagatatgaaaagctgaaatgccttacttttttctcttggcttacttttttctttggagaatcttaacaaatggtgataagatctcttttctatcataaatagaacaaaatacatattacaaaaatatgaagcacagattgcttaatcaactgagacttgttggctatgtcgttgaagccatttactcatcgtttgaaaccctgtagtggtgttaataggtctgcagattctttggacacccctcccttaaaaaaaaatagagcctaacccttgaacatgggttgaacttagtgattcctacaatgactagaatgtggtagaagtggtgctatttactttgggagcaaagttataaaaatggggccgtatccactccactttttctcatggattattctgtctgggggaagctggctgctatgtcttgagtgcactcaggaggtcctgtggagaagaactgaagtctccaaccatcagtcagcacacatttgtcaagcatgtgagtgaaccacctaggaagcagatcctccacctccagtcaagtttcagacaacatcagtcctgaccaaccccaaatccctgacccatagaaaactctgggagttaataattgttttaagctgccacctcttggaatttcttaggcagcaaaagaaaatttatacaaacacttttccctgccctggcttcagtggtcctgagcatttacgtaaaaccctgacctaacttttctgaatttttctgataaataaaaatatgccatccactgaaacacttaatttttaaaggatttttaagatgtctttgttctgaatcactgttgacgttgtttaggatgggggttggtaaatttcttctagaaggccaggtaataagtatttttggcttttctgatcataagggctctgggctgggtgcgatggctcacgcctgtaatcccagcactttgggaggcccagttgggcggatcacgaggtcaggagatgaaaactatcctggctaacacggtgaaaccccgtctctactaaaaatacaaaaaattagccgggcgtgttggtgggcacctgtatacccagctgaggcaggagaatggcgtgaacctgggaggcggagctggcagtgagccgagaccgtgccactgcactccagcctgggtgacagagcgagactccgtctccaaaaaaaaaaaaggtctctgttgaaactattaatattcagctctgctgttgatttgggaagcagctatagacaagatataaagaaatggtcatgggggatggctgtgttctaataacatttagaaaaattacaggctatagtttgctaaccctgatatagggttttcccaggctgttaaagatatgagcttactgtcttcaaaaaggtagttatttatgtgtttatttattatacttttgagccaaaaattagaccttctgtatctttgggtttgtacatgtccattgcttcccgtgcaatcataataaccaaaagttggaatgtacacagtttttgatgtgtaactttctttttgtgttagaccctgattacataaataatgaatatgcacatttgtgagtatactaaaatttcaccataatgctgtaagtgatgttaaaaaaattcacgtacataaaaacaggatcatttgacttcaaggctaatgaaatggtcaggtgagccacatgtggtggataggagccagtcaccaattgcatggcttccaaatctctgtgatctaagagtttaattgtactactaatctgcttcgtttttgagtagctaccttatataggcagaggtgtacatatgcctcttagatgtgctcttttcttattttaggatcctgtttacctcccgtatccccccatccttatcagatcaatcttacctttgttcttttttgtcttagcgcttatcacagtggtaatttaagttggttgccttttcctctctacgctccagcagtgcaggttctgtgctggtctggtgaccattctgtttgtatctatgatagtacctggtccgtgataggcacttaaatgtttgagtaagataattgattattctccgagaagtacagtaagagaaaatgcttttttctcgaaatttaaagtgtgttttcctttccagtgccaaatgtaaatgcatgggtaggggtggagaatcttatgttttttttaaaaaattgagatataatttcacataccataaaaatcacccatttaaagtatacaatgcagtgttttttagggtattcagagttgtacagctatcaccatgatctaattccaggacatttttatcatcccccaaaagaaacctcatactcattagcagacattccccatacatgtacattttaacagtagataaagagtagcagctgccttgtggtacataaatgtattttatgaatccttgaatagggctctgaccagaaaaagaagcctcttaagccggataggggactttcaggggacagagatgagaagacctaaatgaagcttttttgaaaaaggagagatattatgaacagaggcccattaatgttaaatttgaagtggagtgatgaggaacagcttcttactagaacagtgttttataatccattagccacaatttatacttggatctcaaaggccaggatcagtattattgctacttctgtagcttcttccctatagctcatgggcatttctgggtcagtgaagggggagaagacccaaagaaactgaaatccacctttttgtattcctgcactgcttctaatcatatttgctcagtaaaggggccaaatagattattcgtgcactgagcaacagtagatttcctaggaagaagcttgtgtcagggaaatatgagtgaggaatgggctggttgatagtgtgtggtccctgagggggagatggtattctagcacataggaggctgtttttcctgtttttccccccccccagagcttataatgatacatgaatacgaaaaataattaatagcatgagtggcagaggaatgggaggataagcatgggattgggaaagttaactaaaggtatttgagcttgcactggatcttgaaaggtagaaaaagggagcaggaggaaactcatccaggtaagaaaaatagactgtgcaagatgggcatgagaaacagtgaggtccctggctggaggtgggtgctagtcatgttgagcactgctggcaggagaggtttttgttttgttttgttttttgagttggagtcttgctctgtcgtccaggccggaatgcagtggtggtatcttggctcgctgcaaccttcgcctcctgggttcaagcaattctcctgcctcagcctcctgagtagctgggactacaggcatgtgccaccacacctggctaatttttgtatttttagtagaggtggggttttaccatattggccaggctggtctcaaactcctgacctcgtgattcacccacctcggcctcctaaagtgttaggattacaggcgtgagccaccgcacccggctgcaggagaggtttaatatagtttggagcatatttagagggtggcttggaatgccatgtggcattacatggttcaggtcccatatgcttgaatgtatcaagtgacacaggactcactcactacctcaagggggagctctttccagtattggtttgtgtttattttaaaagcttttttttccccttagaaactgaaatttgtctcttgaattttcttcctgttttaagaagttccaccatctgggcaatacagaatatgaggaaaagtggagtttttgcagggagattagtgttagctgtgtgcaggaagggttaaagtgactggtagacagcccagaggtaggacctagagtctggagatgaccatagtagtggggagtgaaatggagctgtgcaggaagggactgctataacagaattgatggaaagagagaattggccagttgtcatgcatgttaactgccagcagggcctgtgcaagtagctgatcttttcagtaggtaaaactaagggacctggtatgtgaaaagttgtagtaatttattttcctgtgacttgaggcatttagggtggtgttgaggcagcatgtgctgctaagaacctgtgttcttacaggtgtaaaatgctgccttttaaaatgtttgcattatttgcttgtaatggatgtcaaaccttattttgtgttcattaatcacacgtattaatgtttattaatacatctgaaacatgttatttgtgtgagttcctatggcaatgataagtattggtaaacattagtgctcctttctctgttgatttgttgaagccctgttatttttctttttaattggaattccaccaagttttcaaaaattgagacatggctcattgggctggagatgctgatcttttagatttctctttactaatctaatggcatagcagaggttaaattaccttggagtagaaaatcaagaaatgattgtgtgtgtctgcaattttggttttaatggtaggacaagattatggtagtctgggaaaaggtgattgagtgctgctgaacagagcaaggattgattgtagctaagtctagtgacttactgcctgccatttggtttgaccttcattttgtgactatcgtaccactaaccacagccagtcacctctcatgtatgtgttgttattctcatggcaaacactgtgaaaacctctgggtaattcactgcagcctcttcttcagtgctgaaaaaacattttatagtgacaactatacatcctttgtcccccagatggccagaaggtgaagatagagtaagttcttttactaaatattcctgtccataaataaaaagcagacatcttaatgtttggcttacagttttttcccctttcatatctatttatgtttagacagatttgtcttaagatttctttgaaacgtttctttttaggttttggctttcaggtcattccatttcaggcaaactttgatactgcgaatgcattttccttgagtagaagatctcaacttactgaaagcagtcagtgttgttaagtactaaatctcaatcattacataaatcatcttttatgtaaaaaatgtcggccgggtgcggtggctcatgtctgtaatcccagcactttgggaggccgaggcgggcagatcacgaggtcaggagatgaagaccctcctggccaacatggtgaaaccccgtctctactaaaatacaaaaaattagccaggcgtggtggcacgtgcctgtagtcccagctacttgggaggctgaggcaggggaattgcttgagcccggaaggcagaggttgcagtgagctgagattgcaccgctgtgctccagtctggagacagagcaagactccgtctcaaaaaaaaaaaaaaaaaaaaaaaaaaagggtcttgttagttttagaacaagaaaggagtatttattgtctgctaacacaatagttaacatctgtgagtttgcaagcatctgggtaatcttagtacctatagttgatttgtgagcatactctaatggtacttgttttctcagcttttttttttttttttttttagagaggcaattactgttcattgtagctgttcttgtttttttaaatttttattttttattatactttaagttctagggtacatgtgcacagcatgcaggtttgttacatatgtatacgtgtactatgttggtgtgctgcactcattctcagctttttttaaatctttaaagcatgaaattacccagtcatataaaactgagggtctcttagggcattgttataaagaaaggatggaaaatgagagttcttaattgatgttaatggagagacattcttttatttatctcagtaattgtgtataactgtgtagtgaagctaaggacatagatgccatcttccttggtacagcttgaataatttgtatatagggagaaaaaatgtgtacacacatgtatgtgtatgtgtatatatacatagttcactgtgaatcttggcaaggcaattttcagaaaaataatgtatttcatccctgacaaaaggttattgagcacaagctgtcaggctcttgaggcatgattttctccctggcaactgactagagtcaagattgaaggaggcgaaaattggtctcctgtccagtgcagatgttgacagcttcagactgatgtacccacatctactataggcagcctggaagatagatgttaaaagacagctgtgattaggacaaagcacgtatcagtgactgttttaagtagagtttgagacgtagacaggaggcagaatggaatctgggtttgctgggttcatgatgtgaagacttaaaacatagctttgaagagcattgtgtgggtgtgtgtgagagagattgcattttaatttgtctgatctggttagtgtggttttaatcgggttgagatcatgagcttgatctcacatatgggctctttaatttttcacaagagaaaaatgacaagtgttcctactttggaatgttgagtatggatttcaaaaagtgttaatgatgctctggaagagcagtagctgggaaacattcaacattttgaaaaagattaaagttaagttaattagcttttcagattagtacaataactttattaaaactagcaagaaatcagctgatttttttctcatagtcttcctttgagttctggcttctcatttgttatcttaccttttccccttgttgtcttagaattttcatcctgttttctcctcttatttttgtggatgtctcttttcatgtgatcccattgtggcttggtcttttgttagaagtgctcccactccaattcatacctttcagatgttcctgaagactgtaattaatttaaaaattgttattgaccccattccttcagtctcaccatttaatccattttttcttgttcttcatttaacttgagcaggaaaagcaaaatataaattctgaaaaatcattagctggttgtcatctgggaattttatgtcttaaagttgtctgcctgacttaaactataagtctttagggcagaggctatattttctttgacttgggatgtttcaaggatgctgtctgcttctggatcactacccttgtgtgagcatatgctgctttgcagagacttgtgttctgctgtagccagcttggaattgaggaaagaagagtgaagttattacattctaatgtcattttgaagtggttcattttttccccttttattaaaaagtctgtcctgttaagctcacaaaaataaataacactaaccaggataataatatttatgagttacagtgggtaatattactgccttaatatatttgtacagtcagtgtagctgaggaagttattttaggtattaaaattttagttttggcatgacttcaaccatgatgttgcagtaacatgatttctactagttaatttcttaagaaagtgattccaagttgaaatgcatgttatgcatttatttgaatgtgtaatcaggaagtaagtgcctctctttggagtgtttctgaatagcagcagggcacacttgaattagtaaggaaaatgagaacatgaatatgtgtgttactttattttaacttttttttaaatccattctgtctgtcaactggaaaaagaaatttcaaagcttctttccttaccctcaggggatggggaagggggggaagttaagaggttttctaggcttgctctgattcagatgggcttatagtatttaaataacttcatattaaatgtttatttcctgggttgatttttttttttttttttttttttaagacggagtcttgctctgtcgcccaggctgaagtgcagtggtgcaatctcggctcactgcaacctccgcctcccgggttcaagtgattctcctgcctcagcctcccaagtagctgggattgccagcacccgccaccatgcctggctaattttgtatttttagtagagacagggttttggcatgttggccaggctggtcttgaactcctgacctcaggtgatcggcctgccttggcctcccaaagtgctgggattacaggcatgagccactgggcctggcctcttttctttcaaaagataaacagttgtgtggatttaaaaaaaaaacaaaaaaacaactgcatcccagaaagttctcttaaggcatctgtcagggattctttgagttattctcagtttatctgtacttacagggatatcatctaggggtctgtttttaccaaatatccctccttgataaatggaaggcttgattgagaagattaaagtgtgttattcaggatcatcctcatgtcatagggcacgtgggttatgccaaatatatactaccatttggttccttcttataagggctgtgttatgaagtctattattctttgcatctgtattgccaatttgcatctatattgacaagtgtggaaaacattttattaccagatcatagaaaatgaattaaaatttggctgggtgggagtggtgggacatggagatgggatggggtaggaaacatatattaactttggattatcttgaagttaggagataattttgtgaagtcttggtcctgttattttattatgttgtaaaatgaaagttggtggaataacagatgaaaatagttatcaggcccacgcctgtaattccagcactttgggaggctgaggcaggtagatcacctgaggtcaggagttcgagaccagcctgaccaacatggtgaaactctgtctctactgaaaatacaaaaattagccagatgtggtagcactcacctgtagccccatctactcaagtggctgaggtgggagaatcacttgaactcgggaggtgaagcttgcaataagccaaggttgcgccactgcacaccaccaccaccctaggtgaaggagtgagactctcaaaaaaaaaaaaaaaaaaaaaaagagctggccagtcatggtggctcatgcctgtaatcccagcactttgggaggccgaggtgggtggatcacgaggtcaggggtttgagaccagcctgaccaacatggtgagaccccgtctactaaaaatataaaaattagctgggcgtgttggcgcacatctgtaatcccagctactctggaggctgaggcaggagaattgcttgaactcaggaggcggagattgcagtgagccgagattgtgccacggcactccagcctgggcgacagcgagactctgtctcagaaaaaaaaaagaaaaaagaaaaaagctatcacttgttggtgagatcccttaatcaaatcagatgtatttaagagaatttggtataaagtaggtttatcagtaggttttggagctaaagcaccaaaaagtaactttcaagagttaggaatctcatggtagggaagttttgggcattcattaaatccagggctggatgttttttactctgtaaaacactgtgtaaaaagatgccaagctgttaagtacagggcagttttattataggcttgcctgtgatgttggttactttctctcttttttttttcttcctctagttctactccctgggtagaattaaaaacggttttaaaatgagcgttaattttctgcagtgaacatgtgttttgatagtaagagcaaaaagaaaaaaaatgaaaacttacaattttgtatcctagagatgaaactaatggttaacatttttgtcctaaatgctttccagtttgtcttctgtgaatatgctcacgtgggtagagatatgttgggtttgattatgtcatttgctttttttcatttaatggatcctgaacatctttctgtaatattaagtattcttctacaacataatttttaatggctgaacactatcctctagagagtaatatgatttaagaacattattttataccagcaaactaaagacttctctttaatactgttatgtcaagagttttattcacttttcacattttcaaaggagtatagtattaataaatagttacaatcctagttttttactttaaagactgaaggctcctattgttaagaagtatgtatcggctgggtgcggtggctcatgcctgtaatcccagcactttgggaggccaaggcaggcggataatgaggtcaggagatcgagaccacggtgaaaccccatctctactaaaaatacaaaaaattagccaggcgcggtggcgggcacctgtagtcccagctactggggaggctaaggcaggagaatggcgtgaacccgggaggtggagcttgcagtgagcctagatcgcgccactgcactccagcctgagcgactgagcgagactccgtctcaaaaaaaaaaaaaaaagtagtaggtatctgagaagaaataaaaggttttagatagttaaaatcattttgagataaagagaacaaagttacttgagcaaggttatctgggaaatcagtgggagaagggagagttggaattccaagtatgctcatgaaactgatcctgaaatgagtaatttgaacatgtttaagatagttgatggtgtctaactcttctcctggaagcttttgtcattttagcgcagggctgtttttgctggtttgcagaagcatattcaggtggatgtctttaaaatctcttttctcttttggatttggcagttgataacaaacaatatgctcctgtaaaatgttctgtttaagaaatgcctacctaaggtctgtgtaaccattgaatcttcttccctgcagcaactctacagaaaattttaaaaatgagattggggctacagatacccatttattttaccacttggcttactcttattttggataaaacccctctagttagctgactttataagcttttacagaaagattttgtaatatgtgcaagttttactttttcatttttgcatgaactagcagccatgggatttttatacttcagaaaaaagaaaatttgaagcctgagttttattatcatacacacaaactaaagatattggcatttttatcatttaaaaactttttttatataaaagtatattcactatagaaagtaaaaataaacaataaacaatcacccatcaggctgtaccaccttatgattaagctctgtcgatattttggtatgtgttggttgtagtgtttaccatcccatccctttcccaggacataaacacattgtgatctccattctcactgtgcagtacagattgttatatatctgctatttaaagtggaaatgaaaatcatttccattaatgaagatacctgggtgggggcagattgtataatttatcgaagataagctgtgtttctctactgggctggcaaaaatattttttctggaccttaaaggtagaaaggttctggtgaagaagctatttaaaagtatccttagtattattttggggaaggagatataactttgccctatttattgaggtttttggaggacttttacaggcagtagagatgtttccatagctggatttctgagccattacgttgtggttgggaacctttcttttgtagtatactgtagaattttgggatgtgacactgtaaatgggatagatgaggaagatgaccagttcctgagaactggaaggaatcccagcttgacttgagaacttctttaaaacaaaatgaaacaaaacaaaacaaaaaaactgctaaaaaaaaaatttaaaaaaagcagttggaaaaacgtaaggcacagcaagctttggttgtagctattagcacaaaaggaacaattattactactttctgcactatagacagtggagtgaaggaagctcccctcatcctttacagcttcagcatttaaaattaaaagctaacatttcctctgtcctttaggaaacttggtatcatgactttatttctaaaaaggtaagaaacagctggtgtgtggataatgacatgttctaaataggtttaaaaactggaaaaagtagatggaaaaatagaagggggcacagaagtatttgttgagctttgcatatattatttcatttaattttcaaaacaactgagtaaggtatgggagatgtgtactcattttacagaaaagaaaacagctagagataaaacaacccaaagtaacacagctgccaaatatcgaagctggatttagacccagttccaataccttatttcatctacaccaagtagtgttctgggagagaagtagttatattcattaacattacttcatagcattctttgttttaaaggagcaatgtaacaggttcaggttaaaacaaacaagccttttgttttttttatccatcacccaaatattttccaagcctatcctttccccgtaactttataaagtttggttgctttcaggggaatttactcatgatatttgatgcttcaaaaacttcttgattttgtcttctcctaataaagaattgtgggtttttttgtttgtttgtttactttataattgcccattgtctttgttttaaactccagaggaacttattttattcccagctcaggagagaacatcaggggatgacagattttatttcatggcagatggtacagtagtattgagctctcttaagtttcatctcctttgttagtagatgtagtgtagttgactggaaacagctgggacaaagtcaggttttacaaccgtgcgatcttggatatagttcctgtctacctcagtttccccagtttgcccttttgtgtgcagagagcacttttgatatcttataaatttaaactaacaggtatctttttaaatttttaattttttttattaaaaaaaattttttttgagatggagtcttactctgtcacccaggccactgtgcctggctaatttttgtattattattttttagtagttctggtcttgaacctctgatctcaagtaatcccctaccctcagcctcccaaagtgctgagccatcgtgcccagccttctgccacattttgtttttttagacagagtttcgctcttgttgcccaggctggagtgcaatggcgtgacctcggttcactgcaacctctgccttccgggttcaggcaattctcctgcctctgcctcctgagtaggtgggattacaggcatgtgccaccacgcctggctaattttgtacttttagtagagatggggttttgccatgttggtcagactggtctcgaactcctgacttcaggtgatccacccacctcggccttccaaagtgctgggattacaggcgtgaccaccatacctggccatctttttttatttttagagttcttttaagagacatgagagatggaggaaaaaaaagttgttgattcctttttacaatttttttaagcaaggttttgagcatgggttctttttacatttaattttgaaatgaaacttattaaacatctcaagttagtcttagtgtcattttttttttttttgtaaggatgaccattcagaagtttgaggacctcatttttagctgggggcttatttatatacttgtttatagttttgctgatggagaaagtgtgaatattttaacccattatacagtgtgtttctgatgtattttttcattactaatactttatgttagccatgaaattaaggatttgtcattagggctgtgagctaaaataaattagagtagatgtagatgtatgtatgtatgtatgtatgtatgtatgtatgtgtgtgtgtatgtgtgtatttagagacagagtcttgctctgtcgcccagtctggagtgcagtggtgccatctcggctcactgcaacctctgcctcctgggttcaatcgattctcgtgtctcagcctctccagtagctgggattacaagtgctcgccaccacacccagctaaatttagtatttttagtagagacggggttttgccatgttggccaggctggttttgaactcctgataaatgaattcagcagaccactgtaaaaaaagaaaatccatgaagctgtagctgctacagcagcaagcatgaaaacccctgcactttttatgaaaataattttatcttgtcaacacaagataaaatgcagcttctgtgtgggtgcagggctgctataagaaaggcatacctatagactagtaagattcgagaaaaagcaaagtcattatatgacaatttaaagcaaaagggaggtgaaagatctagagttgaagaatttaatgccagcaagggatggtttgatactttaagagagatgtggctttaaaaatgtcaagataacaggggaagcagcttctgctgaccaagagaagggttcccaaatgccattaaaaagtgcagcagaaggccaggtgcagtggctcacacctgtaatcccagcactttgggaggccaaggcaggcagatcacctgaggtcaggagttcgagaccagcctgaccaacatggagaaaccctgtctctattgaaaaaaaaagaatagaaaaattagccaggcatggtggcgcatgcctgtaatccgagctattcgggaggctgaggcaggagaatcacttgaacctgggagacggaggttgcagtgagctgagatcgcgccactgcattccagcctgggcaacaagagcaaaactccgtctaaaaaaaaaaagtgcaacagaagggtgggcacggtggctcatgcctgcaaccacagctgcagacttcaattcacagtatgtatcaggcagttcggctttttcttacaatgtcatgacttttctttacctcttggtagtacttccagcatcactagtggcactttgtattagcttcatggtgtttctcaatgttttgagtgttgtactaaacatgatgaatgagaactacgaatgatcacttttcactgtcatgcaatttactggctgtgaactgctcaggtggagatgattagcatcgcatgcagatgcatcatatggcattttaagtggatattcacaatacttgaccatactgcaatagcaataggagatggctacaaaattattacagtagtacagtgtgtactacaattaattttatgtttgattatatttcccttgactgcgaatggcaccatgtacggcctgtgtttgtgtgcataagttttgattggttaactttctgtgataggtttgtgtatatttatggtagtacatgataaaataggctagtatctacagatattttatgcattcatgatatacctaactttctcttaattttttggtacttctggattacatgatgagtttttttcaaattgttgcaaatctctgaaacaattttcaatatgcttattgaacaaaatccacgtataaataaacccatgcaattcaaacccaaactgtgttgttcaagggtggctgtacaaacttcgctgctagcttttaagtgtacaaatagctgcataaataaccgatgtgcatcatgaccagtcatgtcacttctttcaaagtctgttggtgatagttccctgcaaatctgttcagtttatgcaaagtgtgtagttgtgttgcttccttttctcctagtgataaacccacatgaactacttgacagaattgaataattgaaagattattcaacacaacaaagatgaatgtgcaacaaagaaatgaaaagtgatagacctggaattgaaatttgattagaatataaagggaagaaatagctgattgtggaaatgttgaccctgctgctatttaaaactctagctatgcagctagaactacttagtgaaggcaaacttctcgacttaaatgaggaatgtggttgtgatgtccaagagaatgtgtgatgtcattaaaaacgacacattaaaggaactcttgaagatattcatgacaaataagcgtagatattggataaaatgttggaaatgggtccaaacttagaaagaaatatgatgattcgccaagggattaaaaagatgctcattctgcaccctaatgtaaatgacaagaagaaggcagggaagcattgttcaaactacttttgaaaattttttttcacaaggaaataaaatattttgtctcagtgtttataatgttttaatttagtacattaagcaaatattagttgactatatcatatccctatacatttataatagacaataaaggaatttttaatgcatagacaaaagtatttatttttaatttttattttgtagagatggggtctcactttgttggccagggtgatctcaggaaactcctgggctcaatcgattctcctaccttgacctcccaaagtgcagggattacagttgtgagctcacatgcctggctgacaaaattttggggggtcttattttttaaaaatttatttttttcttttctccaaatatgatgttggaaactgccaaaaatttttaaaggttacgggagaatcataattctctgtgattaatctctgattaagatcaggttgcactgtttcagcttgtatggtcatttttacagtcctgtgctactgtgcaaagtgaagatgatcagtattgttatctctgttttacaactgtggaacctgagactattaagtggtgaagctgtggtttttgttttttgacttctgagtttatgatcttattctctattatactggttacccctacacaagatttttatattctgagacagggtcttgcgctggagtggtctggagtgcagtggtgcagtcccagctcactgtagccttgacctcgtgtgcttaagtgatcctcccacttcagcctcctgagtagctgggattacaggcatgcaccgccacacttagctaattaattttttttttttaaatagagacaggttctcactatgttgcccaaactggtctcaaactccctgggctcaagtgatcctcctgcctcagcttcccagagtgctgggattataggtgctacataaaattgaaaataaagtagaaaataattcctttagtagcccttgcttttcctcctggtaatgggccaaatttttttttttttttgggagatggggtctgtcacccatgcgctggagtgcagtggcatgatcgtggctcactgcaaccttggcttcctgggctcaagcgatcatcccatcttagcctcccaagtagctaagactataggtgaatgccaccatgcctggctaatttttctttattatttgtagagatgaggtctcacaatgttacgtaggctggtcttgaactccttgtctcaagtggtcctcctgcctggacttttcaaagtgctgagatcacagatgtgagccaccgtgtctggtctcaggccaaattcttgaaagagcagtcttatttataacttactttattacccttgaaatctggtgtgtgcaactcccagaaagccacttgtcttcttcgttgtcttgtgctagccacattggcttccttggccttccataatctttttagatctttgacttggtgttccctctacctggaatgctcttcctccagatagccacattattcctgtgattcctttgtcaagactgtcttcaaatcaaatggtattttttcaaggaggcctaccttgatccccctattttaaattgtatcttacatcccttttctctctgtcctcctttctgtcactgcccccgaccctactccagtactattgtttattgtctttctctcccactagaatgtaagttccctggagcccgggattttttcctggcctggttggttaatttcctggagcatttagaatagtgcctggctgatagaaggtgatcagtaagcatgttttgaaagaggcatgaatgctcttgaagattgctgttgaataggtgaatactgatgaaacacaatgaagaccttttctctgtcttctgatcttgttttacctagaattaatcatttctaccaaccctattttgtctcctagtgcttgctgcaaggcactgaactaggcattttacaaggtatcttaattgacactcacagcaggtattctacacatcgtgcagaggaggaaacagaatcataaagtctagttgcatagctggcaagtggcaaagccaaaacttaggcctatatccagctccagagcctgtgctctttcatgttactgcattcaatactggttttttttcctttgtgttttttgagctataactcaacatacataaaattcatcattttaaagtgcacaattcagtggtttttagtatattattaggttgtgcagccatcaccactgtgtagtttcagatgttttcatcatcctagaaagaaacctagttttacctgttggaagttagtcctcattcttacctgcttcccactgcccagcaagcattaccttctgtctctatggatttgcctgttgtggcaaatggcgatttcatataaagggaacaatacagtattctttcacttaacatatgttttgaaagttcatccatgttgcacatgtatcagcacttcattttttcttacggctaaatactggataatgccacattttgtatgtctgtttttcagttggtagatgtttgggttctttctgctttttcagctgttatgaatagtgacactaagtattcatgtacaggtttttagttgtgtagctatgtattaggttggtgcaaaagtagttatggttttggccatttaaaaaaaaggtgatgaaaactgcaattacttttgcaccagcttatattagtccgttctcacatagctataaagaaatacctgaaactgggtaatttataaagaaaagaggtttaattggctcaaggttctggaggctgtacagaaagcatagtgtcttctccttctggggtggcctcaggaagcttccaatcatggtggaagggaaatggggagctaggcatctaacatggtggggaggagcaagagagggggtgggagaggtgtcacacacctttaaacagccagatctcatgagaactcattcaccatcacaagaacagcaccaagaggttggtactaacccattcatgagaaaccactcttatgatccactcatctcccaccaggccccacctccaacattgagaattacagtttgacatgggatgtgggcaaggacacagatccaaaccatatccacctagcagtggaattactgagtcatatgataacatttaaccctttgaggaactgccagactgtcttccaaagtagctgcacctttttacattcccagcattggggtatgagagttctaatttcctcatattcttgccatttgctattatctgccttttttattatagccatcctaactaagtacaaagtgatatctttgtgtggttttgatttgtattacctgatggctagtgaggttgagcatcttttcatgtgcttgttggccatttctaaatcttcagacaggcacctgtttaaatcctttgcctattttaagttggattattggtctatttttgtttgtttgtttgtttttaaagaagccaggtcttgctatgttgcccaggctagatgctaacttctgggctcaagcagtcctcctgcctcagcctctcaagtagctaggactgcagacacatgccactgcagccaacttaaaaaaaaaaattatttagtataagagttctttatatattctggatactagatccttataatttgcagaaatttcctttcatttgtggattgtctttttactttcttggtagtgttctttgaagcacaaaattttaaatttttttgatgatgtcaaacttacctgttttttgttctgttgtttgtacttttggtgtcatagctaagaaaccattgtgaatcagaggtcatgaagacttacaccagtgttatcttctaagtgttttataattttagctctaacatttaggttttgataaattttgtaagtatatggtgtgagataggggtccaacttaattcttttgcatattgcacttgtcctagcaccatttgtggacaagaccattcttcattgaatattctcggcactcttgttaaaatcagaatatatttctggattctcaaagttgattgatctctatgtttacatttgttttggttgaccagttttctcttacaagtctggccttcttgtttttgacagtcttggttctcttcattgtttcttttattgcagaatcttcctctccttactctgctgtccacagtctcgagggtcctaacttttttttttttctaaatctttcccaactcatgtgttttcatacatctctggctttcttctcccgctcagaaaggccctagcttgcaacctttaaataatgtactgtgcttaatcaaaggtgatcagatcttttgacccctgcctttgtaatttactactactctcttctgggctctcactgtagctttctgatccatctctctggttaggtttattgtatgtactttagataggttaatcctctttactttgacttcactctggttgagggaattgaattctgtttgtctctggcctttctactcccatcttctgcttcttctaagcatatcccttactcctcagttagactagataattcagactagatattatgcctctaagcctaattaatatatgaattatatattaatatataatatacaagccttattgtatacctcagcatgataagtggttctacaaagagcataaatactggcattacaaatcctgactctgccatttactagttaggtggcagggatttagttagttaatctgtataagctttagttgcattatttgtaagccaaggctaataccacttactctctaggtgggtgacagaattttaaaaatatgtgtagtgccatagagtagatgttggacttttttttttttttttttttgagacagactctcgctttgttgcccaggctggagtgcagtggcgcaatctcggctcactgtaacctccgcctcctgggttcaagtgattttcctgcctcagcctcccgagtaactgggattacaggcacctgccaccatgtctggctgtttgcatttttagtagagatggggtttcaccatattggccagatgggtcttgaactcctgacctcaagtgatccaccggtctcagcctcccaaagtcctgggattataggtgtgagccactgcacccagccagtgttggacattattatgttactgttccttctgcttgaggtggtaactcccttaactctgctgcccacatccttcctctcctttgagggatgggttcatttcagagtaccaagccttccataaagctgttgctggtattcatttcttccctaaactagttgttagtgcttcctcctttgaattcccatgacaccttgtgttttctttcttacagcttgtatgttaaaatgccacataatttcttaatggtcaaatccatcttttctggataaattatttgaaggcagggatgttatgttcagctttgtgttttggaagtggatttgtttgtttttagtgtgtagtaagtgctaaattaggtgaagttctgcttattatatagggtcaacatctcttgcttattctctcttgtttggtagtaatattgtttaagacagtatttatatatatatatttgagatggagtttcactcttgttgctcaggctggagtgcagtggcgtgttctcggttcactgcaacctccgcctcccaggttcaagtgattcttgtgcctcagcctcccgagtagctgggaatacaggtgcctgccaccacacctggctatttttttgtatttttttagtagagacggagtttcaccatgttggccaggctggtctcaaacttctgacctcaggtgatccacccacctcagcctcccaaagtgctgggattacaggtgtgaactaccgtgcccagcctaagacattattaatatatttttaaggcaaatatctctttctgcatggcttttcagataaattcttccctgagtaaatagttttcttcagcgtatttccagagcaccttgttcacaaggctatttaatttttgggtgcattgtaatactctataatttgtgaaccctttgagaccaaatgccgtgtcttaaccagttgttaattttttgtctccctccttccctccatagagctccagtagggtatgcccttgatgtgcgatgggtgctcaaacatttgttgaacaaataaaagaatgaatgatctccatcttttaaaataccagaagatactagcattaatgttacgaatccacataatgattgccatatgtctgtatcttcctgaagatgtaagagagaagactgtgttagatccaggaaaaccttttaactatataattcattggaagtttttttctggcctgacaaatatgtggagcgtatctttactcttagaattatacagtgcttctaagcctaattaatatatgcatgtgaggcaatttttcccccctcttctgcttgtgttgtgcatccaaagatgatagctaggagaaatttgataggtctgttgagaaatagctagtcttcttgaaagtgccttaaaaaaaaaaaattcagggaagacatgagagtgtgaatgggttttaggctttaatgtgaactgaagtgggcttgcttagccaaaggagggagtaattgcttttccaggattccaaagatagtctccatagaggccctatttgtataaccagtggacaagacacaacactggccctttagttgcttctagctgtaagaaaagagtggcaatgggcactgtaaataattttaagacacaaatgacagaaagtataagtttcacaagtttctaggaaatgttataaattatttttaaaaatttttttaaagagacagggtcttgttctatcacccacgctagagtgcagtggtgcaatcatggctcactgcaacctcaaacacatgggctcaagagattctcctgccttggcctcacaaagcgccgagattgctggtgtaagccaccatgcccagcctataaataaattcttgagctcaggattgtataagttggatattcctataagctatagtaaaatctattttatatgtttttagctagtttttaaaaaattatagatacaatacctcttcattatagaaactttttataagtacgaaatgtaaagaggccgtgtgtaacccaatgataactattatttgccttttgactccagtctttcctctgtatttaaaaagaagcatacatttatgatttcatttgtttctgcttaacatttttcatatatataaatattttcataatagtcaattgtaggccataccataatttacttaactagatgcttattgagcatgtgagcttttggtagtgttctgtgaaggaaatgaatgaatcaatggctgagctctgtattttcacataccagtgagtctctgttatggctgtacacatcatgtagttgggatgattaatgaagtgtggtggttctgcataattgtggccctgtttctgtattctatggatgtgagagtagattttattagatatgttttttctcctgttcaaatcttgaatttttcttttttttggatacatataatgcccttttttttttaaaggaacattattagatcaaagggaaatatttttaagcctcttgatatatagtgccaagtcactttccagatattttgctttcaccagcaatatatgaaggtgctttttttagtgatagctataaaacaaacaaaggaacagcaaacaacaacaaaaatgaaaactcttaaactaaatttgtgcatgaaatatacaaagtttggattatttttatatttttaaaaatgtagatcagttatttgagttcattcttgctgagtttgtttttcattctgtaaaacaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtaagtatacaggcctatgtctgtaatttgttctatcacaggaagattgctactggccttccttagttcagtattccttaggatttagtttggttttgaatttggtttatctcaatggaccagagatgtttttgtttaatttccacttactcctctattccaagtatatatcatcctggctctgttctgagccagtgttgtcttggctgtaatgaagaacttgtagcaaagatactgttttgactccttccctttttccagtaatgattaaatattttccttgtagagttctggagttgagaaaccaagatacattaaattttgtacttttatttatttatttattttttccatttaaccctgagtggacacagcacatgtttcagagagcacagggttgggggtaaggtcacagatcaacaggatcccaaggccgaagaatttttcttagtacagaacaaaatgaagtttcccatgtctacttctttctacacagacacggcaaccatccgatttctcaatcttttccccacctttcccccctttctattccacaaaaccgccattgtcatcatggcccgttctcaatgagctgttgggtacacctcccagacggggtttcggccgggcagaggggctcctcacttccccagtaggggcggccgggcagaggcgcccctcacctcccgcacggggcggctggccgggcagggggctgacccccccacctccctcccggacggggcagctggccgggcagggggctgacccccccacctccctcccggacggggcggctggcctggcgggggctgacccccacctccctcccggacggggtggctgccgggcggagacgctcctcacttcccagacggtgtggttgccgggcggaggggctcctcatttctcagatggggcggctgccgggcggaggggctcctcacttctcagatggggcggttgccaggcggagggtctcctcacttctcagacggggcggccgggcagagacgctcctcacctcccagatggggtcgcggccgggcagaggcgctcctcacatcccagacggggcggcggggcagaggcgctccccacatctcagacgatgggcggccgggcagagacgctcctcacttcctaggtgggatggcggccgggaagaggcgctcctcacttcccagatgggatggcggccgggcagagacgctcctcactttccagactgggcagccaggcagaggggctcctcacgtcccagacgatgggtggccagggcagagacgctcctcacttcccagacagggtggcggccgggcagaggctgcactctcggcgctttgggaggccaaggcaggtggctgggaggtggaggttgtagcaagccgagatcacgccactgcactccagcctgggcactgttgagcaccgagtgaaccagactccgtctgcaatcccggcacctctggaggccgaggctggcggatcactcgcggttaggagctggagaccagcccggccaacacagcgaaaccccgtctccaccaaaaaaatacgaaaaccagtcaggcgtggcagcgcacgcctgcaaatcgcaggcactcggcaggctgaggcaggaaaatcaggcagggaggttgcagtgagccgagatggcagcagtacagtccagcttcagctcggcatcagagggagaccgtggaaagagagggagagggagaccgtggggagagggagagggaggggaagggggagggaattttgtacttttagaggccaatattagtgtttttcccactatgaagctcctgtgtaattgctgtttaaatgttagaagaccatgcgcaaactcgagagctaagtttgggttgctttttgagtagttgttaacaggaatgaaaattcctaggatgccatcttctttacagacctacattcagaatttttgggttttggggtctttcttattttataggtggaagatggtatcttgaagttgaggaatgctggcaatgaacaagacttaggaatccagtataaagccctaaaacctgaagtggataagctgaacattatggcagccaaaagacaacaggtacagtcatgatttggggatatattaaagttgttcattttactatctagagggaaaaactcattctgtgtgttttctgaaagtaccattacttaccttcgccaatatagttccattaaaacatttaaactaaggtgtcttttcagtattgtgctgttaataaagttgtaattacattgcattcatgttatgctcctattttaattcttgtgaacattttatcttaagtagcttgacaacttgtgatgaaggtagtgtctggagaggtaataggtctttgtgtatttaaggattaacctgaattagtggtgcagttttgttcagatttttaataaaatcttaatccatttaaatatactggaattatctctgtatcagaaagtatctccataccttgccccaccagccccgtgtcttgttactttttaactgtttcttattgttattagtattttccattgtgtggcatgaggatcagtgttaacttttccaagctccagtagccctttgacccttcggcattttcactgttggtgtgctttgaaacccttcctgtgcccttgctgttggacgctgtgtatttcaggtgtatattcttcaaggaagatccatatattgctatccatcttcttatatctttcatagtcctgatcaagcttacgctttacattcttactttaaaacaagccccaagaagaatagttgttgttagctagtacctttatcagttaggatactttgcactggagtttgcagaaaacccagctcccaaactgcttgaaaaatgggggatttattttctcattaagtataagtcctgagttaggctaagtgacttcagggttgttaaatataagggctttgcagtatcatcaaggatccaggttcttgatatttttcatcactatcgtcttcagtgtgcctggcactgggtggctgcagaggctctttgcatgacatctgcacataatatgtccagtgagaacaaaaaggactgttccttccatatgtctctctttataagcaaacaatctagaagctcctagtagacttgtcctaaatctgaattgtgcaacatgcctattcctcagttatccctggcaagaggaaaggagtctgcctgactcagaataatccagatccaccttctgctctgggttaaggggtagctttcctgaggacagaaacacccgacaaaaggtctgacaggtagtagaaagttgggttgggagtagtgggagtagggaatggatttgggtaggcaacgtgctatgactgctatagacttttttcattacagcaagatggttgtcagtaaacacataaaaaaattttttttgaggcaggagatctcactctgttgcccaggttggagtacagtggtggcatcatgtaacctcgatttccccaggctcaggtgatcctcccacctcagcctcctgaatagctgagactataggcacaggacaccacacccggctaatttttgtactttttgtagatacaggattttgtcatgttgccaggctggtcttgaactcctgggctcaagagatcctcctacctctgcctcccaaggtactgggattacaggcatgagccactgtggctagctaaatgctattaaagtctaatatatgacagcttcttttctgggggcttcttagtcatttggttatatttacattagtattaaaaatctatgccatagggttgagaggattcaaataaataatatatgtacagtgtttaatatagtgccaggcactaagaaggcccttctcagtaggcagttggtgaataatagtttattgcttatatttcaagtcataagatgtgatcagactaacttatatatgagatcctggttttgcatttctagtacttaagattatacatggtaatatagctaggttggtatacccaagttagtgtaggctcagtgtgctttttttttttttttgagatggagtttcgctcttgttgcccaggctggagcgcaatggtgcaatctcggctcaccacaacctccgcctcccgggttcaagtgattatcctgcctcagcctcccgtcagtgtgcttttataatttatttttgtattggcttagtctccatcatataaattataagtatcttttctttttgctggagctaattgatcctgagaagaacttgtttaatagaatggtaatcctataaatgtggcaagccggccaaattacattcacaatttattttaattaatgggtttgatacaaattctcttttgaatatgtgaagtaaatattaagttatatttaaaagatacaatttggcaaatagtcctactggtttaaaacgtagtctgagcttggtttatgaagactgactgttatttagacaaaataaacattaagattgccactattgtgcatcattgcaaaatggcggaataagtaaatagatgggtttttttttgtttttttttgtggtggactcacattctgtcgcccacgctggagtgcagtggtgcgatctcggctcactgcaacctccacctcctgggttcaagctattctcttgcctcaggctcccgagtagctgggactataagcgcctgtcaccacacccagccaatttttgtatttttagtagagacggggtttcaccatcttggccaggctactcttgaactcctgaccttgtgatccacctgcctcggtctcccaaagtgctgggattacaggcatgagccaccacactctgtctggaattttgtatgctattcaagaaacttactagaaagtaatgctacctgagttgttttttttcttttttccaaagccaaatacttctcaatgcctaagttttaataccatgttccatggatctgtgaagagttccttgaacataatcccttatgtatttttttcatgtgtttttttttgaaagtagtagcaaatgccaaagttttctgaaataagatgtcacagaaatattggaattattatatacatgctggataatcttctgtttgcccttccatattgtttcccacccttgtttaccctattctctgccccaggaacctaacctgcctggatttcatttgtgggctcctgcttgggcttggtgagtgggagcaccagcaggaggtcaaaggagatagagtgatgctagggtgttactcttaggcctctttcctgctgggtgccctgggttgctaaaagtgatggcattctctacacatcttgctccctggttttggtaactgctgcctcctcttgtcccttcattcctaagtgtcctaccagctttgtagtttttctgtattttgtccatacctatgtatgatagtatagtctctaaactgcctttgagtcacccgatttgattttattctatttttttctgccagaattttgaatgatacgtattcgcattttcttgggtttatagtaagtcatgagtcatttgtagttttccttgggcctaagtttttagccttagcctcctgaaagagaattcactgagtagactggttgtgggctcctgtgtacccccgttcacaaaatggtcttttataggcttgggccttggtgtatattccagtagacgaatgcttttcttggaaattaaacaaatactaattttgtcctaagggcccagcctgatggaaacttcattatttcttttgggcactgtccattggcctccttcagtagaatttattcctcctatttaactgtatatttgtatctgataactaacctttggctacccacctctccgcactacccttcctcacttctatgagtcaacttcttaagcttccatgtaagtgagaacatgtggtatttatcttcctgtgcctggcttatttgacttaccatagtgttttctgaggtcatccatgtttccatgaatgacagaattttgtcttttttaaatggctaaatagtattccattgtgaatatatgccacattttgtctgttgatggacacttaggttgattccatatcttggctattgtgaatagagctgcagtaaacacaggaatgcatgtctctctttgacttactgatttcctttcctttggatacccagtagtgggattgctggatcatatgattggtctatttttagttttttgaggaaattccatacaattttccataatggctgtactgatttacattcccaccatcagtgtataagagtgttcccctttccctgcattcccaccagcattttttttcctttcgttttgctaatagccattctaattagaatgagatgataacctcttggaggttttgatttgcttttctctgatgattagtgatgttgaggatctttccatatacctgttggtcatttgtatgtcttcttttgagaaatgtatgtttagctcatttgtcttttttttttttaagacagagttttagtgtgtcactcaggctggagtgcagtggtgcaatctcgactcactgcaacctccacttcccaagttcaagcaattcctgtctcagcttcctgagtagctgagactacaggcatgcgccaccatgcccagctgatttttgtatttttagtagagtcaggttttcaccatgttggccaggctggtctcgaactcctggcctcaaaagtgatccacctgccttggcctcccagagtgcctggattacaggtgtgacccaccgtgcccggctacatttgcccattttaaaatcagattatttgagtttttgctgttgagttgtttgagttgtttgtatattctagatattaatcccttatcagatgaatagtttgcacatattttctcctgttcttcaggttggctcttcactctgttgattatttcctttgttgtgcagaagatttttagtttatataattccgtttgtctgtttgaatataacattccattttttcctggcctgtagcgtttctgcatagaaatctgcgttattctaatgggaattcccttttatgtgacttgatgcttttcacttgctgtctttagaattttatctttgtcttttgacttttgacaatttgactataatgtgccttgggtgtataactacccactaattataactacttttttgattcaatctctttggggactttttgggctttttggatctgtatgtccatatctctccccagacttgggaagtttccagctattatttaattaaataggttttctatgccttttcttttctccttctggaattcccatgatgggaatattggttgatttaatgctatcctataagttttgcaggctttcttcactctttttcattgttttttgtttgtttgtttttcctctgggtaatttcaagctacctatcttcaagttctgagattttctttttcttggtgaaatcttttgaaactttctattgtattttttattgaattcttcgttgttttcaccattaaattctttagctgcatgatttctgttggttcttcttcatgcattctttttgttgaatttctcatttacatcctgattttggtgaattttctatttgtattttattgtatctctttgaggttccttaagataattattttattttatctttttgagacagactttcgctgtcatctgttgcccaggctggagtgcagtggcatgatcttggctcattgcaacctccacctcccaggttcaaatgattcttgagccttagccccgtccctgcgcccccgcccccacaaccaagtagctgggattactggtgtgagccactgcatctgggcctagattttaaattctttttctggcagtttgttgatttcccccttttttttcctttttctttttttttttttcagacagggtcttgctctgtcgcccaggccagagtgcagtggcattttctcggcagtctcaagtgatcctcccatctcagcctcccaaattgctggggctacaggcatgccatatccagcttttttttttttttgggagcgggggtgggtagagatagggtcttgttacgttgtccaggctggtcccgaactcctgggctcacactgacttcctttttattgggttctagtgttaaagagttatattcctttcttggtgtcatatttacttgctttctcatgtttcttatgtccctgttttgatgtctgtgcatgtggtgggacaatcacctcttctacagtcttttgaatggcttttatagagactttcccttgcagttggattttagtgtgctggttagggagtgtgtgttggctctgtgtccagtaggagcaatagtacagtcttcgtgcagcttcttcacctgtgttcaacatcagcagtaactttgggtgcctcagttgcctaggctgtagaagtttgtggtagttgtggcagtcatgtaggtccttggtgtcaagggtttttggggtcctcctcttcttgtttttctcacagtagggagacttagctgactgggtccctggttgtgtcaggtatgacacagtgtacgagcagctactgtggcactgggttccaggtacaggtgctcgcggtggctgtggggctggggtcccaggctcagggttttgtgaacttactgtggcacctggatcttgggatgtattgagtgcctggctttgttctctatggcagagttggatgtcagttgcccataaagccaggatctgtgactctgaggcaccccagtagctttggcccaggggcctaggttgaggttatgattctttccttagggggcagggcacagcattggcgtgattgggaagaaggggtgctctggaggtttgggcccagggagcagggtgtatgtagctacaatttgggaacctgagccaatagggctcagtggcaagttggagcctagaggatgaggcaccatgcagtaatgactctaggcccccggatggtggagcttggcagtatcctaggctctgtgaagccaggtgcaacagcagcacatatcccagaatggcagagcacagctgttgtgtgggccctggggaggggagggaacagcacagcgattactctactctgcaaggagaggagtgtctcagcagttcagactctagagaatccagctttagggaaacagaatactagagttgtttggcctgtacggcgaatgtctctgctcagccactgttctgtttcccttggatgcagggtactatgtcggctcagccctgggatgctcagctggtttagggcaccagttccccaggggcaatgtgctgcttcagcgcaggcctgaggggcatgacttttctggacagtccaggcactgattccttgggatgcagggcaccacttctgctaaagcacttggatgcgtgactgctctgggtgccatttccttggattcagggcaccgcttcaagttgggcactagtgtggggtgactcctctaagcagcgaaggtactgttttccctggaaggggagtgatattgtttggatttgtgtccccccccaaatctcgtgtctaattgtagtccccagtgttggaggaggggcatggtaggaggtgattggattggcggggggcgggggggtgagtggggggatttcccccttgctgttcttgggagtgagttctcacagatctggttgtttaaaatctccccctttgctctcttcctcctgctctcgccatgtaagatatgattcctttctctttgctctgtgccatgattgtaagattcctgaaccacccaccccccgccctgccccccaccgccagccatgcttcctgtacagcctgcagaaccatgagccaattaaacctgtaaaggtagtcctttatagcagtgcaagtatgggctaatacagggagagaagaggggtagatggagtggcttcctctctccttggccccatgagtaagggtataacagttgcttgcagcttggggatgtctggccaattggttgtgatagtttggtggtgacttagccttggggatgaagggaagctgtggccgctcacactaggagcaagacacactccagccatggttccatttccaagatggtatagcacagtagttgcatgggctgtagagggcaggtcacagtctcgtccccttcttggagggagcacagcaatgtggattctaggcaggtccctcagctgggcctagtgcctatgagaactgcagggacagtggtgaggtctgtatgtgtccaaggtgttgatgggggttgctgaaatcctcttgcttacctcctcgaagtagggaggtttgtcctggttcccgggtgatcctggttggggtatagggtggtggaggcctggtgtttccttctgttttccatgtggccagcctgagatttgtcaccagggtttctgtaactcctctgatgcgctttggcactctatctcaattatttttattaaaatgtagttgtttagtcgttgttttgggtgttgttttgaggggggtgaatgctaggagctgctagttggccatctgatgtcactgttttaaaccctttgtaaacataaactcatttaatcttcacaaaataatgtgaggtagatactataactggtcgcatattaattgtaatagaggttacgtaatcttgcaaggtcactcatctaacaaatggtggagccaggatttgaacctaggttgtttggcaccagaggacagagatactgtgttttaattgttcctataatcactgctgtctagaatattgcctggacatagtggtgttcaataaatatttgtttaacaactgagtgactgaaccactttgctgtactggaattggattctaagtgtgacgccaatcagttactttctaattaagtgtggctggaatattatttgctgactagaagtgttgaatctccattagctgcatgttgttctttgactgtaagtgtaaaattgatggcagaagtaaggatgggttggcatcaaccttagatcctgtgagaaggaccacttctgcctcatattgtcgactctggcttcccaacatgctagtgatgtaataatgctttgatgcttacattccctccatctgtgtgcagagagcttattgaggtatttgatgataatgtaatgcttcttatttattacctagtctatgaattcttgccttttgtgattatttttttctgaaaacttggacactgaatagtaatgttactgtcggtgttttatttgtaaatactttggactggttggattgtttgaccatggaccctttttttaagtgtagccatttgtatccaagagaaatctatggctataattttatattgttaagagagaaatgagaggaaacttccacttgaattttcagctcttggttagaggcagtgttatagattgcttagaagttagtttctattttttggtcagtccatgggatatcattcagattacattgaaagcagttctttgttcctgagtctgcttgaaccatcactgggttggtgaagttggggattatgaaagctaaagtagaccaagagactctagttttgtaaataatctattatgttgcttaataggtcactttcctcagtaatctggattacttattggcattatatatcttgaaaagagtacttttaatcattattcttattacagtaaatagtgctgtactgtgatagtgtccgttttctttatgtaacaaaatctaatttctttgtgctaaggcaagagcagttctaaagagagaaaaaagaacactttagcagtcaggacaaatgatggtatttcgttattattttcatcatagattaaaatatatccctcatactttgtaaataggagtctatcagagatacactgtgataagggcaagacaattagaaaatggcacacagaacatatgcaccagctgtttaagcataatggttaaccctagctccttgtcataactcgagtcttgaaatgatcaccaattctctaaatccacaggatcttgtttctgaatatttagcctaatgtagtctttggaaaagtagaagttggtaataccataccaggcagtggcttaggaaagtcatgtgttgaatagtaattatggcacctgctaacttgagatgaccgtaagtgtctttggtaactaacctttataagaagctatgctgatctaggtcatagatacttaggaggaatgccaaagctgattgcaaagcatttttataaaacggtagacaatttaagtacttaaaggcaaatgccttcccggaaaacttttagagcccctcagattgtggtgaaggcaagacatttagaaaatgccacacaaaacatgtgcaccagctgtttaagtgtaatgtttagtcatagccccttgttgcttgagtctttaaatgataactgattctttaaatctacagggtcctgtttttgaatatttagcctaatgtactgtgttacagggcatttggagtgctgtgagctattacttgcaaatttagattccaaatgagaaaagaattctaggaggaaaagtaagctgtcatgttatacaaggtttgaataaagatgcaaacctaaatatatactgagatgaagtttcagaaaaaggaagccagtttggtgtctctaatgcctaattaggaactcatctagaaagatgaaccactaaatagctaagtcagatggctaattgagtaattgactttgtcctttctaacttggtcaattttctgttactgtttacacatgtaatactcaaaatgtttaaatttatactctaggatttagttaatgacattaacattgacattttaacatgtaaaataagagttgggctaccatttggtgattatttagagttatcacctgtattcttcttctgtggtggtgatccatttttactaaagcctttttttcccttctgagtattgtgagtgaaagagggataccagaaatacccgcttcccattcccatcttgtgtatttttggcatcacttatttgtcgcttagcatatctactcagcctaccaagtagatgccatcattagtggaaatgatgccaaggacctcaaatccttcttactgtggattataattatggggtagaagaaatgaaaaaaagtagtttaagaccgtatctatacagagtcttataatcatagattggggctatgaagcacatacgcctcaactttatggcttactgacctgcgaactgtttaatgtactgtgtaagaaaagtgtggttctgtgtcctaaagtggtttttggggtggggagcgggagaggaggagatacgtgcttgtcagaacagccttgtgatatcctcacctatttatgtagttcatacatacctgtggcatcctgtcccaaatttcacaaaactcttacaataaaattatgtaacttggctgggcgcggtggctcacgcctgtaatcccagcactttgggaggccgaggcgggcggatcacgaggtcaggagatcgaggccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaattatgtaacttgataaaaaataatactcataataagtcttactctgtttgactgtatctcttcatgatctttctatcgttggttggtataggtacatatatctatatagagttgtaatcaagatgctaggcagtttgttttgtcttttatttaatgccttatttagtgctgtgctaagtactttacatacattatccgatttaatcctcaaaacaatgataagaaaggtactgttactgctcttctttgacagaaggggaaccttagccctgagggtttaaaataaggtcataaaatagccaggagaaagtagaagtgggtgtggggtggattcagatctaggtctgtgtgattccaaagctcagaatcttacctaccaaaccatactgccttctttgtgattgactctcaactagattgttaatgaaaataatgtgtctaattaatagaaattctaacttttcagcatttaccagcaaatttttatatgagtaaagcccatataaagagtgctccaatttcttgttttatttactcttgtaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacgtaagttatgcttgggtggaaatttccagctcttgaccatcccccaaaagataacagatttctggggaaaagtgatcaaggcttctgatgatagctcaatttccacttagatctttaatctaagtcaaaagaaattatgaatcatcagtctacttgattttaacttggcctaaaacatttatttttatttttgtttttagtttgaattaaacttctggattcttttatgtagcttgtgtttcctatgaggtcattctttactgaggatatgggtttggttcatttcaaccaagattttgaccttctggcagatgtgaagctatggtagatacagaaactaagtacacgtagggtcagccccctagaggctcgtggtctattgggagatagagaaacatcataagtgactgcagcaaaagtaccatcattctaatctttcttgtctgcctagatatacttcttttcagtgactaaattggaataatgaacagaaatttaatcaagtggaagcaaatttgggattaaaatactttcttagcataatgccataattacttttcataaatgatgcgctaggtctgtcctgtgtacacaactcttaaggttaactttttggtgggttatgtgttcttaattcctacccacagtgcctcttggcttccagtagatggcagcagtataagttttttttttttttttagggctttaaaagtaactgttggggctaattaaaaaaaaaaaaaacaaaccaaaaaacagaaattgtgttccaggtgaccagcatcctttcataaagtagggatgctatgaaatatagaataaaaaaaaattacaatggagtgcattttgtttttaagtttttccttgcctttaccttttctttcttttgccactttactttcgcttaggtagctgatccttgttgatatgcatggccgatttaagactttttcataaagcaagaaggcagtgttaagtctaaagaccatggtgttagaactcagtttttaccatggagctttaaacattaaattattttataacaaactcttatggtgcatgttaaaatttactagcaatgttgtttttccccccttcaaaatttggcagtattaggtatctttcagggtagtagcacattttgccctaagttgagtaatatctaccagaagctacttaacttctcagggacacaggtatttgtaaaatgagggtttgtgctaaatgatctcaggctcattgaggctctgttactctattaaaattctatgaccattcatttctcatttttgttggccagaaagcattttgtattcagttttgaccagagaaatcctgtaataacctaaccttacaaaaaatgatcagctaaaatgtgtaggttaataatgaactgaaggtattgcatgttcagtttgaaaactgagggttctttggaagggaaggaagaaatgtatacttattggaaaagggcaaggttttggtagaaaaaatttggcatttaagttgaaatcaataaggacatagtctctgtaaagaaaaattaaagccataatatttgcacagacatttatcagggtgaggataaattatatcaagtggaggaattggagggaggccagtagctgctgtcttgaggatgccgatgtttcaccttgtacctatagcttacttgtgaccagacctcactaaatgctagaaaagctggatgtaagtggagtcaggagggaaggggagacagaaaaaggatttattcttattggagcagttcttcctcacagcttaggtttttgggaggattgctatcatctcttacagaatactagaggtctttgaggaaaggaagtctctaatttagacataacaggataaatttgagactgaattatttagaaaacttgattagatgtgtaagatgaggcaaatagatggaaattcattgtaaatgcatttctttctgaaactttaaggttagagatcagtttgtatgtgtgcgcacacgtgtatatattttaagagacaaagtcttgctctgttacccaggctggagtgcagtggcacaatcatagctcactgcagccttgaacttctgggttcaagtgatcctcccgagtagctgggactataggcgtgtgccaccatgcccaacttattttatttttttgtagagacagggtcttgcctcgttgcctaggctggtgttcaactggcctcaaacaatcctccttcaatctctcaaagtgttgagattacaggcataagccaccacacctggcttgtttggcttttattttttaatttttttgtggtgcaacagttctaaatatcacatggcagttttatattctgcaagtaagaggtaacttttattttccttgtaattctcatctgatgatttgaattgctagtcttatacgggtttacctttagatgttcagaataagttgtgtgagcatgatatgtttgtatttgtggtatcataccttatcatgccttgtttggctacatagcattacttccactgctttctttgaggagtgatcaacagtaggccatcttctgtgggacagccccttacctgctaagaagtataactttctttcagatgttggaatttttgtgttaaatcttgatattactaataacacttttctcaccttgaataaagaagggaacagagatgagtactaacattcggtaatactttctctgcagaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgtgagtttgacagcttttctttgaagtaagatatttatggatgaggagttttctataacatgttggatctgagatgttttcactataaataccaaatatgtccttgactccttgatttttgggagtaggtcagatttttaaagaaatggataaatggctaagtggctctttcctctctccagcttattgagaaattttcaacttataaaaatcatacagtgaatacctaggaaatttatctgtattcatcaattaacatgtagatacatgtgtaggtgtgtgtatatataaatgtatatgtatgtatggtatatacacaaacatccttttttcccccgaagcctttggaagaaagttgtagacattgtgatgcttcacctctaatattttagcatgcctctccaaagaataatgaccttctataccactaaagtttcattatcccaagtaggtggctaattttgggcaaaagggaatgttgaaaacctgcctcctcaatatttatagttgtgaaagttttttcgtgaaccatattgaatgtcacaagagtagataattgccaagtagagttacataaagcaaactctggatagtgtttttgaattttgaaggtttgtgcataaaaacccaggctatgaaatttgatacccactttttttttaaaaggccatagaaaattctatatttgttgatttttctctgttgccatatgtctttctttttttccttcgcttatacttcttctattctggttatttaatgctagcttagggttcctgtcatttagaccttggacccaatattttactgtagctaattagcaataaattaagtaaaaattatatgaaatcattttaaggggaagaaggacaacaacacaaattagttgtcatcactagcgttttttacctgtttaacacctaaaaaaaagatcttggttctttctcatttgttcgtttgccatacatcttgtctgttcacttacaggcctgtaaaagttaatgggtgatggtaaatcatggtggaattcctagggtgaagatgaatgccttcctctgtttatcttgtctctaccatactgtgaaattagtgatgcatattgaatttttttaaagccattgccccctgggcatgatggttcaagcctgtagtcccagcgttttgggaggctgaggtgggtggattgcgtgagcccaagagtttgagaccatcttgggcaacatggtgaaatcccatctctacaaaaaatacaaaagttaactgggcatggtggcgcacgcctggtctcagctactcgggaggctgaggcggaagaatcgcttaagcctgggaggttgtggctacagtgaaccatggtcgcgccactgtgctccagcctgggcgacagagcgagagtgtctcaaaaaaaaaagccatgttttgattataggcagtctacttaagaaaaatgagattagaggttttgttaaatcaaatggaaaaagtggtttttaagtcacagtgaaaatgtgggacacatttaaaaatccatagctaagattgaacattagaaaatattttaaaagatggatatgttgcagaatggctcacaatgttgcagtcttaaacaggggaacaaaaactcatggtaagtggatcagtcatctgctatcatgggtagtgctggaaatggtgtaaaagtgtcttatgtagttatgatgaggaaatcacttcaaaaacagactttggtgggaaggaggatgtgataaatctgttccgattgctccgttttagagcctcctaatcagtctataagatatcccttgagtcttgaggttggtcacattcttgggccaatcacccctggtcatgagtaaccttgaggtttcgaaacctagagtgccatacaaacagtactgtctattcatgccatcagtgtaagaaaaggtgggaagcactcatttatactgaagacatggagactgcagtagcattcttaaatgaaaactggaacaatgtgtgatgtgaggctgaaatttgagtattatggtagggatcttgaaagaaatcttggccgggcacggtggctcacgcctgtaatcccagcactttgggaggccaaggcagacggatcacaaggtcaggagattgagaccatcctggctaacatggtgaaacccagtctctactaaaaatacagaaaaattacctgtaatcccagcactttgggaggctgaggcgggcagatcacaaggtcaggagatagagaccatcctggctaacgtggcgaaaccctgtctctactaaaaatacaaaaaaattagccggacatggaggcgggcgcctgtagtcccagctgctctggaggctgatgcaggagaatggtgtgaacccaggaggcggagctttcagtgagccaagatcacgccactgcactccagcctggggaacagagggagactccatctcaaaaaaaaaaaaacccaaaaaataaacaaacaaaaaacagaaaaattagccaggcgtggtgtgggggcccctgtagtcccagctactcgggaggctgaggcaggagaatggtgtgaatccagcaggcggagcttgcagtgagccaagatcgcaccactgcactccagcctgggcgacagagcgagattctgtctcaaaaacaaaaaagcacaaaagaaagaaatcttcttgagatttagaaatgtattttaggagatggtctctgggtatgtttctcctaaaggtaaaaatctttagtttccttttattgattcacgtaacagtgaacaggcttggtcctgtcaaaaagcactggagtgaggataaacggtgagggcagtggagcacacttgaagaaagcttagaatgataaaagggtctggaagaagcagaagcaactggggatagatttttgcttatttatgaagcattcaaaaacatttagaacctctagtgagtgtcagaatataaccagcaatgtctgcctgtcagtcagttcattctgagtatgtgacacatgcaaagcagtgtgttgggcacaatgtaagaggaggaatgaggctctgatccctcccttctggaacagacaaagtttctatagggggtttaatgggagtgtcatcataggtacagccaaaatgctgtggaaattgcaaggaggttgaggttatttctatctgggaaatccaggaggctttctcttctagaagatttattttgtaatcttttggttaacttctatcttgattttaaaaaaatggttcattttatttctgttgaaaaatattagacaaattatgttatgtggagaattgaaatcacctacattaattaatacttgtttactacgtggaactttgtataaacattgttgtaaagtccagaaaggctcacataatattcactttttctgtttcttggattctctcatgttgttattaatatttttatggacacacattcgtaaagtgtcttctttcttcgttttgtgttgcttattaccaggttccactggctttttctctgaggcagtgattcttaactttggatgcacattacagtccttgggcaactttgatgtttcaggtgtaccccagaccaattaagtcagaatctctgcgtcaagatccaagcgtcagttattttaaaacacttcccagttgattccagtgtgcaactaaggtggaaaaactgctctggtagtttattctgtttgtccctttctgtccccactgccattaccttacttcagtgtctcctcactttctccattttccactttgttctgcctgcccaggccaggctgagctcctgtctttagtactagggcattgttcattatgttctggaaattcccttcctacctatgtaaacctaatctactctttcttcaggccccacatttgtttttcatctctttgctgaaggccatttcaaactacatcatcttacattatttctttggtgcttgaagttttgtgccttattgtatactcccttgaattgttgtttaattgcatttcttttatccattttattctgcaactaggtttttaagcctttggaacatgacaactccttaaaaatattcattcatggtctagtataatgctgcaagaggtgctcagtaaatgcttgcttaatgaactcatgctggtttgtaggaatgaataaaatgaataattttggattttcatggtgctaaggaggtaatagtgtggtggaaaaaaccaaagacctttacccttatgggccttacattctacagtggatgaaggaggaggctgtgtggtttatttctacttcctattagatctttcactatacagatgacatttgttgaaaaaattaaaccaaatactctggaataagcaattaagtgaaagtgatatcttagagcagagttaaatttaattcatcagctgagggccaaatccccttttaaagtttccaagggtcaggaggctagcagccttaatgttattgcttgcatagtggtttgatgaagagttggtaggtagtcttggctctacaactaacttactatacggactctaaggaaatattgacataaaagtaatgcatttgacctctacttacttaacattagggaaatatcacagacccatgacagtggaggttttgcgacccttcagtgtatccttgtagtttcagagatgacttccaggtttccttgaaatgaaatgtggttattgtggttaagtttaatttgttttggctctgtcagcctaaagttgctttgcctgtgagagagaaaaacagctttggatggatgttataatcttaaaaggtttaaaagtgaatggattgaaattaaaatgaaatgtaattaaatttgaaaaagttattaccattttttttcatgattgaaattcagacatgtgcattaaattactaaaataccactactattagcatttagggatatatattttcaggtttttttcttttcttcttctatgcagagcataaaataacagttttaattctctcagtgttttctgcctataaacatgaaatatccgtagaactaggtttcagactattaagttaatgggttaaaacagtctgctgtctggttaatgggttaaaatttctgtttttcaaatacatagctgacttggttgcccagttgtgtgttttaatgttctctgagttatttcagtgctactgagaaagacttctgaagggctctatgctttatacagctgacttctttatttcatgcctttcattctgctgagggatatgctgactgttaatatgttcctttctccgttttttaaggcatgtgtttttccaatagtagaatttattggaactaaacttgtctctgttaccataccccccttcaaccctgactcctcaatgaacaaataagcaaaacctaccctttccccaaaacctccaaatctgaatatacttaatacaatgtctgaaacataaaggaccctcagtctttgaaatgaactccatttggttttgaccagagcagtcttgcccagcaggtcatggtcgtgtttgactgactggcgttagggcttataattggtaagaacaaacacatgccatgggcttaagtagttctagctctctgctattcagtgtggtagccactcaccatatgtggctattgagcacttgaaatgtgacaagtctaaattgaagtttgctgtaagtacatcagatttcagagttagtatagaaaaaagaatgtgaattatctcactgatattattttagatatattgggttaaataaaatctattaaactttatttttacctgtttcttttcacttatggctacgagaaaaatcatatttacattggttatatatgtatctataacttgtatatatgttataaaaattatatgggtggtttatttctggcttgcattgtatctctgttggatagttctaaccaataagtaaccaaccagctaaggtgagtagatgagaggttaggatcaactttgttcaatgtccagaatggcatggtagtccatgcatagtagctattataacttgtattcttttaatacttaaaactgtagttttagatagaagaaaattggttcaatttaggaccttgtaaggataatgtttcttaaggatacattttatctttgttcttgcctgaaaacgttggacatagtagttgtaggatcccaaaagaagaatgcagtaactggacatactttggttggactggatgtatatttgaggaatatgactatgttaatacatcaagtataaaattttaattcgatttgggtaaatttgatgtggattgtatgaatggtatgcagctaatgttcattttcaaagatcttttgaaaagatatattgttattatagtgaagtgaagcactcaatttagatgttaatcctttctcagttttgcaaatgccttcctggaatctctttagcatagccagagcttttgaaggactctgaagagcttgttactgcattatgttgtggctacacttttcttttcttcagaattagagtagcttaattttttcctgattataaaagttctgtgttcattatatattgtccataatcccaccactcatttttgtgtataacattccagacttaattcggatctgtgtatatgtacacttatatctgttcttttcttaccttttctttttaaaaatgttgttagtaatgattgtccatacttttacactgcttaccatatgccagccattgtgctgagagacattttatccccataataaccctattgagttgataattgctcaaaaatacatatacacacaggtgcagtttgagctcagatctgtctgacctgaaagtctgaactcttaatacttttaccattgtacatcgtcccaagttaacaaatatgattttataacatcttaatggtggcagagttttccattaaaattaaatacccccagaactaaaataaatactggaatctaaatttcagtattaaatttctaaaattggatatcctagactaagtaaaatagatccaggtctgggatagctgcttgaagtgagtggaatgtcacttgcctctgtgtgaagagactgccaaacaggctttttgagagcagtaaagctttttaatcacctgggtgcgggcgggctgagtccaaaaagagagtcagcgaagggtggcgggattatcattagttcttataggtttgggataggcagtggagttaggagcaattttttgtgggcagggggtggatcttatgaagtacattgtcaagggtggggagaatattgcagagtaccttcttaagggcaggggaggatattacaaagtactttctcaagggtggggagggtgtattgtcacaaagtcaatttatcagttagggtggggcaggaacaaatcgcagtggtggaatgtcatcagttaaggcaggaactggctattttcgcttcttttgtggatcttcagttgcttcaggccatctggatgtatacatgcaggtgacaggggatatgatggcttagcttgggctcagaggcctgacatggagcaaaagagcttttagagtattttccatgctagactggtggtacttgagtgctgtagctgtttaaatgggctctgtggtttgcaggtacagaggctgagttttgttatacagttatggtatgatttccatctttctttgaactcttgagttttctgcaagagatgcttacctaaattagtagtccatagttctgtagaggcatttgaagattattttattgaattgttagtgtaagcttttctgtgagctgcctaataaacaggatttgggagagtttatataagtagatgatgcattgaatgcaaaatttgagcctgtgtaggacttgcttttttgacagcggcatttatttttattttttatttaataaattttatttttactgtatatgtttaaggtatacaaggtgatatttagatatacatagttaaatgattactacagtgaagccatttaacatatctgttatcttagagttaccttgtgtgggtggtaagagggcctaaaatctactctcttagcaagttttccaaatacaatacagtgctattgactataggcttcatgctgtagattagagctctagattttttatttacttattttttgctctgtcacccaggctggagtgcactggtacgatcacagctcactgcaacctctgcgtccctgattcaagtgattttcatgctccagcctcccaaacataatagctgggtttagaggcttgtgttactaagcctagctaatttttgtatttttagtagagatggggttccgtgctattggccaggctggtctcgaacacctggcctcaagtgatccacctgccttggcttcccaaagtgttgggattacaggtgtgagccaccatggctggccaagagttctagatttattcatcctgcataactgcaactttgtattccttgacataagtgtcccctactcccaccatatggtaacccacctttctactctcttgtttttatttattagagaacatgtaaaaatcatgcaatagttttctctgtgtctatttcacttagtataatgccctccaagttcatccatgttgtagagcagcatttatttaatttgaaaacactttgtcaaaaattaatttgtgattttcttacggttcaagataaggagtttaaaagatcttcataactctgagaaagacatcttaccccagttatatttgtgttgctttcaaagaggtttgaagtacttcccatttatgagctatcctggcattgcgcattgcagtatttagcaggcaagttcttaatctctaataccagaaagatgcatgtttatgtatttgttgaagtgatgctggcctgatggagcagtagtggttttgaaatcagaatgatggagcaggcatgtaagcctgcccagtgttaggcagcaggtggataggagtttagcctcctcaggattgctgttagactgtcctttatatcactttgtgctgtttagccatcaagcagggttgaaaagacttcatatctaaagtagtatttctgaattaacaggtaataacctctaaatatatcagattattagtaattatctctagctggtggggcgatgggcactataaattttctttgatattttttcccacatttaaaaaaagttttttatgttgttaatgtcacaaagtttaaaaaacttagaccgttagatttgcgtgtcttagatttttaggttttgtttataatcatacaccgtgttcatttccaaagcactattaatatggaaatttgatggtttttcacacattaatatgttgattcgtcctttcgaggtaatgattcattcaggactagtttggctaaagtggttagtttggttttataaaaaattatagtatacatttctatcaagtcttgaagtgagactcaattatctctctgtgatagcatttgcttcattcttttcttgcagtgtatatcaaagcgatttttgaccttggaagtataaaattgtgaaggtagaatttggaagtgacgttcgttatcatgtggtctaggggttgacaaattatagttctcaggtcaagtctagcctgccacttatttttataaataaagttttattggaacacagccatactcatttagttgtttcttccttctcctcctcctccttcttttcttcttctttcctcctgttcctcctcctccccctcctcttgatcctccccctcctgctccttccccctccccctcctccctcccctccctctcctcccccccctttccccactcctccgtcttctcttctcttctcctctctcctctctcttctctctctcctctctcctctctcctctttttggttttgtttgtttgttttgagacagggtcttattctgccacccaggctgggactgcagtggtgcaatcacagctcactgcagccttgacttcccaggctcaggtgattctgccatctcagcttccccagtagctgggactagaggtgtgcaccagcatgcctgactaattttttgtattttttgtagatatggggtcttgccattttgccaagggtggtctcaaactcctggactgaaagcagtctgcctgccccagcctcccaaagtgctgggattacaggtgtgagccaccatgcctggccaagtagtttctaaagagaccgcatggccccagagcctaaagtatttgctatttggtcctttatagaaacttgccaatttttaatctgtttcaatcagctccccagtagctgggactgcaggtgtgcactgccatgtctggctaagttttgtatttttagtagagatagggtttcaccatgttggccaggctggtctcaaagtcctgatgtcaaatgctatacccacctcagcctcccaaagttctgggattacaggcgtgagccatggcacccagcccaaccaattaatttttctgaaggttttaaattataaattcagtttcttcagtagatataaaactaagttatgtattgtttcttgggtaaattttggaagattgtggctttcaatgaattagttcattttatccacttagttgattttgtacgcatggagatgtttgttgtaatctcttactatccttctactgtttagcatctgtagcagtattctctgtttcataactattcttgataatttgttttattttttctttctttgtcaatctggccagaagtttatcaattctagtgatcttttgaaaaatccagctttgggtttcattaatttttttttcctctaatacttccaatttcatctgtttctgctttttatttatttatttttctgtctgcttattttgggtttattttattctatctttactagtttcctgaggtgagaacttaggttattgacttgagacctttcttctttgtgtaaagatatagtggtatagatttccctaatctaagccctgctttgtctgcatccgataaattctgatacgttgtattttcattttaaaattatttttatttttttgttgttgtttgtttgtttgtttttaagagatcgggtctcatcgtgttacccaggctggtcttgaactcttgagttcaaatgatcctcccacctcggcctcccaaagtgctgggattacaggcgtgagctaccgtgcccggcctatattttcatttttgttcagttcaagatattttaaaattttcctcgagtcttcttctttgatcactggcttatttagaagtatgttgtgtaatttccaagtatttggagattttcttgctatgtttctgttactgatttctagtttaattctaattccatatggtcagagaacataaactttgcatgatttcaattttttttaaatttgttaattgagccttgttttatgacccagtgctacctttgtaatgttctgtttgcacttgacaaataatatgtattctgctttttattttttttttcttttttgagacgaagtcttgctctgttgctcaggctggaagtatagaggcatgatctcggctcaagtgatttctcctgcctcagcctcccgagtagctgggattacaggcacccgccatcacgcctggctaatttctgtatttttagtagaggtggggttttcccatgttggccaggctggtctctaactcctgacctcaggtgatccacccgccttggcctcccaaagtgctgggattacaggcatgagccaccgtgcctggcctgtattctgttattgttgggtggagtgaaagtgtcacttagatctagttggttgatggcattgttctatagcttgctgtttttttagttgggggaaagatctaattattctaagaattactgagataagagtgttgcagtctccaactttaattgtagattcgaccattctttatttcaattcttggattgccactccatgtgttctgctcaggatctttagttacattcagtgggacagacagggtggagtatatttattacatttagccagaaccaaaactcaaccagtgttttcaaaactgagtctgaaactagtgaagtgttaggccatggttacacccatgtttgaacagttaggactagaactaaggcttctgattttttagtccagagatactcctggtggtgctcttcacatgtgatgccatggatgatgagcagtaagctgatacttccatagaatagaacttgttaaagcttgatcaagtaatgtaatctccccagggcagctttcttggctggaattggggtcattaatagctgcccctctaactgaccttgttaaaatgcacagagaatctctcaagtaagaccaagtaaaaccgtgaagatggggatataatgggtggtgttattaaaaaatatcaagatgccttggaacaaaagaacagaaaataaagtgtagcaaagaatagggtgaacagggatctggataggtggggaccaagggacatgccttctgtgacaggtgctttatagctttctgtgtctgctccattgcttgctctctgcctctagcaaagagccaaagtggcagtctccatttccagtctgcatgattttgtagttcaggcatctaatcatagctgacaggtctctccctctcctctcgtgtgtttgtgtgtgcaatgccatgtttggtgtgaacgtaaaactataaaatgtatgtgcaaatgtgcaaattggtgtttttagggaaaaatataatatagtttctccttcagttattctttttggcccaaggagtaggctttactttttggcaaagttgtcatgtgttgataataaaaaatcgatttattaaaaatattgtgattgtttaaatgtagccaattaatagttgtgggaggccacctatttagtttagaatgcccatatgtgacaaacatgtaaaactaaaagcttatcaatcataactttctaccctaatagtttttatccattcattttacatttttttaaaattaggtgtcttagaggatttaaggtagtaaataaaaactcattgtgactagggcagttaaggattaaacaaattgggtttgtgtgttcggtttgtctgccctcaaactagccataatgtttatttatttattttttgtctttaaccctctcctcccctcattaaatatagttacataaaaggatgccattctgcttttcatgatgggtagttcaggttctgtcatgagcattgagtttccaaactgtccttgtcggagacaggagatttcctcctttctgacttcagacctgctgtgttgaaagttgcctctttggttgatatatttctcagtcataatgccaacttagaagggcacaagtctgtggaatatgtttttattcttagatgggattattttattcattttcagttgaatctttgttcatatctgatgactgctaatgaagtccttgccagcaactcaatggcttgcttattttattttattatgttgtatgtatatatgtatgtatgtatttatttattttttgagatggagtttccctctgtcacctgggctggagtgcaatggtgtgatctcggctgactgcaacttctgcctcctggattcaagtgattctcctgcctcagcctcctgagtagctgggattacaggcgcccgctaccacgcccggctaatttttgtatttttagtagagatggggtttcaccatgttgaccaggctggtcttgaactcctgacctcaggtgatcaacctgccttggcctcccaaaatgctggtattacagacatgagccactgcaccaggcctgttttgaagaggaatattggatatatagaaccaaagactgttgggcaccaattccatttggtcattctctcaaaactgccattagggctttttgtaatgtcataatttggaaacataaggaagatatttcctttgagttactttatgctgaaataacatctggtcagtaaatatcctacaagtattactttcagatgttttgaaatgattggcctcctgctctggttttaaccccagttgaagacactttaatgtttgcagtttataataatctaccaagttgaatacagtgtgacatcgtatttcaaggcttccttaagggctaaccgtcctttaaatttaacactggaacatattagcctgaattacttctccttgctttgagagagaattactggttttatagattcaaacatgaaagtcatcttctaggagtgaaaagattaatgttttggcttgcccttgctcttgtgtctgtaagaatattgcttactatttcctggtataaaatgacctgagatattttattagaaaaattataccggccggggcaacatggcaaaactctatctctataaaaatattaagaattagccgagcatggtggcacacacctgtagttccagctactcgggaggctgaggtaagaggagagcctgagcccgggaagttgaggctgcagtgagccatgatggcaccactgcactccagcctgggaaacagaatgagacttcatttttcacacaaagaccagtaatactgaactgtaatcttttaagctcatactaataaacacacttgttgccaggagcagagcatattgtttatgttactttgaagattctgtatttttgctgaaaaatagccgaagccactgtatataggaaaattgtttgttttctaaaattggccattaatatatactatttagtgatttctgttgtgataaaggatcctctcacctccctcaccttttcaaaactggtttttcttatgccgttaaagtttttcagttaaggaaacagactcaaggctctaacccatttatgccagaggttgcaaattttttgttgtggaaaatcagaccttgatgatgaccttgagcagtaggatataaatagctcccagaagcttagcgttgcagtaatggaacaccaggcctaaatgggttaagaaatttgtttgagttttctttttcaaagcaatattaaatgttgtagcgttcagataaaaatccaattttaaaattaaaatttctaatcatggcagttaaaaaacacctgacaccattggccacctcttacttgctttctacagggctttcatattggccaactgtagaggttaaaaatcaaactactcttttcaactaggtttttctatccaatgctccattaaccattttcttaaaaccactctgaacctggaattacactaatttgggggttatgttaataaacagcaataattgtatattttggatttaaggtattgatcaagtgtgaattatccttaaccctcaagatttgaacagatatgaaagttggtttaggaggaatggttacatacaagataattccttacagagtgagatgtatgatttgtttaaaaacattccagcagaaaaaccaatggaaaggtgataaatgaaacaagaaagcagaaagttgatgatttttaaagtttggtaatggttaagtgagggagttcatttagtattctcaatccttttggtggttatgttagaaaaaactcataataatttttttttttaaaggacatgtcatcaccatgatggttagttgagtaggtgttagcatgttagatgtctgagagcacagtccttgccatatgtacacccttcggagggcatttgcatgctttgcaacccctggaaggccttgttttatcccactcagtcctcttctcactctccattttataggctggctggtgcctatgctgattcttaagccaattagattctcttggggatttgtatgggtaaataatgggaaaatgatgcaattagtaatggaaactgaaaaaggaaatgatgccattatgtagagccagggtcataggggtcttgacaaagtgaacttatggctgagtagcagctatgaattagataggcagcaaagagggtgagaatgggtcaggcatttgagattggagaatgggatagccagctaagaggagtgtcctgggcttcctgtatggccgcttctaggggcagtggcccagctgtacttgggttcttctgtatatgtgtccttgaagtaaaaccctttgtcactgtattcaatttgggtttctggattcccccaaaaggagtctactgtagttactgaacagtgcagaattttcttggctaaattaaaagtaagcactttttttagaaggtcaaaagtgatcattgcctattcatctaggcattccattgtgcaattcttaaggctttttttggagacttggcccttccccaagtaatttaatttttctttttaaaccaaagtggaagcaagtttgtggaaagcaaaggaataaagaatggccactccataggcagagcattttaaaaatttaaaaatttttaaaattttaaaaataaaagtagagatggggttttgctgtgttgctcaggctggtctcacattcctggactcaagcgatccacctgcctcggcatgcccaagtgctgggattatagacacaagccaccgcacctggccccagagtcatatttttaaagttctgtcttgtatagtacgaaaccttttgtctcttagctgcttgacttttatataatttagtagtgatgtttacattgttcactagactttgattgaattgaatttaataaatggcagtaatcaggtgttttttggtggaggggttagcttgctgtcttcaggtttcctatgcttgagaatttgcctcaacacaattttaggtggctgtaacactattttgttggccagtataattttagattcctcactttggttgttggttgttaaaagacatagggagctttgtttgactctaaatctaccattgtctgtctctttccttttctttggtgttcttttttaggggacgaaagtaagaattgagaagatctggcttagataatgctagtaatggagattttaaaaaattacctattattttattattataaagcactagagcaagtatagaattatgtatagtaagtaggatatacaaagaaagaaaagattggcattcattggctctggggagtgggctaaggttaaaacaaagatttagagtcaaaaattaattagtgtgcaggagacagcaaacctcttggcttggtgggaatgaaaaactatttaataagcataactggctagaagcagtcttctttccccattagtaggtggctcactgacattgtcctaggtgtttgaaatgtttgtttttctccctttaatttgctcctgtgtataaagttactgccgaaggagccaggactgaatcagacttgagcaatacggggcttgtggaaagagatgttttgatcatattgttatttttgtgtcataaaatcttagattggcaactttcttctagggtggatttagcctttgatacattttcttaggcccacgaaaatgagctgctaaagtagaaatgaataaaactattcggtttagcctctagacagtgacacattaaggactaatgactgccaaaaggaaatgtcaaacactaagctagtctactttctttggcagctgagaatccggtgaatcaacagttttagggggtgtatatttaatgtgggtggaggaagaaagtgtctaacattctttaaggccctgttcagcaaagttggaattggagcctgattctacctttctaaacacaagaaagtcacatgctatagaatgagggtggttactgtttgtcacgtagatagtatcgactaagacattttaaaatgtgtttacaggctttgtctttattttcatttaattgttggtaggtgcgaagcagcatgcatttgtgtgtgagagggacatacttcagagttttgattgccttggtcccccttttcataaacaggaattatctgaagagtcttgtggaagagaatggataaaactgtgatccttgaggcataaggagcaaatttagactgaatttctactaaattactgttaagaaaaggacaacaaatttagagcttttaagcttataaccgagtatgattgccatgtcctgggtacttgattgccatgtcctgggtacttaacagtttagcacttaaatattcacatatagatatagggtcagggaatgatagctaaagggtacaggttttttttgtttttttgttttttgtttttttgagacagattctcgctgtctggcccaggctggagtgaagtggcgcgatcacggctcactgcaacctccgccccctaggttcaagcgattctcctgcctcagcctcccaagtagctgggattacaagcgcccaccaccacgcccggctaattttcatacttttagagacagggtctaattttcatacttttagagacagggtttcaccatcttggccaggctggtcttgaactcctggcctcaggtgatccaccctcctcggcctctcaaagtgctgggattacaggcgcgagccactgcgcctggcccaagggtactgggtttctttaggagatgataaaatgctctaaaattgactgtagtaatggttgtacatatctgtgaataaaccaaaaaaacattaaattgtacactatcaatgggtgaattttaggtgacctatatcagtatataatctgtatcagtagataattatcttatatatttgtaaaattatttaaagatatttacatgcgtttcacatgtcagtttgctaatgatgtgatatgtattttaaattatatttcctgtaggagttcaggcaatttgttcatcttacatgaagtaaagagtatttttcccattttgaaacacggcctgtgtctgttattgccaccagaattacatggtctacattaaatcctatattgtgtacactgttgacctctttaatcttctgactttgtatgggacaaactaatggcctacaattttctgtgactatttcatttaaattatacaaatgttgaatgaaggattgctgaattaaaaatagttaaaaaaaaacccctcaaattatactgaacaggtgtcatttcaagctgagtgtttttcatttgggggcagggtgtcttctctctgaaaaagtgttagatctctacattatgtacattgttagcccttaaagatttttgaatggtttggattattagaagattctgcatataatcacctagaatttgattatacagctctgagaactatgaaaaggaactaatttttctattaattacatgtttggattattatttgcagtcagagctttggggttgggtattttggttgaaatattggcactcttaaatacatggtagtatctgaaagctttgttctaggcccacttgaaggaattgcaaaaaaagatgtagcagaagttttaagtgaagtggtttgttttagcaacattaacttatttacttaaaaataggtttttacttttttgcttctattgggtagtacttgtagttcaacagcatggattttcaccttttggagggaagaggagactgacaacattcctttttaaagccggcgtagtccctccctccctgtctccttccctgtctccctccctctgtttttttagagataggggtctggttacattgtccaagctggtctcgaactactgggctcaagtgatcctcctgcctcagcctcccagagtgctgagattagaggcatgagtggcaggccgatgtcataatttcttagtcaaagtattagttgaagaattcaaatataatgtcccctgtccactttttattgttgctttattcgggggatatttactttccttttgaaaagaaaattcttgaagagaaacctgatggtgggatttcaggcactgtggcaggaagtaagaaagatgtgttacggtagaggtggtcacccttagatcagtgtgggcagttgcttgtggggcatattttgggggaggggcatttctctctaaattgatgtactaggagatagagcatatttttgctgccccaagtaaacttttgatgcattacaaaaaggaaacatttgggcaactcccatttctgttgctttggagcttaatagtcattaagtttgtgtttctttatgtggtactgagtaaaagctgaaagtagcagagattgtataggccagtatatcttttgttagttttgaacttgttgggagcacttataattacctgtgtttctagagataaatcaagtggcacctctgtttctttaagttcttctttacctagctgagattcaggggtcttgcttcttgggtaataaattctacctaatttgaagctttgctttccttccagagatgtttgaactacatttactaatgcatatatgctgttggcataaagataaatttgttattgaagggattttctatggagagactgttctagtcttgacagctgcactgagcatgaaaagttacctaagctttcccaagtctatgtttcctcaactgggaactggggatgataatggtgcctatgcacccatcatggttgcaagtgtatagaaaagagtcatgtaaggcacaaccactgctgttaatactagtgttactattaacattgctataactaataatttatatttgaattgttcacactttaagtcctcttttttttgtttgtttgtttttttagctcttctgatttccagtagtttcatagagccattgcatttatcattctcctccaagagcttagttctctctctgctcccccttttcttctctcttcttttacagtcatggtcaaatacatttggagaattttcccttttacatgtgtattctgataataatgtctaaagactgtgtccctgttgactgtgctgcatagcttattttattgctctccatttgtcttaactgtcttgcctgaagttggtagctttattcctagattcataatatgctctctttactattaaaatgtgcattttgattgggcctggcatacttttttttgagatagagtctctctctgtcgcccaggctggagtgcagtggcgtgagcttggttcactgcaacctccacttcctgggttcaagtgatttcctgcctcagcctcctgagtagctgggattacaggtatgcaccatcatacccagctaatttttgtatttttagtagagacaaggtttcaccatgttggtcagactggtctcgaactcctgacctcatgatatgcctgcctcggcctcccaaattgctgggattacaggcgtgagccaccttgccctgcctggcatacttctttattgttaattctgagttatctggcatggggaagcatggctctgatcgtcagtgttcattctctgaattgagttttgtataggcatctctgtataaaatttcttgattattctttcctactggttttggctttatttggtgattgcatttgaagtagactgtttatttgaatactgtaactattcatgtagtttcatgttcattttttataagttgtatttcctctctatttttttttaaaattagcactagaggaaaaagctattatgaatagggttttgttgtttttgttttaacaaacccactatctcattgtttaagagaatttacacaccctagaactggttgaataattaaccaaaaacagtaaacctaggcatagcctatgtatttaaaaaacaaaaacaaaaacaaagacggtaggacaggcagtgtgaggtctagaagttctctttccctttcatgttataacattctctgtctttagagctcttaaacctctgaagagaaaaatcttattaggaaaatctttatagttaagcagggctgactttgaagtgaggcacgtgcgctggctggtatcatcactccacttcaggagatgtgaacagttgccatcagatgttatctatgaacttactcattggattaatggttatttgcttcagaaaactaaagagtaataggagagcaattcatttgctggctttcatagggttcttgttttgaaaaaggtctgttgttgaactgagatccttacagttgcatttccttatacctgataaaaagtttttttttttaattcttaaaataggcagtgcatttacatggcttaaaggggtctaaaagagtatctaatgagcattgcctctcatccctgttacctagccattcagtttctcttcttacagtttcttgtgtatcttccagaaatattttttgtagatacaataaaacacacacacacacacactctctctcttaagatttttgtgtcttttgacttatatggaaagttattatacttgattgtgaaataggttttactatgataatttgctgacctacacttattttgtttttttcctctaaaacaatgttttcctaatgtttatttactttgctcttatggctacccagtctgattccacatgccctcttttggccaaaccatccgcaatttgtgctctccctgtcttctatctttgccttccttcttctttcttagatatttaatcctggatgcctctatttctattcactgtactatggcatcagcttatagtcccttaattgcaatgaactctatgaagctcacatgtctagaatataatcactttggcttctttcatgtttgaattgtttttcaaccaagtcagatcgagtggccttagtctaggtgctctgttattgactgttctgtataatgttgaggatacttctatttaacaaataattaatactaataatagtacatcttactgtattatctatgtagccattaggcatttaccatcttctttcaaatgtttatcttacggtgttagatctctttatacttcattaatttatttttcacatcacagatggtttaaagtcttcatttactataacaactttgaaggttttactatttcactgtagtctctttcagtttgtgtatccaacgactcctgtggtctttagctctggatccagggtcttatccagaaaatcttcattttgttctttcttaatttttactgaggctctctggttttagagcccaaagatggatgcttctacagatttaagttttacctattatcactacaaaacaaacagaaaccctgtctaataagtcttttggtgattgatattagtttctgctttctaatattagatctttaactttagccatgcacaaacgttctgttaggggaatattgagcattaccttaagcagtggtaaaaactggcatgctgtgttatgtgaagaaagaagatgattcagtaaacaaacaaaaggcatttattgccttgtgccagctggcatcagtatagaaaacatgcagtgtaatgtcacccatgatatattcctgggaagttgaggttcaggataattccacaaaatggtttctgtgtagaacatatcatggatgacagggggcagagaatgcacactgcctttgtcgttttcattgttgggctcttatctcaactgagcctcatttcctatcctgatgggcattcttgtgcctgatctctgtctgcagggcttctggggcccttgacttcacatcctccagaggttgttcagttgatcatggcagctagtcatcatagaaggtgatgctactttgcctgtgggtgaaggtggactctgacagcatctttgaagaataggtgattttagtctctaagcaggagaggtgtacacgtggttaacatgggtgctacctggctgggcgcggtggctcacacttgtaatcccagcactttgggaggccgaggggggcagatcacttgaggccaggagtttgagaccagcctggccaacatggtgaaaccctgtctcttaaaaaaaatgcaaaaattagctgggcgcggtggcatacacctgtagtcccagctacttgggaggctaaggctggagaatcgcttgaacctgggaggcggaagttgcagtgagccgagattgcgccactgcactccagcctgggcacagagtatgacttcgtctcaaaataaataaataaaggccaggcatggtggctcatgcctgtaatcccagtactatgggaggccgaggcaggcggatcacctgtggtcaggagttcaagaccaatctggccaacatggtgaaaccccatctctacaaaaatacaaacaaaacaaaacaaaaaattagccaggcatgatggcgcgtgcctgtaatcccagctactcggaaggctgaggcaggagaattgcttgaacctgggaggtggaggttgcagtgagccgagatcgcaacattacactccagcctgggcaacaagagcgaagctccatctcaaaaaaataaaaaataaataaataaataaatatataacatgggtgctacccaattagtagtgctatagttctggagcaggattttggaggtctctaatgggcctggcgttaaccctttaagtacttgagtaataggggtatggaatatttcaatacttttaacattgcctcagtgtaacccatgaagatgagccttgcctgtgaggctgtgggctaatagccaaataccttccttccatattgacattttttttgcttccaggctcacctcgaggtacttcctttcacctctttctcgggcagtgttctaggatagtgattccagctttttctctgttatacattattttctccactgccttcatactttacatttctgcttctttggggggtggggggggtacacatttgtcacttgctttcctttccaagacccagggaatctcatgactactatagttcagttacagtttcttcctatataggtcatatttcgtgttcaatatacttgtaagaaattagacttaactttaacatgtacaattatacaaaaatgtgtaaaggcaaaggtaatcttttaaaatttacatacacacatgccttttccataaatgaaatttatatacatgctgattcccctgatttccctccttcccttctcctccctccttctacccgcctctctccacattccacatcctctcctcctaagaaccagtgttaccaatctggaatcaataactgtatactttcctttgcctatagattcctgcttcccttccctcttttcgcgcgcgcgcgcacacacacatttttgcataggtgtttgcctgatcaaagtgggatcattgttcacaaatgttcacaaacctgcatcatcttattcatcagtaactcatggaaatccttgcaagccttctggtttacctctaatttgttcattttattgctgactacactatgtatttgaccactcccctcccatgtgttgtgtgtttttatttcagtgtgctaacagtaggcattatttgttttaattttgctgatctgatgagtgtgaagcagttgttcattattacttttttttttttgtctcgaactcctgacctgaagttatcctcccgcctcggcctcccaaagtgcttgggattataggcgtgagccactgcacccggcctgctcattattaaagttgcatttcccttgaccactgttgaattcaaataatctttttaatgtacttgtaagtcattggatttgcttttttatgaagtgtctgtttgtattctttgcccattttctactgtcatttgtatgtttttctttgccggagctcttggtatattatagctatttgtcttttgacattgcgtgtgttttcccccgccttttttaatccttcctagccagcggaagtatatacttaaaaaaaaaaaaagtattgaagttttgtttttgttctcaggtagatgtgtttatcttttgttttatggctagaggatttcctgttttgggtaaaaatgtctttctcacttagattacttacatgcacataagtttgggactatcagggttaaatcacagaagcagaagaactaggaaagatgtgtaaggaatttattatagggatttgacattttacaatcatgggcacagattaaagagtttatgtgaggctgttgcttttatatttcttttctaaaaagggagaggacttttcaatttggtgtttctagggaagaaccttcacatttcaaatgagggtttgaaataaattgacatatttcaaatacagattcctttgcaaaaatgtcatgggtgataataaattgcctgactttgagcttttgggtttaaagaaaattcttttcacatagaccattttaattgtttaagatcaaaattcatttgacctgggtgaatggaagaagaagcccaatcatagagctgggttagtgaaggtttttggagcctttcctgctatagcattctatgataaaccttcctttcacaattatcattgatattacatctgcaagactttcgtacttgtaagtagttttaagaatatttgtttttatttttttacccacatctgcaaaaatgtgtgtggatatctgcgaattatttatggatatacaagtttctgaatgcaagcactgaatgtgactctacacacattcaactgagtggttctttttctaatcaagtaagagcagtcagtacaagactcaaaatcacagggggagccaaacttaaaaaaaatctttgacaagaaatgagctaaataatggctttctctttgaaataaataggggctattttgtcttgatctggggccatttgcctccatttccccccaactgaacacatgtacttgtgtctgtacacacactctcttacataggcttaagtgaaaagtgtaaatgctagaggaacttaagtgggagaaggaaaggaggacagaacagttcaacagactcctcagactgcaatagcgtaaaatatagaaattatgtggtacagtgaaaatagaataaaggatttaaaatgcagaattgatttgacccactaagcctctctattagaaaaacatttcccagtaagcctctctgtagacatttttcagttccttctttggataattttttctcatgttacattgtttccccttattctctgtagacactgttcattaaaaagggtaatgatggcttatgtaataatgtcatcctgtggatgcacatccagtgtacttcatactccacgggacatacactttgagtgattctcctcccagcattggtaatgtattttcactgaactcacatcttttgagtacccattataaccattgacagatactttccatttcagagagaaaaaaatattgggatttagagtgtgaagagcaaaattggtccactcaaacaccaaacccatgattggctttttaactgtcattttgtttgtttgtttttgttttgagacggagtctcactctgtcacccaggctggcgtgcagtagcgcgatctcggctcactgcaacctccgcctcccgggttcaagctattcttctgcctcagcctcccgagtagctgggactgcaggtgcctgccagcacgcccagctaatttttgtatttttagtagagacagggattcaccatattggccaggctggtctcgaactcctgatcttgtgatctgcccacctcagcctcccaaagtgctgtgattataggcgtgagccaccgcgcccagcctcaactgtcatgttttaaaccaaacaagctaaccagccagcacttgttttttctatgtatagatattaatataattgtggatgcaggaaactgcaaagttaccagcagatgccctttactttcagtgagagaaaattcagttcatactgggttaaactggtttttgttttttcctgtttcctaaaaatttgcatctaggtgagttttcatcttccttttaaaaagcttagaatgctgttttaccagtggtttttagttgctggcacttgccaggaggtgtttggggagtctacaattttgtacggtgtttggtgggtgagacaaggtctttactttgtcactgtaagcgtgtgtctttccttcttataaaaagagctggaaaagcagtaagagttgatttttggtaggtactttccatttgggttggctaagtaaaaatggcagtagaattttactgtctgggatttgacagtttttgtagtttgcctaggtagagaaatttgagttgttagctagtcttgattgtaatgaaaatgtgaaaagaaatgtatgttattacttgagactttgaagagctcttattattacaatttttgaaagaatctttctaaagaaggagaaagtatgtgaccctggagaggaaactagggacattatagagttaattttgggtagagaatgaagggattccaaaatcctgaaacttgttgatacatattttttgaagtataaccctcaagatgtcatttcttagctttaatttctgttaagatgggaagtagataatggcttggggcttttattaaaattatattgatagccatgccacatacttcttaacaaaaccagcagttctgctgagatttccaacagtgaagccattaatgaacctcttgtatatgaacgtaacaaattaaaccttataataagatactcttttgtagtgtgtgagggagtaaaattaacattgtcactacactgtgatggtgcatttctttcttttccttttttttaaagaataaaacagacagggtctcactctgttacctaggctggagtgtagtggccgtgatcatagcttaccaaagttttaaactcccaggctcaagtgatctcccacctcaccacccaagtagctgggactacaggtgtgtgttaccacactcggctaatttttaaattctttgtaataatggggtctcgtcgtgttgcccaggctggtctcaaactcctggcctcaaatgatcctcctgtgttggactcccaaagggctggtattacagacaggagccactgtgcctggcctgcatttctgtttaatatttgcaccatgttagggagctagaaattattgtttaaagcttttaagagtacatgactaagattggcagaagggtggattttactagggtaaattggactcaagcaagagtgtttccctctactacaaggtagaaactggacctttctgtgcctaattcatgagatgaaatccttattgagatttgaaaagaaagttgtaaatatggaagtattttagagagaaattgtgtatcttttcagaaaatagttttagactagagattaataatgaacacttgaaagttgtcatgggaactccaaggctgtctttagtacattctggtgaatgaatgatttctctcatgtttttccctcatgccccagtctgctgcccatttctcttggagggagtcatgttctttttcacctgaccattggttcttaccctttgcctgccctttaaataaatttctttccttttttctttatctcccttaacagcctttttctaatagtggaagttacagatttttctctgcaaaacaagaaaaattgccagaatacatctctctaagtcactgctttggtcatcatatcctagccgtcttcagaaatctggagtgactgctcttgtcaaccatgttaaatctaagctcccttcctagccccagaggcttcttgttatttggtcctactttggccaagcccagagtaacttcactattaatgggcatcatgtctcagattactggctctggccttctctgtacccagccatattgaaatcctgctgttccttttgtaccaagctcaaagctcatttatccactgcattcgttaaaaaaaaaaatttttttaaatagagatggggtcttgctatgctgcccagggtggtctccaactcctggcctcaagcagtcctcccacctcggcctcccaaagtactggcattacagatgtgagcctaccactgcattcttaagtgccttcctattttctaaatatcagtaatattagtggcactgtccatttgtatttaaccatcaaagcatgaagcatggtactgttaatgcataaaggttaaatgatttatacaaggtcccatagctagtaagtagaggtgctatactttgaacccagcctggctccagaatttgagcccttaaccactgtgcaacactgtaaggactagttgaaattaatagtatattagattgacagtaccataacttacaattgtaattccctttcagacattttattttgaaaattacgcatgtagggaagctgaaagaattatacagtgaaccacccacatatgaatccacttcttagattctattaaatgtttaaatatttcctttgagacatatttagccatccctgtatccatcttactgttttgatgcatttcaaattcagttgcagacacttgtacattcacctctaaacactgtcccatatgtgtcattaattagagttaaaaaaaattttttttttttttttgagacaggttcttgctctgttgcccaggctgaaatgcagtgatgttaacactgctcactatagccttgaactcgtgggctccagcagtcctcccacctcagcctcctgagtagctagcagcacgggtatgcaccaccatacctggttaatttttttattttttatagagacagggtcttgccatgttgcccaggctgatcttgaactcctgggctcgagtgatcctcccaccttggcttcccaaagtgctaggattataggtatgagctcctgcgcctgtcccagtatttttaaaggtaagttttatacatactgaaatgtacaaatcttaagtgtgctattggtgaatttcgataaaggcacataccttgtaacccaagcctctatcaagataaaattatgtaatacccttttagttgaatatttggcttttttttctttttctttttctttttttttttttttttttgagacagagtcttattctgtcacccaggctggagtgcagtggcatgatcttggctcactgcaacctccgcctcccgcattcaagcaattctcctgtctcagcctcccaagtagctgggattacaggcacctgccaccacgcccagctaattttgtttgtatttttagtagagacagggtttcaccactttggccattgttggtctgaactcctgacctcaagtgatccgcctgcctcggcctcccagggtgctgggattacaggcgtgagccactgggcccagcctttggctctcttgtagttcaagtacatgagttctacatgcccctcagaattaacccctgcttttctgattgttcgtgaactttcattggttcttcagtttattacattgacttgagaacagggccatctccagcttatttgccagcttacttggcatggagcatagtatgattgatgggcttgttattgtagtcatcattctgaattcctaaatggtatacatgtgtattcttcattgattaaaaattcctttgatatgtcgtttccagtcattttcatgaattaagctgaccatattcctatttgttttccaatagcacatgacttgttcaagtggctttgatgttgagggaatgcttcccttgaaacctatccttttttttccgtgactgccattttacaggtattgtttaaagatttctcagactggtttaggaggaaaggatggttctgtgagtctcatctcccatctacacccattcccttggtgatctcatctaggctagtgactttaaatacctgtattcacggatgatgacttctaaatttatgtttccagcctggaccattcccctggacttgtcatctctacttggacgactaataaacattctaactttaacatgtcatatattgaatcttaattgttctgcatcccccactttcctaatgtgttccacttaatagtcttcttaatcttttcttggtattcagttagttaaaatgctagttacaaataacagggctcagagcagtggctcacgcctgtaatcccagcactttagggtcgcttgagcccaggagtttgagaccagcctgggcaacatggcaaaaccccatctctacaataaatacaaaaattaggcaggtgtggtgccatgcacctgtagtcgcagctacttgggaggctgaggtgggagaatcgcttgagcccaggaggcagaggttgcagaaagccaaaactgcaactctgcattccagtctgggcaacagagcaagacccagtctcaacaactaaacaaaaaacagaagtctaacctttcataagtatatctaatccccagactcccttctcaatttaaactgagggcggggtgtggtgtgcgtgtgcatgcgtgtgtgtgtgtgtttaaagattgtgtgtgtgtgtttaaagattgatataaaatatttgaaaggtgagatcttaaaaatattattttccaatgtggtacctctgatactgaaataattgatgaataaatcaaaatactgattattgtttttggaaagccagtgatttatgtttttactggaaatatatttgtttaataattctagttataaattagggtaatggatttggtgggagtgtcagctgaacttcagataaaccgtttatagtttgtcctgttcttcataatctatctgattcaacacacatctaattcaaagcaagcacaaattgagtgtctaaatggtaccacttatgcactgtaattttttttgacactttaggaatgctgcatcaaaactaagaaaattcctgaccacctgctgttagattttcatgtggaataatagacaaatcttagactggcagggtttggttttttttgtttgttttgttttgttttgttttgatacggagtcttgctctatctctggagtgcaatgacgcagtctcagctcgctgcatcctctgccgcccgggctcaggcgattctcctgcctcaacctcctgagtagctgggattacaggcacgtgccaccatgcccagctagtttttatatttttagtagagacggggtttcaccgtgttgccccggctggtctgggcacctgacctcaggtgatccaccctcctaggcctcccaaagacttggcagttttaatacggtaataaaatgggctctagtttttggaagttgacagcaagtgtcagagaacagttttgcacacactggcttgcagggtctatcaggagagaagatggagatgtggtgatgtggtattgtcccatttgcctgcaggagtgtgccgaggatggtatattcttcttctctttcccactgccatttttttcctcctggtaaattacaagggaaaatagagaggtagcgctgtcaaggcactcctgaacacaatctttttttttggagacggagtctcactgtgtcgcccaggctgaagtgcagtggcatgatctcaggtcactgtaacctttcagctgtcaggttcaggagattcttctgcctcagcctcctgagtggctgggattacaggcacgcaccaccatgcctggctaatttttgtacttttagtagagacggggtttcaccatgtgggccaggctggtctcgaactcctgacctcaggtgatttgcccacttcagcctcccgaagtgctgggattacagacgtccaccaacacgcctggctctgaacgcacttcttaatgtgtgggccacatgggcgatccttacatgaaatagttactagtgcctaatgttcgtgtcttttttttctatttggatcaaaaactggcagaacatactttcaaatgaaaggtcccagctttcttgtggccaattctatggaatcccaagaaaactggaatgaaagattactgcctattcttaaagaattctacatttctgaaatgtttgccatatcttctacgccccaattcacattccccactcccaattaaaaacagcaagagagcaacttttattacaggtatgaagggtgttggggactttatttggtcatagaactggagtgagtgctaattattaaaagtaaaaagggtacgtcttaaatggcaggtattcttggtcttttaaaagtgaaagcaaaatgaataaatgctattttatacttgaatctgtacaaagagcaaagagaagcgtggactgaaaagatagctcagatgagtgactatattttttattgtaatttccaaatcgtgtagattattttgtagctgataggcacttagttttgtggatttgggagaagcaggtagtaagcccacggtcaagagatgtgggaaagtagagaaaagttgtggatgaaggaggagataaaaggattttccttgttggataaactagattattatcttggaaagacaatgccaagaaagttgttttcttgacttgaagaatctgggtcataagatctgataagttctgataagattgtatgtctttcattgagataggttaattctgagcaagctttatatggaatagagatttcagtaatatggaggattactctccagctatcacgaaacataccctcctgcgtgcattgaactaatggattatgtttgtgtttttaaattctcatacctctcctgcccacacccctcaataattctggcaaatctgccttggaaccaaacctgccacaattggaagggctgcttcctaaattagatgtgatagacttaaagtacatttttttctaaacaaaaaggaacgtaatagtgatccttaattctcagccatgtattttgtcctaaaatataattgtccaaagctgagacatcaatgagattcttatttcttttgaaaaaatagtatccttttatgataatggatagtacttgttgtcctatataattttactgaacaaggaaaagacatcacttgattttaagtgactaccttattcagaaggaatttttgagttagggattttaaacctttagaaatttagccttgattcataaagccaaacgagagtaatatcatatctaatattatagtacattttgcaaagcaggttacttgacggtgagataatgtggtaagttttatatcaatattagatgtaaaaagtgtaacaaggctgttgaggcttactgaaagttctagctaattatcagttctcattttgaatactgcacattaacttagagaagaaagactagaaagtagggttttaggaagcagcacatgggtctaacatgtctttaatgtgattacattctctatttgatggatctgtagcatttcactctctacacgttgctattaaaaataataaaacagttttgagcatttattctgtgctagcctcaggactttatgtgaataaatccccctgtggttgttactgctattaattctgttttacaggtcaaaggcccaaggtacataaaggttgaaggacttgtccagggtcagaggctcaagtgtggatcagggctcctaactgctgtgcaacttaacttgcccctgttgaaaatctaggtggtttttttttaatggcttctagaaagagacagttaaatttctgacttgttcaggctaatgattgcttcatctttttttatatatatatataatttattttttttgaaacagtgtcttgctctgttgcccaggctggagggtagtggtgtgatcacggctcactgcagccttgatttcctgggctcaggtgatcttcctacttcagcctcccgggtagttgggactacaggcaagtgtcactacacctggctaatttttgtgtatacatgtattttttgtagagacagagttttgccatgttgcccctgctggtcttgaactcctgggctcaagcagtcctcctgccccaggcccccaaagtgctgggattccaggtgtgagccactgcacctagctgctttatctttttaaatgtgttgtttcttaggaaattagttattgtgttatagattcttacctaaggagaacacgtatgattatcatcagcattttacagcccagttgggttcttcttgcctgctgcacagaaaaagccagtaccctgagacagcagaatttgcagcagagaaagagtttaataatcgcaaggctgattgaggtggacaagatacctttcaaatccacctcccaaagaatttggagactaggtttttaaagatggtttggtaagcaggggctagggaatgggtactgctgattgattgggctgggcatgaaatcataggagtgtcgaaactgtttcttggtatggatcaccagtataggtggcgtcagttggtccactagaatgcagtctgaaaaatatctcaaacaccagtctttttttttaattagatgggatcttgctctgttatctaggctggagtgcagtggcacgatcttggcttgctgcagcctccacttctgagactcaagtgatcctcccacctcagcctccagagtagctgggactacaggtgcaccacacccagctactttttgtatttttagtagagacagggttttgccatattggccaggctggtctcaaagtcttgacctcaagtggtcctcctgccttccagagtgctgggattacaggcatgagccactgcacctggccttttcttttttttagacagagtctcactgtgttgcccaccagtcttaagtttcacagtagtgatgttgcttatagaagcaattgggaaagttacaaatcttattatgaccattggctaagtgactcctgagcagtaaacaattataaaaagcaagctaggaaacagtaatagcctactgttttaactatgcttagatcttatcagaataattttaaccttaccacctttcattaattttagaaaggcagtttcagaccaccaacgagaagaagggtagtttttgggaggggactatgatcatccttgctttaaagttaagctgtaaactaaattcctcagctaaattataaactaaatcctcccatagttagcttagcctatgcacaggaatgaacaaagacaacttgtgaggttagaaacaagatggaatcagttatgttcgattgctctcacttgtataattttgcaaaggtggtttcatgcacaaccagagatgttgtatgaaatatgcttctgttcattcctgatgtagtggaagatgtgttttttgtttttgtttttgtttttgtttttgtttttggagagggagtcttgctctgttgcccaggctggagtgcagtggcgcgatctcggctcactacaacctccgccttccaggttcaagcagttctctgcctcagcctcccgagaagctgggattacaggtgctcgccaccacacccggctaatttttgtatttttagtagagacggggtttcaccatcttggccaggctggtcttgaactcctgacctcgtgatccacccgcctctgcctcccaaagtgctgggattacaggcgtgagccaccgctcccggccggaagatgtttttaattttaaattgtactcctcgtgtagaagatgtgtaatataatgtagtaggtgtttactgggtgtcccttgtgtgttggagccctgttgtctggtcccagggatgtgataaagaggaaacaccagctgctgaaagtgcttggttcattcttgcagaacttctaggctccacccacccttgggtcacggcaaagtttaggtcatcacagagtgcgcagcatgcttgtgtaggctccttacccttagcctttatcaagggtcctgatgaagaacaactctgcctgttctctagaacctccttagagggacagtccaacgttgttcctacagctggctccattttataaataattcacaggttttttcacttaagtgtctctttttccagcgaaaccaatgtgctgctttatccgatgaaagctgttggttttattctttgttttggccaccaggaagatcagggccaaattggtgtatagtgtatactagaaataatgatttcattgctgtactaggcctttctaacccctttttgtaatttatcaaaacccattagatctggtaaaatatgtggactcacatacaatattgtattataattttaagacgttcttgcatcctgaaacgtattctggacccttggggttaagagtcctgcttttgatctttttatatctttatttcactattctgtacatagttttattctaagtttccttgactgtatagaagtaggttatgtgtaaatgataaataacattgtttttagaggttttgggtactgagcagttgccctccatgtatttgacagcgaggcaatgggaaatgtttttgttcatcacaagaggaaattttttggccctcacgatgatgaaattggtaggctaattataaatggctgcagaggctgggtgtggtggcgaacgcctgtaatcccaactctttgtgggctgaggcgagtggatcacttgagcccaggaattcaagaccaacctgggcaacacatggtgaaactctgtctctaccaaaaatgcaaaaattagccagtctcataacccggtctggaaataattaattaattaaaaatggctgtagagttttggtacaatgattttccaggaaaagcaacctgtagattctgttgtaactcatttatttatttatttatttatttatttatttatttatttatttatttatttattttggtacaaatactagggcctaaagatggaagtcttatgctctaaacacaattgtcaatagatattcagtaaacttaatgtttatgatgtttttacacctcttctgtgtggtttttggtaaaatcttgatgaaagctataaaaaggctttggcaattgtctctagggctgcagttttcatatctgtttcctaagtgaggcatgaaccattggcctctgcccatcagggttgctgttagcagatgcttcttcatgctggatttctattgggagttcctgacttggaggcattgggcaagcctttgctcttcagcctccatatatagagggtagtattttcatttgtaggcttcgcaggataggatgcttgattgtacttgactttggagatttcttgctctttactgtcctcttcagatagtagaaggggaggtttaagatgtgtcctttaagagtattcccaaaacaagtattgaggataaaggtcaaattcatgctaaggagaaatgtttttgcagtagctatgactttcacctctttttccccttccctctttgtaaaagacaatttgtagtacattttgtctctctaagggagacatgactaccccaaatttttaaacagaccaggaagaatctattgtatatttgagtgggaacctgagaatgctgtggcatatagacaaaattaattaaaataactgataaatcagatgtagctttaaatgggattttcaaaattaaaatgtaggagaattatgttaataagctctgcttttaactctatcaagtataggaatgtgttcctttgtgcaatttaaaaccaccatcacctatgccctctagtgcttatgggatgagtttgacaatagaattgtgttctctgtttcctgcttctgccctggttactgctgatattcctggtgtgagagttctcttagtctctctgatcccagcttccctggcattgggaaaagggtggctttgcctattcctccatgtggtcctgctatggggctgtggtgctggagaaacaataagtgcatctgggcaaacacggcagactactggcagtcagctcctggaagccagggcagtttatgccctagcactgcccaggtgtagaatcctgtcctgaggatgtttatctgtagcaagccaaggacattatagttgacccttgagcaacatgggtatgaattgttaaggtctacttatatgtggatttcctcccacctgtgatacttatatgtggatttcctcccacctgtgataaccctgagacagtaagactgactccttttctttctcttccttctcggcctactcaatgtgaagacaacaagaaggatgaaggcctttatggtgatccagttccacttaatgataaatgtattttctcttatgattttctttctttctttttttttttttctttttttttaagatggagtctcactctgtcacccagactggagtgcagtggcatgatctcagctcactgcaacctccacctccgggttcaagcaatcctcctgcctcagcctcccgagtagctgggattacaggcgcataccaggttgcctggctaatttttgtgtttttagtagagacagggtttcgccttattggccagactggtctcaaactcttgaccgcaggtgatccacccacctcagcctcccaaagtactgggattactggcgtgagccaccatgccccaccatgattttcttaataacattttcttttctccagcttatttttgtaagaataccatatatcatacatataacatataaaatatgtattattttgactgacggtattaaatatgtgttatctaatatggactgaccgtttatgttatcagtaatgcttctagtcagcagtagctattaataaaaatttttgggaagtcaaaagttatgcagattttcgactgtgtggagcagggggttggcacccctaaccccagtgttgttcaagggtcaattgtagtttaaaatcttcccttccttttcccatctgtactcactgagtcgtcatccagggtggaggaggtcatgtagggatcttcatggtcctagtgtgtaagcacctgtgggacctccctcctaggagtggcatggaaggtgctgctgggatggacatcaaccaacccccaaggtagaggccaagtcgctgttggctagatacaggcaattggtacctttccgaagctctctgtggtgttagttcactgtaatggaggattcagagaggggcagccaactccatgccctgtgagcctgggacagttgtttgtccacttgctcaggctcttgacagagcagcttcttactgcatgacagctttttaggcactctcccttctcaccactttacctttactttcttcttatcctagttttacctctctctgaagacaggtaatgattagctgccccttttttcagtggacacatttgacattgtagaggaacatggaataaaacaactgttcatttaagatttctatgtctgtcacaaatggcttttcaagtttcacatgtcaaaattgataggttatcaaggaaaagtaaaaagaaggcattcactttttacagtatacacaattttaataacaaaacttgcctgtacactgctctttatgttaccctcccccctcccaaaacaccctgcataatagtattttcttcccaccctcaacccatctgcccacctcccacccaaaaagaaaaatggctcttgaaggtgattgaacacaatgtatttggactgtactttgagtttccagtctcagtgttgataggaaggttcaccaaacattccatatatcagacttaaaaaaaaaaaaaaaaaccgctaaggacaaaaatgttagttgaaagagttgcagaggtttccaaatgtttgcaatagcagaatgaaagcttaaacagtaattttctatttgtttttggccttattcaagtactatgagtttgccccaggttagatagagaaatatttaattatctatagatggccttactgtctctctctctttttttttttttttcctggctcaagggctttagtcaataagatatgaaaagtatgcccccaaacagacttttcagataggtctgtcgctgtattcctgtattaggaaaacgatcatgtaagtcagctgttaaaaatattctttaacaaattttatattgatatccacacttcagaaaaagaacaggacatttatagctttttcccctgatagctgtgtgtaggaagtgtgccttaagaaaatgaaatgcctgttttgaattttagaattcaaacctagtgctacatagggctcatttttattggaaagatggagtctagctcttggtgactagcattagaataagcagatggattttaataattagtggcgttgggaagttcagtcaattccatttattgaattgatacagaaattaacttaggcacattaagaaattacatgtgttagtacagatttttggcttaaaaaattagtatctttgctttttgatgctggcagtgggtattctcagagttgtgtgtggatttacaagtttatcagcccactcttttcagaaaggtgattgaaatccctgtcatgctacagaaatgaatataaacgatttcaaactagttcttggtttctagatgggtatggtatcatagtcttctttagctttcctttttccagagagattaattatttttctggttcttaatggtcattttcctctaatcttaaaaatagaaaaaaaatggagtgggtagtggtggtgaagaggataaaaccccatcaaaaaacaaaagctctgacactgtgtaaccaagatccgcagcgttgctgtgatgctgttccgttctagccagttggtaaagaaagcacagatgactaacagtctaatcttcaaacctgtgctgattctgaaacacaaatggacaaaaatgaaagaaaatcttgccttctacaggcaattaaaaagggaggtttttgcttttaaatgagaaaggaaaatacctttttggtactactgtcattcacttttcttaaaggacattacccagaaaaatggaaggcaaaaaattttgatttttttcaactggaaagtatgcctcgctagccttggctatgctgttcctctgaattagtaaatggctggcttttccaatttgcttttgtccgtacactaaggattttgccagttatggtcctttaaggattaaggtggagattcccagccaaagaaggggatttcttacccatcccacagtttaaatcttaattttgtttgtggtttgaaatgatggaaaatactcctctgctgtccttcagggctgatggaatcttgtgtgctcaggacacagttgtgttgtgaccaagctgtctgtcacctgacaaatggcaatggtcatcctgataaatgggttggtaaattttagctcgtggtgctcttatttgtaataggggcttctaattcagcctgtctgtggggaagtagggcgctgtgctctatgctgttaaatcagcttctgtctctgcccagacaagcccagggtctggtttaacaagagacaaaatactcaccactcgagatcaactgaattgaactgggctgagactttgacaaactaatctgcccaccttaaaaaagagcacatttttactgtaatttgtgatcttgtctgctttttaccgagagatgttaggtgaagggtactaaggtacccatctcttagtattaaagaagaaaaattgtgattaaatcttactggctaaactatagccttaacatgttttcagtttgatcctgggaagaaaaaatatgccctgaatgaaggatatcatgttgatgttgatgttggggaaaagataacttgaaaaatggtagtggctttctctaaggttttatgtcttttttctacatacagtaaatggcagttgtaaaaaatgctcattttctaaaatcaagttagtgctataattttacagttttttcaatatgtggaacaatgtttatggaaaagttctgtgtgaatgagtagcttgcatctaaattccaaatatttaataggttttctttagaaatcataatacaagaaactgaatacctgtggttcttttctgcatgaaaaatgtggcatccttatcatttgttaactatggcatgtttatatttacattggaggatctacccctcttcccttttcagcagcaggtcctttccctgtttggtgcagattgtgtataatcattgttggctgccttgtaactccagctaacctgagagtcagatttcaaaatctgcctttccttttaatccctcacctctgtgctgccttcaagttaccactgtgtggctgcataggcatgtcgagttgttctgccatgagattcatctcagtggtgctgttttcttcacctacactgaactacacttacagcgtgaatgcgtatctttattgaaagatcgaaatgtattatataatagttggaaagtgttttttttcatggttcctttgtaatacaataagaatcagtgttaagcctgttgctagccaattatttttaacttggctctttgaggtttgaagatcaggaaaaagcagaagaaagaggtttaaacccctttgtcaaggcatctttgatcatgatagttgagagagagagcgcgagagtgtgtgtgtgtgtgtgtgtgtgtgtgtgtgtgtgtgtgtgcgcttttaaattggagggagcatgtcaggattgttaaattgactcagtttgtcttgtttatctccaaaatatcttctaaatcttttttcacatattaatgtaaacataggatttagtacattaattagtacaatgacagtttaatgctagtttaaaacagttgtctaaatgccacaaaaatcatgtccattataagtcaaacgagaaatgtataagaagttggtgtaattatttaggattggtttcattgtaatgagaccttttcacagtcacttggattcattgtgtaaatatattaaagagtcactcagcttattagaattacattaaagggttctgaattcatgatatggactttgataatatctactaacccaggcagaaactctggaaggagaatgtttaatatttaccagtcttcagcatacatgaaattctacttcccaccctggcaagaaattgaagatttgagtaaataccaaattatcatacaagagaactttactaagtctccttttaagcagcaagatagttgtggtacatgggatggagagcagtgatcaaacaggtattgatctatatctgtttctgcccaatagcttctttctaaattgttttcagtagaaaaaaatagtatatggagaccttagtgtaaaggtttacacacgattgtatataattacatacatttcttattttgaagtaagcattttagactttccaacaggagtgcaaattaatgtgagcattgattcatttaacacttaaaatatggtttcatttaaaaaattaaaaatacttcaacacttcaaaaactaagtctccacttagtttggaaaattaggcttaatgtcaccattggtaaaaattagatatgtatttagcctctactatgtaaaataggttacttatctgatgtgatttttgatgatgggtagatattatacttcacattctttgtatggcagctgctgacacttgcactgtccataaccattaatgatgatgaagggtccttcatgggtgggttcatattcattatacggtccttggtctgacatgtttgacatatggagtcgtgtttgggatcggagctgcctgtggttctgaaccattgagcactgcctaattcttcttaaagtgggagggcagcacttcctggagatgaacactataaaaataataaaaaagaaagaaaacaataaagccattgttcccgtaattacccgctgagtgaagatggcattgtctggttcaggaaagtgttcctcggtagtaactgctatgcctgcagtagttgggatttctttgtctcccacatggtaacttgatgagcttattctttttgtatattcagtggttggatctctataagttgtagccatgacagtgacagtggttgacaaattccagcagagctgaaatccatggactgcatctagaatatcctctccttgggtgtggtcaggactgtggcataggatggagtgttcccaccgaccttggaaactgcccagccaggaggccagagcacatattcgggcgctgcattcccacagattgccagagagaccaacggttgtgagggatctcagggagtttaagatcttggaatcaaggctgtttaacttgttgttatccatgaggagtattttaagattgggcatcgtttcaaacactgtcaagtcgatggctttgatttcatttccagtcaggtctagcttttctaaagtgccccaggtccactccatcccacatgtcaagttgctgattttgttccattgtaagaagagcgtgtgcagactgcttagccgtaggaaatgagcaaaattaatcttcgtcagctggttgtgctctaggtgaagctctctcagtttaattaatcctgcaaatccattgcgagccaaacttcgcaaacgatttgtgctcaaatccagaaactccagactacgacagtcccagaacaggcgtactgggatagtccgcagggagttggaacgtaaatgcaaggtctgcagcttccgaaggccatagaagagctctgggtgcagagatgacagctgattaaaagacaggtccaaattttgcaggttaatcagttgggtaaaagttgtgtttggcaagtaaaatattttgttggaacttaagattaattccttaagtttatatagtccttgaaaagcatcttcttttactgttgaaatttgattgtgatctaagtggagccaagtaagttgactgaagctggcaaattgatctctttcgagctctgtgatgtgattgtgcctcagggacaggcccagagagcccttgtctgtggcgtttggcactgagtggaagccctgagagtcgcagtagaagagcagcttctcgcagcggcatttgggtggacacgccatacccagggcaggcagcatttttaaaaccatactcattgcatatattgctgccagcataggggcccctaatggccacttgaaatgtaagcctgcagaatataatttaaggaaaacaagaagataggatatttttcagcagaacatatgggctatttaaaaaaaacaaccaccaccaacattatagcaaaagatttcactgcatataacttatttttcatttactgcagaaaaattaaccttattggtatgactggaccaaaacttaagccatttaaaaagaagataaaacatgtctctgtcatcatcgatatatgcttttacctaaacctcaaaatccaaaatatgatggtgatttccctcataaaatgtgaattcggtagcttattttaaaagcgtgattccttgttgaatgtacaagacatataaatgcacagacttacccattcttctgagcacattggaggctgcattcagtcgcggttgttagactcaacgcagtgagtctgtaaaaggctctaacatgtaggagcctttgaccagtttcctgttttctgtgtcccaggctttccaagtaaaattgaatccaccaggacgagttgttttttccttaggatatccctctggaaagcattggtttcattttctgtgattgctctgatccctaaatcagttttgaatataagttattaaatttctccacctctaactgctcagctggttaatcaaagcttcagtctcctttccgcagccgttagttctcttggtcttaacttgttgatggcagatgggtggcttgttgcagagaagagctcctggagcagcatgagtgcatttactgaaaagcttttccgagaaacggcacaagaatggatttgcttatgtgctgcgaccacacagaactgtatataggctgacgtcaccggatgacgtgtcttttgtttgggttttccagaagctttactgttataaagcaccatgctttgtaacagcatcggggtcgttgcaggaccccctgattacaataaagcgagaaagaagaactcctgacttaaaaacatgatattccttcagtgtaggaagcagcagtgaggttgtaataaaggctgcattcaagaagacccatctgaacagtgagttgggttagcagagtgatgatttttaatgcttgtgagagccagtgttagactgccgattctgcatagagagatcatctaaatgggcagaagcctgcacaatttatgaagtgctgatttaacaccagcctatgcaaggtagtgtcgctgcactggtagtttggaaagctattcagttgccttgttgtcatgcttggttaaaatcaaagtatgactatgatttgctttagatgtgttgataaactagctaagtgggcttggcttgtttgtcatcaagagcttaacattataaacgaagaataaagggggaggggaagcttgcaaaacaaagcatgtggttatttttttctttgagaatttcaggggaactctaaaaagatttctctttctcctattttataacaatgttttgtcgccatactgattgaaaaaataatgctgagttgatctttaaatgtcctcctgggaggacaaggcaggttgatacagtcattttaatgcacatgccctaacagcaaagcagagatgatttaggacaagtgataccgtgtagctggattctgacatggccccttgtattttacctcagaatctcacctactccataactaaaagcctccgctggtactgaggttggtggttgtgacactgaaataatagagcatttgcaccctagttcccagccaccaagtggctgacttaactgagcctactgctgttgttagaacctgtcttgtgaatacaaaaggtcactcatgctttggactgggatttttgttttgacttgattttgcttgccctaactccagtttctccctgttgaatggtgtcttcacttttcagacctcagttgtggatgtatagctccatgtttagtgttatataaatgcaaaagatgtttctagatgttatattttcaggcctgacaaaggtaagcccttttctacatcttgccttattgatttgacccaacatacctatttctcccatatcattggcacttaccctttgtgggtcttgtctcagacctaaggacagacatctttaaaactactgatggtgtctgtgaaacaagaacatcgttggcctttttggttctgagggattcatcccactgggcagatctaagaagtaattgtcttgggtaaaatttttctgttgtagtgttgtgctggagtgagagctgtgagactccaaggtcccttccttagggctctgtgtaaaggtgctatgaaaactgcagcagtgcaggtgtgtggtttgagtcctcctagaagtgatcccaaggtagaattagaagtacaagaggcaaaaatgcctacgaagtacaaagggagacagaaggcagcaggaatgctctgagagtcttcgtaccacagggcaggtctgacacctgtgaagggacagaggaagcaaagaagatgagattggcattgtggttcttagacacattttgtaggctgaatggaaattcccaagccaaagttgccagtgaacagactcttgagtccttagtaatgagcctgcactagtacgtcctctttgttccttcttgctggttaaagaagggaaggaaacaagtcctggtttagacccggggaatgctactccccctctgaccttaatccttcctatagtctctctcaataggctagaacttcttaacctggttccataaactgtcttgtgaaatttttttgcttgttcatttttctgtggataaggttgagtccgattcctacagggtctctcaccctaggtttcagagctgctgttctacaggaacttgcccccaaaagttctaaggacagtagtctcataggagtggtctcttaaatttctttttttttttttttttgagacggagtctcgctctgtcgcccaggccggactgcggactgcagtggcgcaatctcggctcactgcaagctccgcttcccgggttcacgccattctcctgcctcagcctcctgagtagctgggactacaggcgcccgccaccacgcccggctaattttttgtatttttagtagagacggggtttcaccttgttagccaggatggtctcgatcacctgacctcatgatccacccgcctcggcctcccaaagtgctgggattacaggcgtgagccaccgcgcccggccaaatttcttaaatgaaaataagcccttgggatgttgtaaatgcccttattgaagtcagctaccctctgatgaaaaaaaccctttgccacgcaggagaagctggattaaactcttctctcaagtaactacgttagttccttggggagaaaagcattttagtcagttggattagagccaccatgattaggaatgagttgtgtgttaacatgcagaaggaaaagcatctccgtgcccttaaactcttggtttttagtctgcttggcctacctcttaaatactaataaatggagactacttaaattatattatctcagtactattataacagatttgtgggcaaggaaaattgcccagagaagcatcagtgcaatcaagagtaattattttttgaaggcctctgaggaagtgggcactaatgcttgcagtatcatggtgcccagagagcacagccccttccaggtcaccagccatctttctcacctgcccactctttgggttcaagaggttcaggctgtggaaccaaagaagacatggagtttgccttaaaattggtagagtgcagagttcccattgatggaattgtgtatcattttttggtctttatctttctttagctaaaagggctacatatctatttttctaaactttctcttggttttgctgtagagcagcttttttccgcaaacatatgactttgacttaaagtggcaatactacttctggaaggtactgtccatatgatctgtttcaattttcattgctttagatgttcatgataaggcaaaggagaagtaaaatctaacctgtctcctctctgtaaatggttttaagcaaattaactgagtcaagtggcagggcttagatggctgtagttgtctgcattcctccacatgagagtttgcttttcatatgtattgctgattagggagagttattcccctacttggagaagcaaatgtacagatatattcatgaaatttcctgttcttctgtgggagggagggtagagagggagctttatatttgctttatgctaaaaaggcaaatgtttctttcatcatacccagctccaaaaattgtgtatgccctggcaccaaagtgttgcccagaggtgttttggaggagcatgttaaaataaaccttgttgctggcagtctcaatccctgcttttaaaaaaatgatagctggccaggcacagtggtagcctgtaatcccagcactttaggaggctgaagtgggtggagcacgaggtcaggagttcaagaccagcctggccaaggtggtgaaatcccgtctctaccgaacatacaaaaatcagctgggcacggtgacaggagcctgtaatcctagctactcaggaagcggaggcaggagaatcgcttgaaccaggtggcagcctgggtgacagagtgagactccgtctttaaaaaaaaaaaaaaaaaaaaaaaaagccatttttagggtggaggtcctagatgttgtgtgtcttatgtcctctgccaagaaccttttaaggtgttaactggcaaccacatacttaggcttatgtcgtagccagacttgtattagagtaagtgggttttactagcttgtctttttttgaaagagaagggaatctttcaatagtagagtgtctacattagactaccagaatctccatttctgcctggatccttgtctccatcccttccttctgttgattttattttgttgttgtgttttttttgtttttttttaaaaagacagtgtcttcactctttcacccaggctggagtgcagaggcacgatcatagctcactgtaaccttgaactcctggttcaagtgatcctccagagtagctaggactacaagcacatgccaccatacccagctaattaaaaaaatttttttcgtggagacagggtctcactatgttgcctaggctggtctcgaactcttggcttcaagagatcctctcaccttggcctcccaaagtttctgggattacaggtgtcaaccaccatgccagctgattttgatttttaaagtccttttgttatcttgttagtaaacacaactgagaaagcagtagaaggggattctgattacactaacaatggtaagcagtgtttctttggatgcaccttacacattttgggacatatccttctagttttggatacatgtgcactccggcagttgttgctgttggggaagtttcagggtcagaatcatgtgacaacctgcttcccttgtattttgtgcccagggctagatagttcagcaagaaatcttggagcaatgcgtctaagttgggcattaggttatggaaggtcttccatagaagtttggacagatgaacgtttatactattaagatgttttatttctcctattatagacatcaaaacaaaaataacagactctatcttgaagtttttgtgtttgttcgtttgtttttgagacaaggtctcactgtgttgcccaggttggagtgcagtggcgtaacctcccaggctccattgatctccctccttagcctcccagatagctgggactacaggtgcgtaccaccatgcctggctaattttttgtggagacggggtttcatcatgttgcgctaggctggtcttgaactcctgggctcaagctgtcctcccacctcagcctccctaatcgttgggattacaggcataagccaccatgcccagaccatcttgaagtattgattaaagcacaggctgaaatgtttatggcaacctccccgccgccccttttaaaactcttcttctgctagtggcttcattgtgttcatgttttccctttcccctctgtgtagcatgcttcatcttttattctgaaatacatagccaagtttggggttgtccttcctttctcctctctacatttctgagtagcttttgatgtagatgttatttcctcttacctacatagatggcccaaggggctatacaaagaaagctgtttgcacaggatagaattaagaggtaagatacccgttcatacttacttgaagaatcgttcaattttagtggactctctgacccagttgtctaaatttaaggggttagtttgcatgtttgttggctatatgctagcacttaaggttgatgaagcttggaaaccatcatctgagaaccctcttaataggttctgggctggaggggcagtgacaagtgatatggcaaggaaaaaaaaaaacacattgaatatgtgatgttgttaatgcaaagaaaattcataaaaatttggcccaaagagaacaagatcatttcttactctgtacggtttatagcagcatgtcagcattccgtctgcagttgagatgttgattcctccttgtattgcacattgctgaaaggggcttcctgaggctggagagagcagtgaggtaagactgtcctccttgagagctcgtcttgatgcttgttgcgtttgtctgtgtatgtctgcagtgtctgttctgctctttgtaatttaagaagagggcattctttgaaaagaatttgggaatacaggactatataatcattgtattctaagattgatctactgttgagctttgcttaaagcactcccagcaactcttgttacatgttcagcttaggcagagcccaccagccatttgtgggccaggtagaacaaccaaggtcaaattgcttctcctgttattcattaaatatatgttgtatgacactgtgttgcccagcccacagcaagctttttagccctactcatgaagacatgtattgactccctaaaagctgctagtttcccttagttttcaaacatttttcttgataattctctttaaagttctctttcctctcagaaaccttcttggttgtgagcaacagcttggttatcacttcctttctcaagatcttcatctcttgctttattgaaggtccctactgtatggatgacagccccagttctcttttttattgtcttgggtagaagaagcttcaatgctgattcttatttggtcttgtaaaatgccataattcattgtttgttgttgttgttgaattttctaatggctgaggaggtattttatctaactagatcttcctgttaaactaatcagacctcctgtttgttacctttttaaacagtccttaaatgttaagggttaaaacactgtatttcaccctcctctacccacctcaggcttactctagattaaaatgaggatagaaagcagaggtttatttgaagtcttatattctaactagtgacaaggaagcagagactgatgacttgccacacagattacacatgaagtcctatatcttttaaatgtgtctctaattggttattggtttctcatttcattcatgtccaatgggagacagacaagtcaacaggtagttatcctaaggtatgatttgagaaggtctttgagaggaaacatgagatggtgtggtagcattctgtggggacactgaacttgaacttagggctgaggttggctagcagaagcttccacaaggaagtagtttctcatctgaacgatgggtaggagttggaaggaggggagaagagtattttatgtaggtgagagagagcacggcatgtctgaagaacaaaaatgtatgtgggtgggtcagcatggaagatggcagagtgaccataggttcattaaagcagtaggaatgaccaggttccatagggagaatgtgtagaagaaggagaaaagaaagcctttgtttagcggaagaggttatgtggatctttcaatgtagggcactttttatctaagaagtatggtgggatgatatttgtttcgtgcagtcaggttgagtagcttttttgtaggttcacctggaaacctttgccttttcatttagggactaaaatgtgccttgagatgccaccagcaatgccaggaacatatttcatcccttccaaactggcaagggttggagtaaaaagtttcctcactacttccagtaatagttatacgctacagggttgcttttcctaaggttatgtttgagtaacgtaatttttgttcagttaatgctagaaataaaaaatcataactttaatctcaaaagaagtagaatcttgtttttgtttgtttgtttgttttttgagacggagtctcgctttgtcacccaggctggagtgcaatggcacaatctcggttcactgcaacctctgcctcccgggttcaagggattctcctgtctcagcctcccgagtagctgggattacaggcacatgccaccacgcctggctaatttttgtaattttgtaattttagtagagacaggatttcaccatattggtcaggctgaaaccaaaggtttcagctttgaggctaaaggtctcaaactcctgatctcaggctgtccacccgcctcagcctcccaaagtgctaggattacaggcatgagccaccgcgcctggcagaatcttgttttaaaatgagcaagctttatactttcctcaagctcagtgttaaggttgtgagtgtgtctatgtgtactcatctctattacattttaaatgattggtaccctaaacttgctatttggactgtatttttctaaaatgatactgtgattttaaaatggtctgtctagtataacttaaagggcttagtaaataactgctcctaaactgctccccttctgattaatgaggcataaacctctatttcctgcaataacaagaaagacaaattgattttttgggtagtttgacaaagacagaattaacagattcatggtgtgggttgcattgcatcttaaagtgaattttgctgtgtgactgtaattctttcaaaagtcaaattcaaggatttggttttacataacttgaacagtaaatctttttactcaaattgagaaaattcctgggcatttcaggttgtaggggattgggctttcatgaagtctacatgctcaacctttgggtttcagattctaagtgttttctagaacaaatgatctattagaaacaccagaaaaatgtggctaggaacaatggcaaactttacagggtttatttagagaaattttcttgacgtgagtgcttgagtatcttaaggaatatgctgagactttcctgattaaagcattaattatgaagtcagtttgattgtgattcagttttagctacctttgtcttagatcctggtattttgagctttaagattgccagtaaataattgcacgtctcaagctgactagtgtcaacaagaaagagtcaaactctgtagaatgtttgaagaaataaatattctagggcccaatatgagtggccaaggcccaaggcacagtctcaagaacatattcccaaggtggttgggtcataccttgattttatacattttagggggacagaatttataggtagacatcaatcaacacatgtaaggtgtacattggtttggtcctgaaagcctggacagtttgaaagggttggtggggggcttccaggtcataggtggattcaaagatttcctgatggcagttagttgaaaggattaagctctccctgaagagctaaagttggcagaaagaaatgtttgtagttaagataaatggaggcgggaagccaaggttcttgttatgtagatgaagcctccaggtagtaggcttcagatattagatggcaaatcagatcctaaaaggtgccagattcttagttaaatttctcctaaatcaggaaaaaacctagaaagggaaggagattctctacagaatgtagattttccccaaaagtgaccaatttgcagggccatttcaaaatattaatatttcagataaatacattttggggtaaaatagttggatttctttcagggcctgctatctgtcatgtgatgttatactagagtccatttggaatttggtatcttattgctacaaataatctgctttgtcagtcttaagtctgttttaatgttagtgctggacagttgtgcctgaattccaaagggaggagagtataatgaggcacatccaactccctccttcccatgatggcctaaactagtttttcaagtttactttggaatgccctggctgagaagggggtccattcagttggttggttgacattcatgaccctgaataaatcagtttattcctgcaggtagaaatcttcctatttgaatgagtttttgttgagacctctcctccccatcagtattaatggaatatttaatttgattggcagtacaagagtgctagggggaaaggcttaaggaatgagaccataaccagatttgatagtgatcatatcaattttacttatatttcaactcttactattccctgttgtctcctttctgccctttgctaaataacctatatccctcaatatttctaacagtccatagagagataggtggcattttccacaattgacaggtaagggataagagataaagtgaataacaaatgtacattaaaggcacttagtaaacagatctccccattcctaaccattcatctgctctactggcttgtgtactaagagcatacccataccaaaatgtcttgagggcatccaaagggagaacaatgggctaaattcctttgttcatttgtatctctcctattatttgctgacatgtttttcagaaagaaccgtatttgttttgcgaaaacaagcttttaatatactttatatatactttatagtttaacctacatgatgtaggcatttccagggacacaacaatctccacctgggatttaaaaaaagacttttgttccttttctttcaactgctattttattccatttgattctgcttagaatgttaccctggcaaatctcgactcagcaccttgacctctgaagacatgctgttttacataccacttcaagagtgactagcgggttcttttctgtgcaatataactgcattaaagcttagtctaggatttttttaaagtgaccaaagtaatcctacaaagcattatgatttgagctgcataataaacattattagctctgacctatcaggtacatcttagtttttaaatttgttgtttcacattgtttcagtgccaggtcccatttttcacatcttgacattcttcagatctcagagttcatcaaaatcaggtgtaccctgttcttgctgcagttcaaggagagctgcttcattaataaaattggtgtatgctgaaccttgagttaaaatataaatttaatttttaaaagccaaactttaagcaaagctctttgtctcttggcttctcttattttggcaaaactccctcaattccagtcatcagataatgtggagcccaagaattgtaaggttgggtttttatgaataaagccacataacacccctctgctccccagtattttccaactttgagtttaagaagttgtactgctttttcagtgttgacatgagcacaaatggctataggctatcattaggtttctttgtaaatgaataaaatgctcatctcttttccttttatccaggctggacgtaaagaaagaagtgatgcactcaattctgcaatagataaaatgaccaagaagaccagggacttgcgtagacaggtaatctggatgaaagtgctgattgtttttctaagttctcaattttgtagttttgattaaaatcctaataagcactggccttatatttttttattgagagaaaggatggattttcacaagaaagtgcctatctttgttttgttgctaatatgcttcttaatggctaatcaaatttcatgaagacatgggataatacagtctcactgtgttggactgaataagttagctctagtgtgaaaggcatgtacaggtaggaaaataaatttaaaatgacttggagacctgtgaaaataatcctgaaggatcttgttgtattgactatgtacaatagagacagaaatttcagttgtttatctgacttgccctatactcattacacacttgcagttcccttagatccatggtgaaatgtttccagttccaaatatggtaggtatagagatatttgaggtgctgaattttctgagttagtaaatacagagtagagaaatcgaaccttttaatgataaatgaccccattaacatttggagtcaaattgagttttagtctttaaagaagttagagttgattttataaagcaatgtattaagacttaagaagttgtaatacagacaatttttaagaggtaatggacagatattttattgcttatgtctgatataaaacaaaattaaagataaaatatatctttattcaatttccttttggtgaagcagtatcagaaatggttataaagagaaccttaagttttaaggttcatagtgtgtgaatcctttcagataagccagataactcttttttctctcttctctttttatttagccaattaggctaattatatatatattccaaggctatgtgccagttcaacccagagctgctttcagttcagcttttgtattatttaagttgtaagccctagttttgtaattcccaagaaaaaaggatattgtcttaagaactgagattctgttgctgaaatgctgtaactgtagtaatgtaaaccattgtctccatgatcatgtttcctgtgttgtagattatgtaactgcatggcttacatgaggggtcctcatgtaagtgcagcaagtctaccgtaagcttcattagatttaagtgtacaagagaataaaaagcaatctatttaatacctttttggtagaaataaaatcaaatttttacaatttaatcattagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggtaagtgaattagcagtttcattgacttgtaggcaacttggtgaagtgtggtgagttttaatcacattatttaatcagttaaaatttgtaagggctcgcttaacatacaacatgtctgagatgatagtctttcattatcacttaacatctaaggaaaactaccattttggtcactttacattaactatgtacgttattaaatactaacagttcctatcctagaagcctaacatctccacttaatgcaaataaagataaatcatgacatgactagactcaaaagataggatagaaagcaacaatgcctaagaaccagagctcaggaaccacactgcctgcgcttgcatcctgacaagctaacctaaccttcctcaattgccatttcttgtctgtaaaattaggacactgataatatctatcttgggattattttgaggacctaaaaagatgatgtatgtcaaatgcttagctttatgcctgagacatagactcagaccagtcttgttttaaaagcagagaaactgagccctgacatggggctaattagttacatttgcttggtagaaatctgtatgttagtagttggtttgtagggtggcaagaagaaagagtgaatcgtgacttatttcgcaggtaagttaggcttacttctccttttgctaactgaaattatgttacttaatttattcattattgctgtattttggaaatgggacacaaaataagcatatattcaagttatttgattttgtaatcttaatgcagaacatctaatacttggtaaagatattccatataccatatggtaagctggtcattgtgtaaaaacagaaaacgggaccttatgtaaaatgtgtgtctcgtacttttgaatttatagtgatattaggccacgttttgttttgtttttatttgtttgttttgaaactgagtcttgctgtgtagcccaggctgaagtgcagtgggacaatctcagctgactgcaatctctgcctcctgggttcaagcaattctcctgcctcagcctcctgagtagctggaattacaggcacccgccaccatgcctggctaatttttttgtatttttttttttttagtagagacggggctggtctcaaaactcctgacctcaagtgatctacccgccttggcctcccaaagtgctaggattataggcgtgagccactgcgcctggctaggccacgttaataccataaaaattttccgaggaagacaccagtagtcacatcgtgcattactaattttacatcattttctttgaacattaagtgttattctgacctgaattcattatttacagaatacataggtcagtctgctatttaagttaatgattctggcatttgaaactaaaattagaagactttgattttgtatctccattaagcataatcttgttcacaatagtcacatgacagcatgaggtataacttccagatacacacagattgcgctcaggaagccagtctcttgtaagtagcatacatattagaaagttcttccgcatggtaggaagcaaggatgctgccagcccaaggccttgggtaccagtgtggtgaagggctgagtgtggcagctgaagagagggcagtccttgtctgtattggagcatcctttattagggccagctgcattatcctctgcctctccagcctaagagagctgacatttgctgagcacctactgtgtatcagctatgtgcaagtacagtgtacttcccacaacatttctcaggtaaggaaacaggtttacagaggttaagtaagttgcctaagttcacctggcttacatccctccaataatgagcactgtgcactcaagctcactggcttagtggacagcctaataccccactgaagcattgagtgggcgaggaagtattggagaccttgctccaggagctttttccaagcttatatattttattgtatttcatttaattctgaacactactaaccaaaggcccccccacccccaccccccagaattgagagtttggtgttccccatcacagctcagttctgacccctttctaacctctcttctctccacacccccacacgttaactatgcattaaatgacacatggcttttcattgcttgaggcataaccataggctttgtagtcccattctgcaaacagttaaattacatttacggtaatagagacactaggatgtataattgcatatgtccatgaaaaggaaataaatttttaaagtgttgtagaagcctcaaattcctgacttatggcagaattttattcttcagtgacaaggcttctcctcccctaccacttttgtattataatgaaacactttgaactagtcagtgacttgttttaagcaaaggtaaaatatttcattgtgagtgttaatttcttgactgcttcatttcttcttgttctaactggattaaatgtctacaggccaactttggttttaagggccatttgccattttccctggggtgtaagggaagtgagagtgctatatgaaagttgggcagggttgatggtgataagcctctggcaagagaggagaggttcagacattgcagccactgagaagtctgccagatgtgtttgggttgagtgctcctcctaaaatactgcaatacagttctgatgctaatcaccagaagttagtgcagaccccacaggtttagggcatggtccccaataagatttgccttcacttcacatgtcagctgcaagttctggggtccccaggccacctgtacttctgaccagccaggtacaaatctgaggggttcctatgacccacctcaggtttcagtaatccactagaacaactcatagaatattttattataaaggatactaatcaggaccagccaaatgaggagacacataggatggagtctgggaaggtctcaaatacagagattctatgcctcttccaatgaaatcaaggttcatcatcctcttgtcacattgatgtttcaccaaccagaagctccactgagtttcagtgttcagagtttttattggggtttcattatggaggcatgatgatccaataatgatatagttgaactcaatctccagtccccttccctgaaagccccagtcctctaatcacatggttggccccatatcctgaggaatctccttagcataaactatcagggcttgccatgcatgaataacattcttccattactactgaaattccaaagattcagaggtttcctcacaggaatccaggacaaagaccagaccagacaaattatataatacctccccatcttaaaggtatgtggaatgcatgatttttaggtagcttgactacacaggccagcttagcatgctgcagagtcataaacaccacctggaagaggtaaggcagggcaagtttgtttctgcagctttttgtcgatcctttttatggttgttacccagtgatttaccacttgtcttattgggtgctatttgctttgagctttccttttccctggagatgctcttttctgagtcaagttttttcttctccgcagggaatctgatcccatctcttcacaccagagtgagtggtcctttctcatagaatcataggttcttagtctggtgtgtaaatccctttcacttgtaatctttattgtcatgtctgtattggatccttcagcagtgggaaactctccctccagagacagcatatttaactggtatggtagattctctggctgttagaggaggggagttacaacctccttttttttttggaacctctcctgtccatgtgcttgctgattacacacatgtgaattagaagtactttaaacataagattaatggccgggcactgtggcccatgcctgtaatcctaacatttttggaggcggaggtgggcagatcacttgaggtcaggagttcgagaccagcctggctacatggtgaaaccccatctctaccaaaaatacaaaaattagccgggcatggtggcgggtgcctgtaatcccagctacttgcgaggcaaggtaggagaattgcttgaacccaggaggtggaggttgcagtcaaccgaggttgtgccactgcactccagcttgggtgacagagcgagacgccgtctcaaaaaataaataaaataacaacaaccacaaaaacaaaaaaccataagatacatatgtgaaaggaaaataaatcttgggacccccaaatcagtaagctaaagggaaaaatcaatctgggaactgcttaaggcaaacctgcctcccattctttgcaaagtcatttctctgctgtggggataaatgcatatgtgattgattgcttcctttggaaagggaatcagaaactcaaaagaatgcaactgtttgtctcttatctacctatgacctggaagccccttccctccttcgagttgtccagccttttagacagaaccagtgtacatcttacatatatggattgatgtctcatgattccctaaaatgtataaaaccaagctgtgccccaagcaccttgggcacaggacttcctgaggctgtgttacaggcgtgtccttaaccttggcaaagtaaattttctaaattgactgagacctatctcagatattttgggttaacacatacttacatattttcaggatgtgatatagaaaaagaatataaaatatggaaaaagaatataaaatagcttagtttttttttttttttttttttttttttttgagacagagtcttgctctgtcgcccaggctggagtgcagtgacatgatcttggctcactgcaacctctgcctcccagtttcaagcgattctctgcctcagcctctcaagttgctaggattacaggtgcctgctgtcacgcctggccatttttgtatttttagaagagatggagtttcagcatgttggccaggctagtctcgaactcccaatcttgatcaagtgattcgcccgcctcggcctcccagagtgctgggattacaggtgtgagccactgtgcccggcccagtaataattttttatattgcttgtatgttgaaataatttttggtacctttttgcctttttaatgtgcctactaaaaaaatttaaaaattcaggctgagtgcggtggatcatgcctgtaatcccagcactttgggaggctgaggcaggcagatcccctgaggtcaggagttcgagaccagcctggccaacatggtgaaactctgtctctactaagaatacaaaaatagccaggtgaggtggcaggtgcctgtaatcccagctactcgggaggctgaggcaggagaatcacttgaacccgggaggcggaggttgcagtaagcagagatcgcgccgctgctctctagtctgagcaatagagatagactccgtctcaaaataaataaataaataaataaaaataaattaaaaattcttcagtggctcttgtacttttgttgatctagatgatttccctgagccttttagagggtcatttttgtcccagctctcctctgaatgcccttcactcaaggccagccctcacggaacacctgttccggggtctggggatgagggtagagcagtggaggctgtcatcattccggaaggagactgcccagtgtatcccaggatgccttcagccttttgggcagcagcctcactttgtgatgcccattgagctcacagttggtcagcatccctaggctttccatacataggtgctgctgctcagtgtcatcatgttcgttcctatcagcgtggatgtgggtgggtgtttggctcttatgtatggctttgaaactcatctagtataaccttatattccatctcatgttctgtcctatcaggattcctgctgcatttttccacatattattggctgcccccttccatttgtgtcctttctttaaaataaaatatcttttctccttttatccaacctgatgttttatttttattttatttatttattattttttcttatttaattattttttaaaatttatttgtttatttttgagatggagtctctctctgtcacccaggctggagtgcagtggcgcaatctcggctcactgcaacctccacctcccagattcaagtgattctcctgcctcagcctcctgattagctgggattacagacacgtgccaccacgcccacgtaatttttgtatttttagtagagatggggtttcaccatgttggtcaggctggtctcgaactcctgaccttgtgatcttcccacctcggcctcccaaactgctgagattacaggcgtgagccaccgcgcctggcctatttattttttttgagacagagtcttgttctgtcacttaggctggagtgcagtggcatgatctctgctcactgcaggcttcgcctcccggttcaagcaattctccctgcctcagcctcccaagtagctgggattacaggcacccaccaccctgcctggctaatttttgtagtttttagtagagatggggttttgccatgttggccaggctggtctcgaactcctgacctcaggtgatccacccgcctcagcctcccaaagtgctaggattacaggtgtgagccaccatgcctggcctctgatgtttaaaaaatgttgcctaagattaggcataatatagagcctttacttttctttctcttttttttttttttttttgagacaaggactcactttgtcacctaggctggtgtgcagtgacacaatcatggctcactgaagccttgacctcccaggctcagatgatcctcccatctcagcctcctgagtagctggggccacaggtgcaccaccatgcctcactaatttttttcattttttgcagagatggggttttgccatgttgtgcaggctgttctcaaactcaagtgatccttccaccttggcctcccaaagtgctgggattacaagtgtgagccactgcgcctggtctacttggtttctgtggccacctccctagtctgcactgccatctctcactgggcttctgtagcagcctcctgattatgattatgattatgattatgattatgattatgattttctagcactaaccctgtccctcccctgacccacccatcctgtggcttctaggtaagcctggaataatattcaaaaatccagattctcaaccatggcccctaagtttccctgcctacaactgcctttcgtcctgtgtctcccttgctgaatgacttctgccatagttgactagttttcatctttgaccatacctaaacatgtcaccacctgtgccctctacccacatgtcacttctgtagagaaactttcctggaacgcttatcccctccattgcatcctctagcagtcattttttcattcaccagttttacatcctttgtagtgcttcttactatctgaaactattgaatttattttcttatttgtctggcccccaccccatactccaaaagaatataagttatctgaggacatgggccaagaatagtacctagaatatagtaggtgctcagcaactactagatgagggaacctattggttctcaaagttaataaacattagagttgcccaggtgctcaacattcagattcctgggctaccacccagccccctccccaagattctgatttagtgggctgaagactatactttagaaatgcagagctctacattatgactgatcgtccttgttagtggactttgtcttattctgaagtatgtgtaacatttgcacaaaagagcgttgtaatgcatcttgcatatatacccagtgtgcacaaggggaatgaactgggaaaacttgtgggatgtggagatggtgggaaaaatttggagattttttttgaaaaggttaactgacattgatttgagcagttttttggggggggggatgggagtggctagaatgaagctttcaaaaacctgtagcaaacttcctgtatttgagggagaagaaaattgtaacaaaattcttaaaataagtatttatagatttcttagtatgtcctggtcacagttctggacattaggaatatagtagtgaatacaacaataatctctactcacataaagattatcttgtactaaatacgtattttatataatgtatatattttttacaatgtagtagaaattgtactgaggtgatacgtgcaagttgtccattttatcagagtttgaaatgaaagttgaacaaaagctgttatttcagtagcattttaatacatgaccaaaacaaatttggggcagatgtgttgattcttgctaacttggtttttggaaatcttatctgttgctttgatagaaatacttttctcccagaccaaataaaacagtataaaaaggttatgctttaatctggagtttcacataaagttgcttcaaatatgtgaatagttcctgagtagtattagggctaacacccactcagaagtggaagtgttttatgatgccttgtgtgtatatcacactatggaaataagattcatttcaagaataaaaaccacatattgactattgaggttttatcgacagaagtaaattcctctagtccccctgtgtgtacacagtgtcagggagtctgtgtggtgcaggctgcctattggatctttattattttttgagatgtggttcttgcttttttgcccacactggtctcaaactcctggcctcaagatatcctccctcctcagcctcccaggtagctaggactacaggtgcacatcactgtgcccagttctgggtccttattttaataagaatcttttgtgattttacttaaaagcaaatagcagaatattcgccatgagatctctcttaactgttattttctgagggtctggctgggacctgtgaccgcctcatactgcacttctcagtggaatctggtaactccctgcatggtattgaagccacttctcttgtgtgaagggtgcatagatgttgtttatcctcaaggccagtgagtaaggggagcaggagccagagggctggtattggtgggctggatggctcttccctttaccattttcttctgttctggagtgtagcatagcactgagggcatttctttcatctgtttataaaataacatggcctttcaaggccatggtaaggataacaccttttatactcacccctttctcccctatcaagttcatgatttctttatgttgctcttcaatttaaagtgtactgaggtgaagaatttattcgctatcagaaatattaacctttttgtcaataacgcagtacccatgtgtcctttttaattgcttcattccttgcccacctcctttggctgtgagcagcttaaacagccaaagagcattgttttaccttttattttgctctcttctgagtacattttcaattttgtgaattgagagagtggcatagggaaaatgccattaatgaaatcctgcctataaaaatgatatattattcatatgatatatacagtgattgtgtttcatcctttccccgctaccaccagtaacttcagtccaaaatcctttcccctcagctccagaccttgtattaaaatgtggctgttattataatgaatttgctacaataagattctattccatggactaccttgtgaattaagaaccaaaaagtgaatgtaactggcatgcttttgagctgttacctatacctcacaccgcaccccccccccccccgcccccgcccagcacacacagtatttcccattatctggaacttcataggctatggctttattggtttgaaatgtatattttaactgcaaattggatgatctgcattataacttttattccgtagtatgctgataatatgtggtaaagtggccttgaaaaaggctctgtaaggagcatttgaattaaacactgacctgacgtgactacctgtgacatcttgggtattttctcagtactgtaggctgatattctggcaaaaagcaaattttaaatgaagcttcagttttctcagattatggaatgttttcacgagagaagttagctgtccttggggagaatgctgaccttggattccagaattctaagcatactagcttgatttttctcacatattcaagggtttgtaagttcagacccttacttttgtttgagacaaaattgtcttacatgtgttctatttttaacactttgaccaaaaataagctttttaggcagaatttaactacctcgtcacattatgggatgatcaagcaaaggcagttggatgaaccttgttctcaaggggcatcaggattcttcttttctcttggagcattggtaggcatgactaaagaagcactctgcccaacctttgctctgttccagaaaagagatgcagtttggatacagcttttgatacagtttgggtatttgtccctgcccaaatctcatgttaaattgtaatctccagggacctggtgggaggtgttggatcaaggtgtttggatctgtcatagctggtgctgtctttgtgatagtgagttcttatgagatctggtcatttaaaagtgtgtggcaccttcctcccccacccccccccaccccttctcttgctcttcgtcttaccgtgtgatatgtctgctcccacctttgccttgcaccatgattggaaatttcctgaggcctcctcagaagcaggtgctactatgctttctgtacagcctgcagaactgtgagccaattaaacctcttttcttataaattacccaatcccagatatttctttatagcaatgcaagaatggcctaatacagccttcttgtttcctcatcagtagagctgatggattaatgtttagagagtacctttgctagctttacttataaattattcacacacttaggtagactagaagtagagaactttaaaagtggttcatataataccatgtgaatggaaatgattacaagatcatctgagtggtgatctgcaccactgcactccagcctgtgtgacagagtgagaccctgtcttaaaaaaaaaaaaaaaagttatcctaaagctttactacgacatgtctaagtgtggatttctttttatttgccccatttggaatttgtcttcccaagtctgaaaatgatatttcatcccttctgaaaaacattcagccattatctctttcagcattgtctttcccatcattctctctgttctttctttgaaattcttggtagttaaatagtagactttctcagtttatcttgcatgtctcttaaattcttttgtggtttccacattttccataagatgaaaatatcttggtttttctaaagaatttcctcattttgactttctaggttactaattctcttttcagtagagtttaagtcaatatcactttaaatttctagaagtggtagaaattactacttttttcttgaacttctattttgatccttttcaaatctgcctaattatttttgagtgtctttttccttatctgtactcttctgttaacataaatatattttttaaattgcattttcgatcatttgagtattgcgttattatggatctgattacacaggtggtggttttgcttattcttgcccaagacggctcatttccttgtatacttttgtttttgtttttgtttttttaatttgtgagttcacattcctggagttttattgtgggaattctttgaagcctgtgtttagcttaccttccatgaggtaaaattttcatttatatttgcttctgccacctgcttagaggtactactaatacataacctcttaaatgtaaaagttttctgaaccatatacataacataatttctatacctaaacctctgccagcttttgattagaatttggagtggggtataggggctttttcttcttttcctccctgagcgaatgcttagactgagaaataccctctttccatggtgactttcttgatcactcttagggttggtcacttactagggttgttgccttttgcctgttccagctctgcgcagtctctgatctgagtcatctaccttgagaggaccctggccttggcccattaaaacccaagttctcatcatgaaatggtgcctccctgcaaaaccccccaccacccaccagaggaaacactgttttggctgattgcttacttctctgaagttctcctttctcttttctagcctctgacaatttctcttaatttttcacctgcctagctctgcattaaaaattgaaaaagcattattaaagcataatctgtataccataaaattaaccattttaagtgtacaattcagattttggtaagtttacagaactgtgcacccatcaccacaatctagttgtagaatttttctattatccatgcatacttcatttttcagtattgtaagatatcttatttctcctaataagatcaccaacacctttccctggaaattggaaaggtaggggcttatcatcatttcccctgtgggtttggaagtagttgttaaaaacttattgagtgcctctgaaatgttatgacctgcatttgggacttttactttatgtacgacaagtttgtaaaagttgagtttttgattttattgttatttttgacttttagacattcagatcattttaaagaagaaaactcgggtgctagcttggcccaggggcacaggggaagagatgaatgttttgaactctgttcctttgggctgctgctgcgttggtgggtcattatttagacttaaaagctccctgtcccacatctcttctcacttgcttactcctacaacaggtataaactgttatgagagtcagtcattaatttattatcaagaacaaaaagaaatcttatcttgtcttcctacaaacattccaggataagaggaactcagccaaataggaagccaggagcagttaaggaagtgggaaacaacttgtgttcgacttcagtaaatcataaatctatgtataatagagaaaaatagtcattatggttacagaaggagcaggattgaaataaagtcataatgggattttttcctaaatgaaacttcatttaacaaattttatgtaagtaaagatcatccatcgtggagtaaaggtagagccttcctaaaagactgaaaaagttgtctgtcatgtacagatgtctaatctgttgatctgacacaggggggctgtgagtcatttcctcaacagctcagatttgagcttgggttttcctgaaaccagcaaaacccaaggccgattgtttaaatgttttctgaaacctgctcttccgcaaggtccaaacttccacacagtaggcacagatggtacaaaagagggctgcctgatctcaaactagtggttgtggtgtcagtcttagcctacctcttcgaatagtgggaatcagagacattttagttgttaatacaagtaactgtggtaggaaagataataatttattctcctaacaaatccagagatacttctcactgttctacgaagtcttggctctgctgggttctctgtggaagttaactgctccaagtgtttttcttttctcttctcttctcttccgctcccctcccctcccctcttttctcttttctcttttttgagagagtctcgctctgttgtccaggctggagtgcagtggcgccatctcagctcacttcaacctccacctcctgagttcaagcaattctcatgcctcagcctcccaagcagctgggattacaggggcgtgccaccacgctgggccaatttttgtatttttagtagaggtgaggtttcactatgtggccaggggtgggtctcccaactcctggcctcaagcagtccgcccacctcggcctcccaaactgctggtattacaagcatgagccaccacacccagcctctttctttttttgggacatggtcttgcagtcatggcttgctgcagcctcgaccttctgggctcaagctattctcccaactcagccttccaattagctgggactataggtgcgtgccaccacacccagccaatgaaaaattttttaatgtatagagatggggtcttgctatgtagcccaggctggtcacaaactcctagcctcaagtgatcctcttgccttggactggaagccactgcacccagctcagagtgtttctcattctaacctcaggatcttctttagtctcattgttaatagttacgtcattctagagccccagattttccacagaaagaggcatttaggaagctcctctcctcgccctctcctttcactgtagtcaggcctgacactagtatgtgaggttagcctctcagagagctatggtcatgatgttgcatttgcacatttgtcattgttagaagtgagtagccctgtccctggggggtgaattgaagctcattcatctggagaagactgttagtgacaggcactccttcctcctcccaggcctcctgaaataggcagtgtgctcttgtagaacattactgcttcaacagtacaccagaaatattttaaagtaatgttttaaaataaagaacaagtcttccataacctttgttttgttagtgtttgtaatcatgaaacagaaaagatggtttaacagccatttcagccttagccacacactaccctcatgtgtctgatgtagagagtacttacgtaatcttttgcttcttttttaaaaatcttttgcttcttaatttaaatatttttctgagttttaaggattcataagattgagaatatagattgaaataagattgtgctagtagtgactgtcctggatccagcattcaagtggcctcctaaatgattggaataggcagggtgctgggcacctcaccagggatctttgttttttgtttttgtttttgagacggagtctcgctctgtcgcccaggctggagtgcagtggcgtgatctcggctcactgcaagctccgcctctcaggttcacgccattctcctgcctcagcctcccgagtagctgggactacaggcgcctgccaccacgcccggctaatttttttgtattttagtagagacggggtttcaccgtgttagccaggatggtctcgatctcctgacctcatgatccgcccgcctcggcctcccaaagtgctgggattacaggcatgagccaccgtgcccggtacaccagcgatctttgttagtcacaaaatgctaattttttcaatgatcatcatcagattttatgtttgttgttcaaaatgtcgtcttaaggcagtgaagcaatagaagttgtagattactcttcatgaacacatctaattcaagctttctccttcaatgaatatttgtttcctttttttttaagtcttacattttacaaaatttatcttaggtcatattttgcagtgattttttaagcaaacaaatagaaatccccagtcatctctgtagatttgtcatcctgaaaagaaatgtctctctgcttgggtccagatgacagagaaggtggaactgtaagtgtcagggagtataagtgttgcttctttatgtgactttgaaggactcataaacatcagagatctgactttccagttcctttacatttttatgtttaaattgcacgttaacttcttttgtttctccttgtgtttgggcattgcaggattctgatagttagcagtcttatagaaagctgataatccttaactgtagcactacaaacaactgccgtaatagtgtataatttttctgatgtgtttatgtgcttaagttgggcggaggagtgaaaatcaaaggttattgccattgcccttgtttactctagcatttaaattcccagaaagtgcctctgatattcaactgcctacgcctttatcattcataactcagtttgcaactggggtaaagatgtgtctcagtaccgtgtattcagttgggcccagatattgctaatggaattggcaagcctgttcatttagaaatatggataagtgatcacagccttagcagtcactacgcagtaacattccagagcttcagcaaaggaagtatgacacaacctggaaagattgttcctggccacgtgagctgtatcattgagatggctggacgggaaggtaaagatttcggttcaaattaagccgcatcagccaggagagattcaagctgtcagtgtttttgagaacccagttgaagggcagttttgcttttaactatgaaacataaccagtttccttttccacttttgatcatgattgcctttggtccatcttgatgttgtcttcatgttatttttttttgtttgaaaaattgtctggtgttcaaataaaattcatcttgccttaaattaagcatctattccctgtcaaatgagcatagcaccttagagttttttatttccttccttcaagaacactgcaaaacacatttttgaggataacaacagttctttcctgatgcccttgattcttcagcttttctcaccttattgcccatactagaagaacctttttctgaagttactgttcaggcgggttagaggccatgcaaagcatgtgagttacaggccctgggatctttcaaggttttgccaccaacctgcaatgtgatgtatgttatgagtctgtatagtttgctttgtgtagagttaaaaatgtgtcctcatctaagtaaataatcaggctgtgagaagggaggcacccttggtgcccttgtcatctgttccagaatggtcagaggtagggccaggtgtgtgttttttccttagcagtcaaaagagaaaaatctttaaagattattttttatgtttataggttgccaacttggcctgttccatctcaaataatgaagaaggtgtaaagcttgttcgaatgtctgcaagccagttagaagccctctgtcctcaggtaaagtacaactgacactggtgacagcataaccaaattaaattttgattcaagtggagatgaggtttattttgttaagttttgttttgtttttaggattttagatggaagtcttggggacagatcactgacacagaacccacatagtttggaatattttttgtttaacattaagtgacatttgcacgggagattacatgttactcctggcccttcattgaaaatgcacagtgggctgggcacggtggctcacgcctgtaatcgcagcactttgggatcccaaagtggatgggtcagttgagcccaggaatctgagaccagcctgggcaacatagcaaaacaccatctcttaaaaaaaaaatacatattttggccgggcacagtggctcacgtctgtaatcccagcactttgggaggccgaggcgggcggatcacgaggtcaggagatcgagaccatcctggctaaaacggtgaaaccccgtctctactaaaaaaaaaaaaaattaggtgggtgtggtggcaggtgcctgtagtgccagctactcgggaggctgaggcagcagaatggcgtgaacctgggaggcggagcttgcagtgagctgagatcgcaccactacactccagcctgggcgacagagcaagactccgtctcaaaaaaaaaaaaaaaaaaatacatacatacatacataaatacaaaaattagcccaacatgatggcgtgcacctgtagtcccagccactcaggaggctatggtgggaggctggcttgagcctgggaggcaaaggttgcagtgagccgagatcacaccactgcactccagccttggtgacagagtgagaccttgtcttggtgggttgaggaaggtatggtgccttccattgctggaaaatacagggtggcagtgaccacagtctccttgagggagagtctacaccctccttgagggccatttgtgacatctggccatcctggaaccatgagagttacctcacactattcacctatattcattttaatggtcagtatttgggtctctgtgttggaggaaaccaaattcacaagctagtctctttattctgtagtgtcataaagcagccttatgatacagatagtaacttaatttggccagcttctgaagtgaaagctcaagaacttgtctccatttataatagtatattggaagactgatgatgaagctgtgttacacatctggccctctagaaagactctgaagcacacatgacagcgaatgctttttaagtgcccagtgtgttgcctgcctcctgtgagaagagctgagtttgtttgtctggcttgacactccttgtcattccagggatttctaaggagtataagtgatgattcagtagaagaggtttcctctccactttcccatgtgtaaattgctcatggcatactctgaggacttacctctctttacatgtcctgccagaaggcagtggcctcaaataaaggagagtaagcagagggactggagaaatgaaatagaggtcataggaatgaagttgctatgttatgtctgcaaccaattttaaaatattctgtgactattatttggcttttttcatgtaaataatccctgacattcaaggtaggcaaccaaaataagtaaagcctctctcggtggttattaatctgtcattctcattgctacataggttagtagggcatttgttctaacacctaaccatgtggattaatttgccaatgagagttgctctgccttaatattactgtgatggacccattgtgaattcacatcatctgatagacattttcccagtgttagtccagtcctgaaatctgccagtcattgacagctgcatagatatttgcaatggatccaatcaccacatccagaaggatcttggatggccaagttgtatgagacagatttgaatttggattctttcttcaagtttgtttgccatttaccctatcagcactttgtttttaatgtctttggttttccatttggtcttgaaatgcttgaaaagcgacaatgctttcacaaatctgtggaaacagatggtagcatacactgatcacacctaccaagagtatttatataaatgatcttaaaacccaggaaaaaaatcacacggagagtctagtagatcctaatgaaaatgatggtgtgcataacctgtgtggccaagccatgtcacatgggtttgagttagccatcagaaagcaatgtgtcttcctctcccttgcagtttcatttttcctactaaaacagatttcaagaggaataggctttaggcagacagtgcccagaccacacttggtactgggtatgtgtcctgaaaaaaaccatgttttttcaagtgtgattattcttcagattctcacctgggctcattgctactcttgctcacaaactgctatgcacacaggactgggcaggttcagtaatggcaaataaagtaggtgtttacagacatggtcacagcaaactgggcatcatgtgcttgattttcagtaaggcagctttgacttcaccccagccccgttattgccagatcccttcctcctcctccttctttcttgtttcttcttcttttttctttttttgagatggagtctgactctgtcacccaggctggagtgcagtagcatgatctctgctcactgcagcctctgcctcccaggttcaagtgattctcctgctgcagcctcccaaatagctggaattacaggcatgtgccaccatgcccagctaatttttgtatttctggtagagacggggtttcaccatgttgcccatgctggtcttgaactcctggcctcaagtgatgcctgctttggcctccaaaagtgctgggattacaggcctgagccaccacgcccggccccctacattattttaaacaaaaattctgcaattcagatttttctgtcatgtctcaattttaaacaattggtaactaatttaaagtttttgaaatctttgaggaggataactcaaactcttctgtgtgctgcctctggcctgctgtggcccgtgtgtttcatgctcagaggatctctccttcaaggaagcgaagggctgtccctcggaggaagagggccttgattgtggagacctctgcctcctctcttgtgggcagtgatcacaagcaccacggatcctgattttgaggtattcccttccaaggtctaggcaagttaatcaacatgttaggtaactagggtagttagttaattcactaggagcttaatttggtgttttaatatgctgcagcatgtagccaaacatttattattttaaagtgtgtgtttctttatagtaaggctactgttgacctctcttcacagtgtggaagaggtgctcagtgcttctaggatgtattttagtgttttatgcctcatgcccaggctgctgtacataggcagcactacagtttggagttggctcctatatgctatttttagtttctggtggggagaaatgacaggtgggaccattagaggagttttcatccccatgccccccatccgcccttttttttttcttcttcttcttcttcgagacagagtctcgctctgtcacccaggctggagtgcagtggtgcaatctcggctcactgcaacctccgcctccagggttcaagcaattctcctgtcccagcctcccaagtagccaggactacaggtgcctgccaccacgcccggctaatttttgtattttttagtagagatggggtttcaccttgttggtcaggctgatcccaccctccttggcctcccaaagtgctgggattacaggcatgagtcactgtgcccggcctttcatccccattttaaagtttgccctatagcaaattaacttttgagagacataggaaaatccattctacagtactcactttttagcagttaaacaactttaactggaaacatttgagatagtaaagttgagttcaggccctgtgctcacatctgtaatcccagcattttcagaggtcaaggtcgggggatcatttgaagccagtatttcaagaccagcctgggcaacagagcgagaccccatctcctaaaataaaagaattggctgggcatgatggcgtgcacttgtagtcccagctactcaggaggctgaagcaggaggatcgcttgagcgcaggagttccaggctgcagtgagctgtgattataccactgcactccagcctgggcgacagagtatgacccctttgaccccttctctaaatataacatcaagttgaggaagaagtaatctaaaagtggctatattttgttgggagaaggaacccacattttttggcgatttgttatcattaagaaaagaggaggtaggtcggctctctctctgcattgccttctacttgatggctactttctctcactcttttctctggaaagggacctgcctccatccgagcagagcgccccggtctcacaaacttttacgaggaagcagtttacaaattggtttgggaagagaccagaatctgtaccctttgtatcccaggcattatgttttgcttgtgaatgtgcccgttttagtctatagtagctgctttaaatattttaatttttaaattcaaaaccatttggtgtgctggtcaggaagaagaaacaaaaacacaaaaaccccaaaccttgcaaacagcagcaggtttctgacattttgagtctttaaaatcagaggagggcattttggagattatctcactcaatattttttcttagttcattatgcaagaatgagcattacacattcgtattaacattaagttaatacaaatctggcacttaaataatttataatgcctggtttaatgcatggcttttcttggaaatttacacaaaggatgaattaagtatatgaagcctctacttatctacatttttttctttcctccccccccaccctttttttttttaagagacaggttttcactctgttacccaggctagagtgcagtggtgccatcatgaatcactgcagccttgacctcctaggtttaagcagtccttgcacctcagcctctgagtagctgggaccacaggtggactccaccacacttggctaatttttaaaattttttgtttgcccaggctggtctcaaactcctgaggtcaggtgatcctcccacctgagcctcccaaagtgctgggatttcagcctgtgagccactgtcccaggtctcttttttcttttggtatttctcactcactaaattgagaagttacttctgaaattgttcattcttccttctgcctccctagatttatcttccatattgcttcttctgtcattgtgcttatgggaaccctgatcatatttgtggctgacatgcttgacacacatcaaataagcataaactcaggctggcctggcccctagctctaggtgggaaaatacatggcccttaaaggagcaccccatacatacaggacggggcagacctgtggcttcagctgtcacttaacctattatttcacaatcatgggaccatctgtctttgaatcgcttcacttttccactttggtattctctaatctggttttttacaaagcagtttcacagagaactcaagggagatgcttcttactaaaagtttctctgagcattttctgtatcctcccatctctacccttctgtgcctcccacccctccttgactgaggtctacaggtaacagccccacagaggtgctgtgctcttttcataaggcttgcctgttgctttgctgatttctgtatcttaaaattggaaagtgtttcctacttttctttttttttttttttttttttttttttggaaaaatctgtgtatatttggtattagttctttgtatgtttgggagaatttaccagtgaagcctggtaactgttaaactctagctgggcctggaatttgctttgtgggaaggtttttaatgatgactgcagtttctttaatagacagggatatttagggtttttttaattcttgagtgagctttggtaatttgtctttcattaattttctactctttgttttcttccttctgcttgctttgggtttaatttgctccttttctagttttaaaattggaagctttaactcattgccttgagaccttccttcctccttttctaaggtaacatttaaacattttaatactataaatttccctcgaagcactgttttagctgccccacagatttttattatgatgtgttaaatatggttaggatgggcaggaaggactcactgagaaagtgatgtataaacaaagacctgaaggaaatgacagagcaaaccacggaggatgtctcaggggagagagctccaggcagagagaacagcaagtgcaaaagcttggaggaaggagatcagatatctaaaacaagtttagggactgcagggcctttggaggccttggtcgtaggcctttggcttttaatttgagatgggaaaccattgaagggttttgagtagaagagtgacatgagcttacttaggttgtaacaagatctcggccatgcgcagtgccttacacctataatcccagcactttgggaggccaagacacagtgactacttgagcccaggaattctagaacagcctgagcaacatagtgagaccctgtatctataaaaataaaaaatttgccaggcatggtggtgcaaggctacagtcctggctacatggaaggccgaggtgggaggattgcttgaatccagaggtcgagggtatagtgagccatgattgtgcccctgcactccagcctgggtgacagagtgagaccctgtctcaaaaacaaaaaaccaagatctctctgacttctgtgaagagggaaagaagcagagaggctctttaggaaattgcagtacacagaataatggcctcccaaacatgtcaatttcctaattccctaagcccaggaatgtatcacctcacatggcaaaggggactctgcagggatgaataaattaaggatctttagatggaaagattatcctagattatcccagtggacccccccccaatataatcataagtgtccttatatgagggaggcaggggcatcagaggcagagaagaaaatacagtgatggaagcagaggctggccacaagtcaagtaatgtgggcagcctcaggaatttggagaagttaagggctggctttttcactagaacctccagaaggaacacagatttgatgataatgttgttgattttagctctgtaagacccatttcagaattctgatgtccagaaactgtaagataatagatttgtgttgttttaagccactacatttgtggtaatttattacagaagcaatagtagactaaaacagatggtattgtactaatccaggcaagagtacagtggatatggtgagcactggttagagtctggatatattttgaaggtgaactttactgaaggattagatgtgaggtgagagagaaaaagagtcagggaatataacacagtttggagcctaagcagctggaaggacggagttcccatttattttggtaaggaaagatggtttggggaaagagataagttttggacatgttatttttgaggtgcctattagacatgcaagatgcatgtcatgttgagggcagaggtctgaacaggatgtgtaaatgtgagacatcaccaagggagtgagtctacgtgaaggaaagatctgggagtggaactggggtccctaacattgagagtttcaggaggtgagcagtggccagcacaggagcctgaggaagcactgtcaggaccagagccccggaagctgactgtgtcttagaagccaagtgaaagaaaaaaaagcgggggagtttctaggaaaagattagatgagattgcccaggggtgggaagagtagaaagaggagagaaggcagcataggactgagctttgaggaaatcccaacaccttagaagaagatgagagagcaaaggagacaaagacaaaatagccagaatgatggaaacaaaacggaaatagtgtttgagaaaatccaacatccattcctgatagaacactttacaaactaggaaaaggagggaacttccttagcctgataaagaatctccatgaacagttgatagctaacattatacttaatggtaaaaactgaatgctttccctgtatgatcagaaataggacaaggacgtccacccttgccacccttatgtcacactgtactggggctcaagccaacaacagcattttaaaagttacgatcagtacagtgatcgtgcctagttgggggctccttgcaaatttaatagtaacatgaatttccatttttaaaattatataagtaagagtaaactccccccaaccaatagctgttttctcatcatttacactttaccttaagtaagtggtccattcctgtccctgtttttctactgctgttttggtgttttccttattgatttacctaatactgtatatttaatctgtaatatatatttaaatacagacatacataattgaatttataggttgacgtctcccattgttattttgaaatagagttttctaagacataaatattgtgactaatggtgacttagtatatatggcgacttagtatataactgaagtgacttttttttttttaactttcgttcagtttttttttgtttgtttttgttttttaactttcattcagtttcgttgaaactgttcgtttctttacagatttaacctttacatatttcgtttgaaatgctttgtgagagatctgaccctcccttcattttgtattctgttttttttcctggcatatagaaaggctgttggtttttactattttatattgtctttagttacattaatgaacttttattctaagagttttttcaggccaggtgctgtggctcacatcactcactaatcccagcaccttgaccacctgaggttgggagttccagaccagcctgaccaatatggtgaaacctcatctctactaaaaatacaaaaattagccaggtgtggtggcacacacctgtaatcccagctactcaggaggctgaagtgggagaatcacttgaacccgggaggcggaggttgcagtgagctgagattatgccactgcactccagcctgggcgatagagggagaccctgtctcaaaaaaaaaaaaaaaattcagttgatgtacttcaattttctgtgtaatttgcattggagtatgtgatttttctcatttttctaacagtttttcctattattttcatttctcaccttatttctttggctagaaagtccattatattattatttaaccaatggtgacagtaagtattccaattaataacatcttgattttttaaggtaaatgattttatagtttcacagctcagtgtcatgttggatgattaaagtagcatgttaaggacatatctatatatttttttaaagacagggtctcatggttactcaggctggagtgcagtggcatgatcatggcttactgcagccttggcatcctgggtttaggcaatccccccacctcggcctcccagagtgctgggattacaggcgtgagccactgtgctcagccaggacacctctttctattccaaatttagtaagagtaatcagaaatgagtatttaatattatcagctgtcttttgtacacaattttgtaatcaaaatgagaaaactaaccttaggcaaggtgcttcccctcattatactgtatgcgatatattacaaagaaagcatttttccctttgtagtgaaaaataagtaaaacgtgtgattaattccctgcccatgtttacttggctctcttcggaaacattttcactagccaaatattcttacagtgtatagctccactctgatacatggatacattattgaattaatgagttaattaatgaagaaagtggtcttacaatggtgaacacatgtagtggataaggaatgacaggaaggaataagtcttttggatgaaagtgtgggagaccacagcataacgtgagaaaaacaaggatctcttcttccaaattattgcctaaacccaggcacttatggaagtgttgggctattaatagttcataaactgggatggcttagttccctgtgcctgtgaatctataattgacagtctgataatctaccagttctaagtattaaggagggaagaggaatagcggcaccaatctagtgggcctgagtcgtctttagtctgttttcacctccagcctttggagggctaagttacaacattcttgaatacccctccaataaattgggaattacacccatgatccaaagcatctgaaaaatcaccccagactcctccactcagggctgcccccacactcctgcctcatccaggtccagcagtttcctcttgtctttgcttccttcccaagttgcatgattataaacacatttactgggccgggcgcagtggctcctgcctgtaatcccagcactttgggaggccgaggcgggtggatcacaaggtcaggagatcgagaccatcctggctaacacgataaaaccccatctctaccaaaaatacaaaaaactagccagatgtggtggcgggcgcctgtagtcccagttattcgggaggctgaggcagaagaatcacttcaacctgggaggtggaggttgcagtgagctgacattgcgccactgcactccagcctgggcaacagagggacactctgtctctaaaataaaataaaataaaataaatacatttacttctaataacccataagcaccttgtacctaggaatcctactaattatcctctcagcgcattttcatactactctcattattcacttattcaatgaatacagccgaaggatctgaatagacatctcttcaaagaatataaacaaatggacaataaacatatgaacggtacctgacatcatcagctatcaggatggtggtcacttcagatccactagcatggctagaattaaccaaaaagggggaaaataacaagtgttagggaagatgtagggcactgtaaccctcatacacactggtgggatgtaaaatggtacagccactttagaaaaaggtaaagcagcttctcaaaagtttaagcacaaagtttactatatttcccagcagttctactccgttcccagagaagtaaaaacacagaaacgtgtatgagcgttcatagcaacatgattcataatagtcaaagagtggcaataattcaaatgttcattaactgatgaatggctaagtaaaatgtggcatggtaatataacagaatcttattcatcaacaaaagggaacaaagtactggtacatgctacacatgagtgaactttgaaaacattatgttaggccaggagcagtggctcatgcctgtaatccgagcactttgggaggtggtcaggagttcaagaccagtgtggccagcatggtgaaaacccgtctctactaaaaatacaaaaattagcctggcgtggtggcacacacctgtaatcccagctacttgggaggctaagacacaagaatcgcttgagcctgggagagggaggttgcagtgagctgagatcgcgccactgctctccagcctgggcgacagagaaagactcagtctcaaaaagaaacacacacacacactaagtgaaaaaagcaagttacaaaagtccacatgttacatgattccatttatctgaaatatccagaatagacaaatccatagagatagaaagcaaattagtggttgcaaaaaaaaaaaaaagaaggggctaaggagagttaatgggaaatggctgctaatggatatggatggggtttctttttggagtgatgaaaatgttctaaaactgaatgtggtgaatgttgaacaactgcaaatatactttaaaaaaccaatgacattgtgtcctttaaatgggtgaattgtagataggtgaattttatctcaataaagctgttttttgtctttttttttttttttggagacaagagtcgtcctgtttgtccaggctggtctcgaactcctgggctcaagcagtcctcctgcctcagcctcccaaagtgctgggattacgagctcgagccaccacgcccagcttgtttgtctttttgaggtggagtctcactgtgttgcccaagctggagtgcagtggtgtgatcacagctcactgcacccttgacctcctgggctcaagcagtgttcccactttggcctctcaagtagctgggactacaggtgtgtgccaccatgcccagctcattttctttattgtttatagagatggggtctcactatgttatccaggctttaaaattaatatttatttatttttatttattattttatttattttttttttgagacaacaagtttcactcttgttgcccaggctggagtgcagtggcatgatctcagctcatcacagcctccacctcctgggttcaagtgattctcctgcctcagcctcctgagtagctggaattacaggcgtgtgccaccacacccggccaattttgtatttttagtagagacggggtttcaccatgttggtcaggctggtctcgaactccagacctcaggtgatttgaccgccttggcctcccaagtgttgggattacaggcgtgagccaccacacctggcctaaaattatttttaaaccttaatagattatacattttttgagcagttttttgtttgtcaaatatgactccattaaaaagaaaatgaaaaatacttatgcttagatgcaatgtatttttcatgaatacattttgataatgtatcgagaacctgaaatgccacatttttatcacaagatatttgtagtgatggataaccagaacaacccagacatcctacaataggagaataacagtgtgtccataacatagaatatatacttagtgttttaaacatatatttaatgatatggagaagcatttaaagtaagaatcagtatagtccattttaagtggcatataattctaattgtgtattttttgatgtggctatatatgtgtctatatgaggagaaaaaagtctagaatttagtgtcactgaaaatggtaggcttgccaccatgaatgaagctagtacagtttttatttgttttatcattgtctatagtttgcaaataaaatatgtattaattcaacttcaccatataaaacttactgttttacactcttccccttcatctttgtgatagttaggatagagcatgtggtgtgatgtctcctagtgaaatgcatgtaagacaaagccatgactctgaaaaagagtaaacagtgaagtttaatatcttttgcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcaggtaatgagctggttccccagagaagtatgtgaagatgttcataattacttttgtctaagttgtattaatgggcaaacactgctatgtcttggcaggtaaattattctaacaataatattgtgctggttttcattttaatgttaaaaaagctatcagctacagggttttcaagtgacagcttctcagctactaggaagtagctggggttggagatgtttcccttgatagggctggtctgaatcctaggagcatgaattagaaacctggctggcaaaggcttatccctgcttgtatagagtgaggtctttcaactgggaccggtagaacaccaggaccatccatccctcttgctgccattgtgtttagaaaaaacattgatctgtgtcttggtggagactgtggttatttgttatcagcctatgaaacttaggagaagaagggattctcaacaccatcacctttagtttcttttttaaaataatttcttcccttcttggaaagcctctcttctgtctctcagaaatgatcatagtcatagtttatctgcctacttttccaaagactttctgtctgcatgatgcacagatagaaaacagagaggaaatatttaagtgccatttaattatgaacttgaaaaaataaatctgggtaattcacctcacaaaaacagttgatttcattatataaacataaactggtaatgacttagtaaattgcattcatatagaaaatatctgtcaaatgcaattcagtgtttatcacacagagataaatttcaatcccatcttcttagagttgagtaactataaatgcattctccatttaacgggacctctgttgcccttggctgcatggcttgctctctgaaagtgccagacttcctgaggccagtggctgtgggcagaatcagtggctaagtttttgtagggctgaaactacctgtcaccccagggaaccacgggctagaacgtggcagtagggcttgaaacagaagcggggcttaagtacatgcacagcacagtcctccagcagtgacctatataagggtgactgtgtgttctgcataccaatgcctccctgtcttcacactctctccttaggatgggtagccttggcttaacttgagaaactggggagcaagccatctgtaaactgcaaaaagtagggggtaaaccatgttgctgcaggactgccaaattgcaggtgttggtactttaaaacaaaaatctcatttgcaagcacatctttgcaggtgccagaaatgcagcaatggcttttttgggaaatcttggccttctgttgtttttcccaatgaagtactgaattattctttttcattggtttagagaaaaacattccaccttcacagcacacttttaagcaaacaacaaattctgaaatctaaatgcaaagcccccctccggataaatactacattcttaaagttacttttttgagattaggttgggtatgtctcaggcttggtctcaagggattttcagtcctccttacagccaaataaaatgtaacagcatcagatgtccctcatgcaccattcgtcaaatcagtgaagaaaagggattctgcagcagcatttagtggattctaggcaatatctttagggcatatgacataaaagaatggaaaagagaaatcaaattcttttaacagatacactgttgtctggtgagtgtgttcagtttttatgcaaatgtatgagagtataagagggattgatttgatggaaaggagtttagacagtttctatttagcaaataaaatcatggaacaattctttcagtcaaaggtggtggtgttttcagagcatctgaattttagaagtctacctggtgtgtttttctgatgttctgtcacagccctgcttaggaatgttacgtaattaaatcattaatagggcaaggcctttcttcataactcctctgatttatgtaatatgcggagacaagcagatgcctgtgcaggtttctactgggatgaccagttaattttcagcattcagactcctttatgttcttacgtacatcccttacccatggtagctttggcaattttttttttttttttttttttttttgagacggagctttgctcttgttgcctaggctggagtgcaatggtgggatctcggctcactgcaacctctgcctctcagtagttcaagcaattctcctgcctcagcctcccgagtagctgggattacaggtgcttgccaccatgcctggctaattttttgtatttttaggagagacaaggtttcaccatgttggccaggcttgtctcaaactcctgacctcaggtgatccacccgcttcagcctcccaaagtgctaggattacaggcatgagccaccgtgcccggtctaggtgtcacactttttatttcgggggactagagatatttccccatcgctcctgacacacagcctaggcaggtgtcatctgcagcagtcacgggcagtatttagatgggaagccacatcttggccctgacgtggccctgccacatttgccagtgtcccctggccctaaagcatagcggtgctttggtggacccatagtgagatgggcttgtttttgagtaggggctgcctggcaagtgcccagcacaggatctggcttttgaggtaggtgggcttcatagcttttactaaatgaacagcagggatgcaccctgacttcttggagtggttgttttctactgtctcctggggcttgaggccctttggtacagagtgagaggttttatgtagtatttgcatttgtgattttccaccatcaaattctcttacactccatggggcctggatattggctatagcactgtccagtcactgagaacctgtccaagaggaaatcgtttatggagtagggcttcagctcctttgttctggatattctgccccattggctccagaaattccctcatacttagaacaagtcatgtcctgatttgtggctcaaaaagtaatggtcatcttgtgtataacctggtgcagccaccaagaccccgatgccagcattttatgaggctgtagggcggggggaactttgatcattgtcaaatatgtgacagtcgcacttgcatagaaaaagaggaatatgcatgataacctccagggaggaggggtagggtctcctcacccccaagctattctatcccaaatgctgccttgtaaatattggagatggtttaagatgctggcattcagcagaccaagaatatatttatattgaccaatcccttaaggagagtggtttgaaattcatcaaagtgataaagactctttgaatttcacttggattgtatttgataaacgttttccacggaaatgttattgatttccattctctgtgcttacatgttgcagttttggctcccttttttttgaagatgcaagtggttgcttagagaagctctaattgggtttattaaattttttactaaatgctcttagaaacaatatatatgcattaaatgctttggagcaacacttggagtggtaatttgtactttccttcattaagtgtcagtgtccaaagaatttggtctgattgggaggtcattaaatacctaattattattgtacctaaatgttggttttgtgtttaatagcagaaatgctaaactatagacagtttctctctttggaggaagtggtgaagttagattagtggtgatttttttttttttttttttttttgagatggagtcttgctctgtcaccaggctggaatgcagtggcatgatctcggctcactgcagtctctgcctcccaggttcaagcgattctcctgcctgagcctcctgagtagctgggattacaggtgcctgtcaccacacccacctaatttctgtatttttagtagagacggggtttcaccatgttggccaggatggtcccgatctcctgacctcgtgatctgcccgccctcagccttccaaagtgctgggattacaggcatgagccaccatgtaatcaaaaatcacccggccggtgatttttttttttttaagcctactatatagtttacatggcaagccatcagaatagttcatgtcacagggtaaatcctctacataaagtatgaaacattgttttcattttctttgtgtgcagcagccctgcatacgctgcatgccataaagatacccagggcagagggtacaaagaagaggctctattgctacacgttgtagactgacattctgacatcttttatggagaatgccagttggcatggttcctggggggcaattaggtaccatacttctactttaaacatatatgctttttaactcgtgatctaactgctagacattttctctaggggagtgtcacaaatatttgccaaaatacctgtataaggatgttttcttcaaccagaatgtctaaggaaagactgaataagtgaattatagcccctccatctattcagtagggtactatgcagccattaaaatggatgaggtagatctgtagggccagacctagaaaggttttcaagtgaaaaagatacaatagtgtccataatataattccttttatattcatttacatatagttgtctgtattttgtatggactgttatatgtatgtgtatgaatttttttctattagaagcacacctataaataatgtattgaacagttgttcatgggtacagattgttgtgtctactcatagtggacctatgctgtttccttagctaaaatgatgtatggtttcagttaagtgtgggcagagcctgtccccctctgttgaacagtggactcgcacctccccccatcaggttcagttgtggagagcaggctgggtgctctgtcctgggtgtgtggtagcctcagcgaggctggggctttcctagagacaagtgtttcatgagggtagagaatattactttggtcagcttcctgaagtggggaatattactctaaaaaatggcacactctttcctggtttaggttcatctagaaggcggccaggatgaattcaagaaagtctaaatggattaaaaaaaaaaaaaaccgtagaagtatctagacaaaggttaaaaaatccttggtggaagtttgggtcacttttgaacggaaaggaatgccatacttcattgattctgaaatagggatgagtcttaaaatcaatgatatgagaaaacactggttcttagttttgctatcaacatgatttctttcaattgtattcctttcctttccttagcaatgcaagtttcatcttaacggtattgtgttagatccagtaaagcagcagtttttaacccaagacctcgtatggtagtcctgctcagtacatttgtttagcttgaattattagagtttatatattttaaaaatgcttgtgatgggctccaaatccatttattcttgtaattggtttaaatatccctcttaaaatgtgtttatgttagaagtttaatatgtttactcttttcattagttcagtggtataaaccctggcaagtctcataatttgtaattaatagagaccaaaatatggtcttaactatattgcagtaatctagttttcccttctctaataagaattcttactgtttcctggccttccctggaaaggtgttttttgtttgttttggcttttgtttttgagacagagtctcactctgttgcccaggctggaatgcagtggcgcgatcttggctcactgcaacctctgcctcctgggttcaagccatcctcccgcctcagcctctagatctgtatcatccactttaatggctgcatagttcccataattcatttatccacccttctcttggagattttggttgctttcacgttgttactacagatgagttcgagcaaaccctttgtggtggggttcctaaaaatttatagtgtcaggctttttgctttgaggaaaaatagttttggtgtgttgcccaaattcagctgtatgactgttaggagccacccatcagcttcataggagtcaggggttttcacctctagggacccttcaaatatcacaataagcccatctgtgtaccatgaagagggttattaaatagttcatctcacacctcagggtcctctagaggaggcttcaacctgctttccagcaccttctcctatcccagggctgtactggcttcttggtagattgtctgaatatcatcagcatctcctggaaggagagggagaggggacagtggacttttgttctaatttagcctttcctttatttgggacatagagtcagtgaagctagaggaagataagttattgatgcttctatgataattttctgccagaaaattacagaacagctgtgtctcaaagatgggcatgtctcctgttttttttgtgtgtgttttttattttttgtttttttttttttaaaaacctggaatgaagattgttattcttgggggtgataacaggtttagtttctgtctctgtcactagtcactggtctctccaatgaagtatatgtaaaactttcagcactgtggctggcaccaagcaaacaataaatgatagatgccagcttacagttgccaccttttcatagaaagcctccttcctcattcaactttttgcttgttctccagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacaggtacgggaactctccctttccagtgctcgcacacaccgcagcctcagtgaggcaggccaccccattagcccagccctgtggtgaggaaggaggagttgggaactcagatttggtctcatggcacatcgggctcctgagaagctggtcatagccaaattcaggcctcacaagcatattttcttcatctgtatctcatgagtaatcacgggactaattctaaacacacgatttaagatgaatttctgagttaaatctcctattagtgagtaaagactaaattaaggtaggtcccattcttaagcaaggcttcaagttagtctcacttcaagttctcaaccatccaatctctgttgcagagaaaaagatgatttgagtcgtaaaatactgcatttaatttatttcaactgtaaatacccttcacacaggtagaagcagaggctcatcataagcctcacctctttctgtctagctgagtgattcagggagggccaggggaatgatgctgcctgctgaccagggtatctactgtgcctctttctccacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataagggtgagtaactgcatttcagacgtcttaacagcttctttcttatcatttgctaaacttgagcaatgcgtcattctagaactcggcagatgcggtggcagtatattaaaaccatgaatctaaaagctgttagaatgagatatatttaattacgttgtctaaaatgactgttagttgcaagttagagcccaaacttgggccaagaaggggagctagcctgagttgacgatttaatttaggataaacagtctctacaacatgaggcttcagtttgagttaggcaggaaattatagaaaataatggttctcaagctagtatcagagaaggaagtattttcataatgcggattcaagttattgttcacatgaagtgcccctctcttcggaggggctgcaggcagacgggatgatggaaccccagggtgttggggggaggagcggccccaggtgatgctcctaggctcatggccaagtgccgagcccctttccccatagccagagtgcctggagggcctctgtcgcaggggcagaggagaaaggggcctctatggcatctgtgattgagctcccggcataccgtcctgctctctgacaactattcctgtcttcattcaagaatcatccagcccctgggcctctcagtttcttgatgtcttgtcctcctccacctcaacctcacggccatagctgtacctcagcttttgtcactgcctgccattgtctttgtcatccccagcagcctagatctattgttcaggttgcgccctcgagtcctgcaactcccagcgagcctttgagtctactgtggggtcttcagtcagttggtcctccccatgtgtcactcagccccttgtgtccttggttcagtcctttgttagctttgagtccatagttgaatatactcactcctctgccctgctgtttcctcacacctgccttgcaaggtgcagtcctggcaagatcctgctctcctgagcacagtgcagatggccacagccacgctgatggagccgcagaagccgcggccatttgtgcgcccttgctgccctgcaacaggcgtccacccacccacccacacctgtgcccctgtcctgtttggcccacttgccgatttcgttgaggatactgaggcagttagtgcgtccacccctctgcatcccatgtctgtgtgctctaccttcctcctagcaccatgggcattgctctcggtgcttctggccaaggccatcccttgcacgtctttgtactaggatcccagcttcttcaccccctgcctcctgtacctttccccaagcctatgatgatttctcccatttttagggggaaaaaaaaagtctcttgacccacaccccttctcagtctccttggctggtttctccccatctcctcagcctgtgaaacacgggtgtggcctgctgggaagtccttgacctcttcagagtcctgtctagaggccgactctcctaagttccacacctgtctgcgcaccttgcctcctccctctcacttgctccacccaggcagcacatgttagttgatagtgactccgtcttcccttgctcgggcccagacctcgaatcttttatttcccttttgtcccatacctcacatctgctttatctgtgaattcttttggctctccgttcacagtagagaacctgaacatgttctcaccctcgtctaagccaccagcacctctcacccgggttcatgcaggtgccactcagctggttccctgttcccatcctgggtgcctacagtctcatgagccacagggcagccagagcgatttctgtaagcttcaatcagatcatgttatcctctgtgccagcgtctccacaggccgccacgtcactcattctttatgctggcctacgaggccttctgggactggaacctgtcacttctccaaccttatttcctgctgatctcctcttgtactcatggggttccaggcaagccggtgacatgggggcagtgagctaagccccccttctgtggcctccttgctattcacgcagttccctgggccaatgccccttccccacggcctctatgctgccacccgcccccccttccccctccttgagagcaccttctcgtgagacttttccaaacacccatatagaattaaaatctccctttattcatcactgctttcttcatagcactggtcacttttgatgtgtcatataattcatttgcttactttgttgtcatttcttccattagaatatgcgagaggaatttttgtctgtttgtcactttgtatctttagggcccagaacagtgcttggcagagagataatgaatgaatgaatgaatgaatgaatgaatgaatgagagtactcggttttcttggcaagaacggttcttgggtctgcgatggggtgctggggaggtagagatgatgttaggaggtggtcctttgaaaagccccttaactgattgattgcatgccagtcccgaaggcatgtgtgactgcagcgttaaaactgtcagtgctggcattgtgttttgtgccaccgagtccatcggcctccaggacctcacaccgacatgctgtctggtcccctgcgtgagcgtccactgttctcacctcatcaagggacaggcccagcctttgcacagcacgttcttggtggttccagaatgtttcttgcatatcttcttgtttgaacctcactgcaagtccttgggctgggcttggactatgtcctggtacacagacgagagactcgcctcactgccctcctgtcacaggccagccggctgggctgagcgccaaccccagctgttctgcctgctgcccccttactgataactgccagaggacaacattatgtttcaagtcagtagctaatcatgagaggctggtagttggtacaaaataagaattttatttcataattaaagcaaagagctaggaccagtaatcagtcccttgggtatttactcagccctcacctgccatattctcccctcttttcttttgatgaaagtcaaaagaatactttaaaatacattgcctatttttactcctccaagcagccttggtaccctaacagaaggcccagttatttaattttctttttgtcataaagtaggaaagttatacaaatccgcttaatactatacaaaacacctctatttttaagtcagtaccttttctacccaggacagttctcatctttgtcttaaaatgccggtgttggggaagtaaattaggaagtaaaaaccttatgtcactgggcacaagtggctcacgcctgtaatctcagcactttgggaggccagggcaggcagatcacctgaggtcaggagttcaagaccagcctgaccaacatggtgaaaccccgtctctactaaaaatacaaaaattagccgggcatggtggcatgttgcctctaatcccagccacttgggaggctgaggcaggtgaatctcttgaacccgggaggcggaggttgcattgattccaagatcacgccactgcactccagcctgggtgacagagcgagactctgtctcaaaggaaaaaaaaaaacaatcatgtcttacaaagaaatagtgaattgactcagtgatagcaattgagccccacacacagtgaaaccagcccaggcctgctgtgggccaggcagcccagcgtgtgcaccagtgaagcagaggctcgagacaaatgctgagtgattttgactttattcaccatactgttcagaacactgcacattaaaatccagaattctgggcctccgtgcacctggccaagaggctcagggtggctgggggctggtggcccagagatgtgtctgacctgtgatctttgtctgggtggcagacccctgaggagttggatgactctgactttgagacagaagattttgatgtcagaagcaggacgagcgtccagacagaagacgatcagctgatagctggccagagtgcccgggtaaggaagcgctccgtggggcagttcagcttgtgctgccgactttccctgtcccctttcttgtttccaggaaaacaccctcagtattcagaacaccgtttctctctctctgtctctctggcagtagactgaagttaaactaagttgtggcacctgctagtcaaatgtagcctcctcagctagaggcagaccaggtcctgggcctcctctgcagtgccctgagctttagtttatgatagagccctgggtcagggaagggctaagatttagtcaatgcagtgtttgttgaaaggatcgtgaaatttgaaaaagattgctgcctttgtccatctcgatactatgggtatgaactatttaattattcatgggtttaaaaaataacagtggtacattcaagaaagccagtcagagccattgcattcatttgagtcattaaatcttcaatcaatagcatttatgttttggggaggatgccaagaaatatttctaaggagtctttgatttcactccttggaaatctgtcgtgaacagcgagcacatccctgccttatgtcctgctcagtcatgagcacttagggaagctgagagggaggagctccccagccgtaggtctgtgggctggaggtgggcagcaggcctccaggtgttgctcaagtatggcctgagtgccagcggtatctctcagccctctttcttcaggtgtacattctaaagccactttcagttcatcttgaatagttggaaatgtccatcagggcccaccagggaaagggctccacactttcatcaaccccttctctcatttcttgtcttatattaataagaattaagcaggttctgtccctgcacaggtgtgattccaaagcttccacattagccttccacccctcgctgtttccttccacactaaaacttgtgctcaaaagtgggtcggaaattcaggctgccataagtttctgcaaaaaatgagagaaatagcccttcaggcgaaatgaaacctattaaagcattatcctacctatgccacagattgcctgttggaaatattcttggctaatgcactctgagaacttcatattctttttatgtaagagctctttgtgcttctgatcacaggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccggtgagcagcaccccggccccaccaggctgcacaggggctactttcttccccacaggtcacctgcgcagcggctcagacagcccaggccatggggctttgtggacaatcttctttttctactccaactgtgaggggcttcacatacaataatccttgttctcttccctcttctcagaggtaaaggaccactcaaaaatacatcggatgtcatcagtgctgccaagaaaattgctgaggcaggatccaggatggacaagcttggccgcaccattgcagaccatgtaagtgacagacttgccaggtgggtctccaagctcctcctggggctcaggcagcccagcctggtccattcagggtaagtttcatgggccacagcacttttgccactcatctctaaaaatggttcttattaatcccagcatagatttgtaaggattctctagagcggatgtgtatgtcctggaatcttccatcgcttggtagccaaaattaacctctgctattgtctcttatgtctcagttccctctctccccctctgggcaggggccgagagcagccagaagccatgtggccagtgctgtggaaggctggtgtgcctagatgggcccaggtttcttcatcctcagcactgtgtttctcagccaccccgtcttcatccccctattccctcacactgataggtacaaaaatacggttcctaccgcctggaaattgtacaatacatttcatttggtgttttaagcctgatcaagagaagctctttctcagttacagtttttctctgtagttaacaagcctccccaccattttccctgaaatagccaaactctcagcctcatctaggccacaggatgtgtgagacacaagcctccttacacaagccaaagattgtaaaggcatccttgactcccacacaatcggtaatagggcctattgcttccattggccaaatgtatcttgacacaaaccagtcttgtcctttctgcagatctccatagccacttggactactgtggccgctcccgatttcctgttctttcctctctccacttccttctgcatccagctgtcaatactgtcatctgaaaatgcagatcacatggctctgccctgcttccatgactacttagaatacagctcatctccagtatggtctgcggggtctcagttcataccactctctgtggtgtactttgctccagcctcactggaagaaaatgtttgcttgctataaacacttgagaggtgctctgtgtttctccctttgggtaaagctttctaggctggtcctaatctgggagcctctaaaactctgagatgtggagcgagacaggaactgggcaggggccacccttttctctttgaccatccccaactgctttttttcttgctttactttactcacttgtcttccacctcagcctgcagtgagtggcttttgtcatcaggcattaataacgcaaagtgcctcagagcagaagagttaactatttgtttacttagctaaaaacatctggacttttctccatagccaggctcctgcttgctgagccggcttgttctcacctcgaggggcatgggcctccaccctgccgtttggggtgaggggatccttggccagggtggtttccccgccgtcataggagggaagtcagtgggaggctcagaaggccttggctatacaaccagtgccatgcggcgcagtcagggtcccatggacgacttccatcagctcacccgcctccatccccaagcagagtgtaggcaagggctgtgactgcctcaggtaattgggtgattttgctccagcaagaggagaggaagcatgtgagtgccacactgaacctttcagaaacagccgtggggtcgggggtgcttgggccaggccaggatacttggtgttaagcctgctctctcttcagtgccccgactcggcttgcaagcaggacctgctggcctacctgcaacgcatcgccctctactgccaccagctgaacatctgcagcaaggtcaaggccgaggtgcagaatctcggcggggagcttgttgtctctggggtaagcattagctgaacaaaaagagggccagtgggaacgtgctgacccttgtcagaaatgaaagtcacctcctatccgcataaacacctgccctgggaaagtgtgctgtgcagaaactccaagtcctgtcccagtctctggagaccaaggtctgtccatcatctgttccctgtagaactgtgacacctgcggggcactgcaagggctgaaaggctggcctcctcccctttgctggccactcactgggtaggaatttttaaaaatcttccttgggaccgggcgtggtggcaggtacctgtaagtcccagctacttgggaggctgagacacaataattacttgagcctgggagatggaggttgcagtgagccgagatggcaccactgcactcccgtctgggcaacagaacaagactgtctcaaaacaaaacgaaacaacaaaacaaaacaaaacttccttttcttcccccagagaggaattaagagtagacatagatagggtgttttctcaaaagcccttcactcctcagagtgcttgggtagcgtctctttctttttaccacatcacagttctgaggcctttctcacctagggcaggggaaagaagaggtttgctgagtggattggggtccaccgagcctccatggcttctcttaatcccactgaatttcctttaaaagaaacacttcttatattgaacatattgagaccatttgctcatctgctttgccataaacatccctgtctcgattcctgcttctcctcccccacgtgcttacagctctgggatcacttacagtgacttccagttggtttgagtgaataaacacttgctgaggggtgggggtgagcaaggcgaggttgcctcatgtcttctccaaagggtctgagggcaggcgcttccaggctatttagataagagcagccgttgagggtgttcttcaggaacaggctgctgcccaatcctctgcgacctgcccaggccctggtcttgcagaggagtagggggctccccttcaagcacagcccacctgtgtccacgaggctggaggtcaggccggtgcttcttaccacccctgtctgcctcgtaggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 368 - DNA, 238588 bp, Homo sapiens
aggccccacccgctggtggcccggtccgcgtgtgcgccgactctcgcactctcctcgctccgggcgcccagactctgagagagagcgacggccatcatagaacagcgaaggcagtcgatcggcctgcggtccgcttcggcattcgcaggccgcaggcgggaggctagagcccccaggcgcacctcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggaagcggccgcctccctgcgccccgcccctccggctagctcgctggctcccggctcctcccgacgtctcctacctcctcacggctcttcccggcgctctcctggctcccttctgccccagctccgtctcggcggcggcgggtaggtgcagccgcaggcggggtccgattggaggggcggcctcctcactgtcccggggctgcccgagccttgccctgcggcagctgggtaccccacggggcccgcccgaggcgtggaagggcggtggccgccggcctgcgagacgcgggggcgtccgagggagggggccaggcggggggctggcggctttgaccttcggagtctttgaggcgcgatctaggggggtctttggagtgaggggggctgagaggtccagcttttgagggtcggggcggtggggccgagcgacatgccttgggctctggatggggctgagccgcggagcgagggtcggccgcagtctggggccctgggtggggttcggaggtgtaggagaactcaggggtcgttttctgaggctttgtgggggtcagttgatgtgaggctgaggtgagccttagtatgtccagtcagggattatgggtggggctgaggggtggtctggagaaccgggccctaggcggggctcttcccccttgcaaaggccccgacactgtgtggggactaaagcgtgtgtctggcagtgggagtgcgaaagggtcacattagggtgggggtggggagggtacagggactaggagaggcagttggaaacattacccagaacagagattgtgatttagcacatggaacaagttctccgccggtgtgagttagatccctttggtgaaattgtcctgtggaggagttgtgagggttttgctcacttccaggaacgggtaaattaaatgcatttgctgctttggggaagaggcagtgattgattacctttaggtttgtgctttaggacccaagctcggatgaaatacgtgttcctcgcgaaggttagtgttacccagctttctactggaaacccccttttctcctttgccttctctggtcctgttacagtattgctccccagggcctctcgattctctctccctggttgcatagcattgcagtgtttcttgcagtgtgtgtgtgtgtgtgtgtgtgtgtgtgtgtgcgcgtgcgtgtgtgtgcgcgtgcgtgtgtatgtgtgtgtgcgcgcgcgcgcgtctcccgcccatttccctgctgctgtgcttttggcaactgcctctgctctttcccagggatggttgtggcattgcatcaggggatatttgtgcttgtaatttgctcactcagcccaggaggagggtgaatagtatgctgtagagatggggggcgggggcagggtgccgtcagcttggctgggtagacagagaaatgggtgtggtgagggaatacagctgctctaggcctttggggtaacactgcccagtcatcagcccaaagagattcaaagagcaccaccagcagctatttttataaatcaatcctgaatccaagctgagcacatggatttagagtgaacagttgtcatgctctattacaagctgggtgtttggtagacaacattaaagttgctaagcaggagactcccatctgtactgtgcagtgtgtactttacttgcaacttttaaactttgcttttctcaactccaaagattgggacatctctcttcaggctgtgtcttttaaattaacgtagtttgctgatccgtactactacttttcaaatgaaatgttttcacctcagttacacacttcctttcaaatttagcttcaaaataataaagctgtcactttttgagcacttgccatctcccaggcactagctatgtttgttaacagatgaggaaattgagactgatgggaagaagaggtcacacagatagttaagtggcaaaaatggtatccaaccaaaccaaggtctctccaacccccacatagtagttcagaaacttcagaattttggtttacattgggatgattcaagtgcttgagaatttattcatgcaaagtaaacaaactcaccagagactgataaaccagataccagttaatgcatgttggaagtattaagtgccatgtgcacaattggatttaattgtccactgaccaggacacctccattgttctgggctgcctaatcagtaataaaaaggtagttgattatggaattggaaaggcactagatattcttagtgggtattttttaaatttaaattttatttatttatttatttttgagacagggtcttgctctgtcgcccaggctggacagtggcaggatctcggctcactgcagactctacctccggagttcaagcagttctcctgccacagcctccggagtagctgggattataggcatgtgccaccacactcggctgatttttgtatttttagtagagacggggtttcgccacgttggacagactggtctcaaactcctgacctcaagtgatccgcctgctttggcctcccaaagtgccctgggattacaggtgcaagccaccatgcccggccatttatttttattttattctattttattttttaagatggagtctcgctgtgtcatccaggctggagtgcagtggcatgatcttggctcactgcaacctctgcctcccaggttcaagtgattctcctgcctcagcttcctgatagctgggattataggcacccaccaccacacctggctaatttgtgtgtgtgtgtgtgtgtgagtgtgtgtatatacgtgcacacacatacatatatacatacacatatacatatatatacacacatacatacatatacacacacatatatatatatttttttgagatggagtcttactctgttgcccaggctggagtgcagtggcacgatctcagctcactgcaaccttcgcctcctgggttcaagtgattctcctgcctcagcctccctagtggctggaactacaggcacgtgccaccacgcctggctaattttttgtatttttagtagagacagggtttcactgtgttagggtggtctctatctcctgacctcgtgttccgcctgcctcggcctcccaaagtcctgggattacaggcgtgagccaccgcgcctggctaatttttgaatttttagtaaagatggggtttcaccatgttggccaggctggtcttgaactcctgacctcagatgatccacctacctcggcctcccagagtgttgggattacaggcatgagccatcacgcctggccttacgggtattttaatcaaggaacaaaagtctagtgagtctccctttccccagtgtaaaaacacatacagtgctggaggatgtcttaacacattttcctactctgtctcacttgttttttaagtagtctcttcaaatatttgtcattccagcatccctttgttaaaattttcaaatttacaaatacatttatattacctattaaaaagtcattttccattgtttgctgacagtgaaggaagcacctggattttcttatatataggcggcttagctttagtcagagagtagattcttcctaatctcatagtgtcttgttcttcctaatctcatagtgtcttgttctttcctaatcttgtttctgaatttggtgatcaatcctttggctctgtaaacttttgctcttgacagtttttggaatcactttgcttttttttttttttttttttaaagattaagcgtgagtagttgctatgtagcttttagatttccttaagatgtgagaaaatctgagaggaacattttgacccagtggaaggcatcttggcagttcatgtatatagtcaatttgaaaaggaaaccaagtaagtatcagtgatttcactttgtctttctaaacagcacttttagaaccaggttattgtagacttattgctaggagtgagtgggttgagaacaattaaggttaagaagggggattgtagggctgggtggctcatgcctgtaattccagcactttgggagcctgaggcggaggattgcttgaggccagaagtttgataccagcctggataacatagtgagaccctgtctccattaaaaaaaaaacaaaaacaacttagtcggtccccagataattttagtgtacagcaaaacaacaaaaacaacaacaacaaacttagctaggtgtggtggcatgtgtctatagtcccagctactctggaggctggggtgggaggatcactggagcccaggagttcaaggctccagtgatatgattgtgccactgcacttcagccttgctgaaagagccagacctgctcacccctgcaaaaaaaaaaaaaaggggtaataaagcacactgatacatataggggatcatattcatcatactcatctaccattttagagctcctaggccagtctttaaatgcagaccttatggtgaactattttggatgtcattaacattttaaggttgaaagtcaacacaattactttcgtgattctttttccttttttttttttttttttagagatgagatcatgttctgtcagcagtgggggagatcatagctcactgcagccttgaacttctggcctcaagtgatcctcctgcctcagcctccccagtagttcagactgtgtatgtgcaccatcacacctggctaacttttgtgattcttgttcttattcttttttttttttttttgagactgagtctcgctgtattcccaggctggagtacagtggcgcgatctcagctcaccacaacctccacctcccgggttcaagcaattctcctgcctcagcctcctgagtagctgggattacaggcactcccgctgcgaccagctattgtgattatttataggttaaaaaagttaatcttcttggcttgggcatgatggctcatgcctgtaatcccagcactttgggaggccgaggcagggggatcacttgaggtcaggagttcgagaccagcctggccaacatggtgaaaccctgtctctactaaaatacaaaaattagctggcatggtggcaagcgcctgtaatcccagctactcgcgaggctgagacaggagaatcacttgaatctgggaggcacaggttgcagggagccaagatcacgccactgcactccagcctgggcaacaagagtggaactccatctcaaaaaaaaaaagttaatcttactgtaaactaatattttattagtttgcatatatttaaatatgtttaaaaatttatttatgctgggtgcggtggctcatgcctgtaatcccagcactttgggaggctgaggtgggcagatcaagaggtcaggagttcgagaccagcctggccaacatggtaaaaaccccgtctctactaaaaatacaaaaattagctgggcctggtggcgggcgcctgtaatcccagctactcgggaagctgaggcaggagaatcacttgaacccgggaggcagaggttgcagtgagccgagactgcaccattgcactccagcctgggctacagcgagactgtctcaaaaaataaatttttttatttataactttcctcacttctttttatatggaaaatagtttaaaactccttttaaataatttcaggtttacagaagagttgtaaaggtagtacagactttctatatacattctgtattcattccatttctcttagcgttaacattttatataacctgatacccttatcaaaattaagaaattagcattagtggaatattattgagcaaactacagactttcctctgattttcctgtgttttccactgatgtccttttcctgttacaggatccaatccaggataccacattgcatttagatgtcacaattctttagtttcttccaataggtgacagtttcttagtctctccttccctatctttccttgacacctttaaagatgagtggtcatgcatttgtagaatggttctcattttgggttttctggtgctttctcatgattagcccgaggttatgcattttggggaaaaataccatagagatggtttacccttcttgtcacatcatatctgggaatacctgatatcaacatgactcgttactgattaacttttttttttttttttttttttgagacaaagtcttgctctgttgcccaggctggagtgcagtagcatgatcttggctcacggcaacctctgcctacccaattcaagtgatttttgtgccttagcctcccaagtagctgggaccacaggcacgtgccaccacacctaatttttgtatttttagtaaaggcagggttttgccatgttgcccaggctggtcttgaactcctggcctcatgcagtccaccggcctcatcctccgaaaatgctaggatagcaggcatgagccattgtgccttgttaactttgataacttgattaaagtgatgttctgcactgtaaagtgactgttgttctgctttttaattttacttgatagaacctagaaatgagtcaccaagtcatatccatattctgggggaagggaattaagctccaacccctgaagggaggagtatcaaagaatttgtgggcatgttaaaattcctaaagtaattagttaatattttggggaagataactgtgaggttatacagaatctgatttctccttaaaaatttcctctacttattttagcattcattagtgaatcttgcctgcggcagcgttgattatattattctgttggttttctatttttctaattctttctacttttatgatttggaatccttttgtaaggaagatttatgcctcccccatttatttattaaatcatttatgtcaacatggacccatgaatatttttttctttgcttataatccagtactgtattttgttgctcaagttgttccagctttggccattctaacattggcacctatgttcttttgaaatacctttccctacctttctttgtcttttagcacttttgtacttcctggcactgtaagatgccccagtctcatcttgtactttacctgccccaaccctaaaatcagccatttctccaaggtgtcctggttccttctgttggagaagagtatttggaaaccactatctggtttctaaatgagcttgatgcactcattactgctagggtatcactgcttctaggccctctcaggggatagttaggaagtaatatatatatatactgacccacacatatcttcgtttacttccgtatctgtctgtatataaatataaacatgagtttatactgatatctctgatgctgatccagcaccacagagttcattctagcattctcttccttgcttctttctctgaaagtgagaaatttggctgatttaatgaataatacatgctaattttttcaactctaatatatatatgaagtaaaaaatagtcttaattgtcatataaagtaaatttccaaagcattttgcagttgttaactaatttaaattatactcctataatattggtattttaaattactgtttttcagctcaggtagagagatgaaatcatttacccttggccaaacaggaagtgagtgattgtatctagaattgaagatttattatttatttatttatttatttattttatttatttattttttttgagatggagtctcgctgtttcccaggctggagttcagtggcgcaatctcggctcactgcaagctgcgcctccggggttcacaccattctcctgcctcagcctcctgagtagctgggactacaggcgcctgccaccactcccggctaatgttttttctgttttttgagatggagtctcgctctgtcgcctgggctggagtgcagtggcatgatctcggctcactgaaagctctgcctcccgggttcacgccattctcctgcctcagcctctttagtagctgggaatacaggagcccgccaccacgcctggctaattttttgtatttttagtagagacggggtttcaccgtgttagccaggatggtctctatctcctgacttcgtgatctgcccaccttggcctcccaaagtgctcggattacaggcgtgagccagggcgcccggccaactggctaattttttgtatttttttagtagagacagagtttccccatgttagccaggatggtctcgatctcctgacctcgtgatccgcctgcctcagcctcccaaagtgctgggattacaggcttgagccactgcacccggcctatttatttattttttaagagacagagtcttgctatgttgctcaggccggtcttgaattcctggcctcaagcaatcctcctacctcagcctcccaaagttctgggattataggtgtgagccactgttcctggccaaatgacctattctcactcccagtgctatacttgatcctaaggaaagcagtctcattatcttgactaacaaatcaacctttgtcttcttgatgggattgttccttttaattaaagaagttcctggtatttagcttttttaaaaaaaatactttcagcagtattgagagcaaaaacaattctttttctggacttcttcctcctcgtagaatcatagaagagatttagagataatctagacaaatgtttcacataataggtgattcctccagttctctatgcaggtatttcccaagataagtacttcacagctggttgctaccaattccaggtttgcagatttgtcattttagaaagattttccggataatgattgtagatctgcctccctgcagtttctcttcagtggtcctaatttttctgtctacagttattccctgtagctctaatctcaactttgcacctattcaatgacagttattttgtcccacctttttcttttccacactagtggcttttcccccagctacctctcgtgaaatgtgctttctaagccttttattattgtcagaagacaaagttacaacaaatttatttatagatttttttttttttttgagacggagtctcactcttttgcccaggccggagtgtagtggcactatctcggctcactgcaagctccgcctcccgggttcacgccatgctcctgcctcagcctcccgagtagctgggactacaagtacctgccaccgtgcccagctaattttttgtattattagtagagacggtgtttcactttgttagccaggatgctctcgatctcctgacctcttgatccgcccgccttggcctcccaaagtgctgggattacaggtgtgagccaccgcacccggctttttttttctttttaagatggagtcttgctgtgtcacccaggctggaatgcagtggtgtgatctcggctcactgcaacctctgcctcctgggttcaggcgatcctcctgcctcagcctcccaagtagttgggagtacaggtgcacaccaccaggccccagctaatttttgtatttttagtagagatggggttttgccatattgaccaggctggtcttgaactcctgacctcaagtgatgcgcccaccttggcctgccaaagtgctgggattacagacgtgagccactgcacccagctccagccttgaaattcttaatcagatataggttgagtatccattatttgaaatatgagaccagaattgttcatattttggattttttggattttggaatatctgtagtatacagatattccaaaatgctctctagtgagcatttcctttgacatcaaaaagtattagattttggagcatttcagatttcggatttttgtgtgttttttgagacagggtctcgctctgttgccagagtttagtggcataatcacagctcacttcagccttgaacttctgggctcaggtgatcctcctgcctcagcctcttgagtagctggaattataggcacgtgccaccatgcccagccaatttttgtattgtttgtagagacagcgtttcaccatgttgcccaggctggtctcaaactcctaggctcaagtgatcttttcacctcagcctcctaacatgctgaggatttcatgcatgagccactacacccagcccaggattgagatttttggatttgggatgctcagcatataattcacttgggttagcccactttctcttttaggaatagaaatccactagtaggactctggagagctctcagtcattttcttatgggaagaacatatttttattgaaataatttgaatttgggtagtgagtgtgttgctttgggtgacaagtgatttctcagtttaggaaggattgggagcagagaaagtgggggataaggcagatttacaggcttagttctctacatatcagctcaagtttcacctttagaaggtcattcacggcccctttctaccctactctttgatgttttccccaatgtatatctttgggcatatgtcattccacatttaaaaaagttgatacataattcacatatcgtaaaactcaccattttaaagcatacaatttggggtaggcatggtagctcatgcctgtaatcccagcagtttgggaggctgaggtgggaggattgcttgagcccaggagtttgagaccagcatgggcaacatagcatggcaaccctgtctctaccaaaaaaaaaaaaaaaaaaaaaattagccaggcatggtggtgcacacctgtagtcccagactcttgggaggctgaggtgggaggatcattcacttgagccaaagaatttgagattgcagtgagccatgatcgtgcactctagcctgggccacagagcaagaccctgtcaaaacaaaacaaaacaaaatcatagaattcagtggtttttggtgtattcacaatgttgtgcaactaccaccattatctaagtccagaacattttcattacccccaaaagaaacctcatacccgttagcagtctcttccattcccttcattcacccagcctctggcaaccactaatcatcttcctgtctgttctggacattccatattaatggaatcatacaataaatggcctttctgtgtttggcttctttcatttagcataatgcttttaggttcatccatgttgtagcatgtatcatttcattcatttttatggctgaataatattacattacatggatataatgcattttgtttatgcattcatccattgatgaacatttgggttgcattttttagctattatgaataatgctctgtgaagattgatatgcttttatatggacatttatttttgtctaaatacctagaaggagaattgcttggttatgtgttaattatgtttaaccttttaaaaaattatttatcgccaggcgtggtggcacatgcctgtaatcctagcattttgggaggctgaggagggtggactgcttgagcccagcaattcaagaccagcctggggcaggcaatatggtgagaccctgtctctataaaaaaaaaaaaattaaaaccagaaaattatttttttcttctctttctttctttcttttttttttttttgagactgagtttcgttcttgttgcccaggctggagtgcaatggcacgatctcagctcatggcaacctccgcctcccgggttcaagtgattcgattctcctgcctcagcctcctgagtagctgggattacaggcatgtgccaccatgcccggctaattttgtatttttagtagagtggggtttctccatgttggtgaggctgggctcgaactcccaacctcaggtgatctgcccacctccgcctcccaaagtgctgggattacaggcgtgagccaccgtgcctggctttcttttcttttttgagacaagatcttgctctgtcactcaggctagagtgcagtgatgcgatcatgattcactgcagccttgacctccagggctcaggtgattcttccacctcagccttctggatagctggcattgtaggtgtgtgccaccacacctggataattaaaaaaaacaattttaattagagatggggtctccttatattgcccagtgaactcctgggctgaagcaatcctcttgcttggccacccaaagtgctgggattacaggtgtgagccaccatgcctgactgatagtatcttttgaaacacaaaagttttaaattttgatgaagtccagtttatctagttttttcttggttgcttgtgctataggtgtcacatctaagaaacgattgcctaatttaaggtgataaagatttctcttttgtttgtttttttcattcgtttgttctttcgttcgttcgttctttcttctttccgagacagggtctctgtcttttgtccaggctggagtgcagtggcatgatatctgcccactgcagcctccacctctcaggctcaagctatccttccacctcagtctcctgagtaggtaggactacaggtgtgcaccatgatgcttggctaattttggtaacctttttttttttttttttaagatgtagtctcgttctgtcacccaggctggagtgcagtggtgcgatctctgctcactgtaagctccacctcccgggttcatgccattctcctgcctcagcctcccaagtagctgggactacaggtgcccaccaccatgcccggctaattttttttttttgtatttttagtagagatgaagtttcaccatgttagccagaatggtcttgatctcctgacctcatgatctgcccacctcgggctcccaaagtgctaggattacaggcgtgagccactgcgcccggctgagatgtggtcttactatgttgtccaggctgatctcgaactcctgggctcaagtgatccgctttccttgcctcccaaaatgctgggattataggtgtaatttatgtttctttaaataattttatagttttagctgttgtatttagttttttttttatcaatttcaaattaatttttatacatgatgtgtgaggtaggaatccaaaatctttttctttgtttcttttttttttttttttttgagatggagtttcactctgtcgcccaggctgaagtgcaatgacgtgatctcggctcactgcagcctccacctcccgggttcaagcgattctcctgcctcagcctcccaagtagctgggattacaggtgcccgctaccacacccagctaatttttgtatttttagtagagactggggtttcaccatgttggccaggctggtctcgaactcctgacctcgggtgattcacctgctttagcctcccaaagtgctgggattacaggcgtgaaccactgcgcccggcccaaaatctttttcatttgttttttttggtgtgtggatatctagttgtccttgaaccagttgttgaaaagacttctttttccattgaattgtgtatcatcttagcatccatgttttgagtcaattgaccacagaggtgtgggcttatttctggactttctttttttttgagacagtcttgctccgttgcccaggctggagtgcagtggcgtgatcgcagctcactgtaacctctctgccttccaggttcaagcaattctcctgcctctgcgtcttgagtagctgggattacaggcatgcaccaccacacccagctaatttttatatttttggtagagacggggtttcaccattttggtcagacgggtcttgaactcctgacctcaagtgatccgcctgactcggcctcccaaagttctgggattacaggtgtgagccaccgtgcccggcctggactttcaattctattgcattggtgtacgtctatgccagtaccatcatgcttgctttcttgtattttcaccctgtggtactactatctgctactatctgcataaatatgctgtcttgattaatgtacttttgtaatatgttttgaaattaggaagtgtgagttttctaattttgtttttttgaagattgttttggctattctggatccttggcatttccatttgagctttaggattaacttggcaacttttgcagaaaaggcagttggaattttgatagggaatgccttaaatctgtagatcaatttagagagtgctgccatcttaacaatgtcagatcttccacttcatgaacgtgggatgcctttccatttgtttatgtctttaatttctttcaagaatattttttaagctgagtgtggtggtggctgacacctgtaatcccagcactttgggaggctgaggtgagaagattgcttgagcccaggagttcgagaccagtctggccgacatatcacacacacacacacacacacacacacacacacacacacacacacacacaattagctggatgtggtggcttgcccctgtaatcctagctactcatcagggtgaggataaggtgggaggatcccttcagcccaggacgtcgatctgtgatcctgccattgcaatccagcatgggcaacagagtgagcctctgtctcaaaaaaaaaaaaaaaaaaaaaagtgtgtgtatatatatatataatgtattttgtagtttttttttcttttattattatacttacaagttctagggtacatgggcacaatgtgcaggtttgttacatatgtatacatgtgccatgttggtgtgctgcacccattaactcatcatttacattaggtataactcctaatgctttccctcccccctccccccaccccatgacaggccctagtgtgtgacgttccccaccctgtgtccaggtgttctcattgttcaattcccacctatgagtgagaacatgcggtgtttggttttctgtccttgtgatagtttgctcagaatgatggtttccagcttcatccatgtccctacaaaggacatgaactcatccttttttatggctgcatagtgttccatggtgtatatgtgccacattttcttagtccagtctatcattgatggacatttgggttggttccaagtctttgctattgtgaatagtgccgcagtaaacatacatgtgcatgtgtctttaaaagacacatgatttataatcttttgggtatatgcccagtaatgggatcgctgggtcaaatggtatttctagttctagatccttgaggaatcgccacactgtagtccacaatggttgaactagttttacagtcccaccaacagtgtaaaagagttcctatttctccacatcctctccagctattttgtagtttttagtgtacaagtcttttactttaaatttattccttagtattttattccttttgatgctattgaaaatggaattattttcttatttcattttgtgttgttgattgctggtatagagaaataaaagatttttatagatctggtattctgtggccttgctgaactttttttttcttcttttttttttttgaaatggagttttgcttttatcacccaaactggagtgcaatggagcgatctcggctctccgcaacctccgcctcctgggttcaagcgattctcctgcctcagcctcccaagtagctgtgattacaggcatgtgccaccatgcctggctaattttgtatttttagtagagtcggggtttctccatcttggtcaggctgatctcatactcccgacctcaggtgatcccacccgcctcagcttccctaagtgctgggattacaggtgtgagccaccgcacccggctgaacttgtttactaatgctaatttgtgtgtgtgtgtgtgtgtgtgtgtgtgtgtgtgtgtgtgtgtgtgtgtgtgtattcctttggatttccatattgttttaaaattatgattattttttgagatggagcctctctgttgcccaggctggagtgcagtggcacaatctctgctcactgtaacctctgcttcccaggttcaaatgattctcctgcctcagcctcctgagtaggtgggattacgggcatgtgccaccatttttagtagacagggtttcaccatgttggccaggctcgtctccaactcctgacctcaagtgatccaccagcttcagcctcccaaagtgctgggattacaggcgtgagccactgcacttggcctaaaattaaatatatcttgtcactggcctgagagtcccttgaagtcagagaccatacttcatttcttgtttctctttctctactggcaaatgtatgttcaattgatgctgcagtcaggtgctacagtagtgggacttagcggagcataatgccactaatgacttggaaaatggcacagaagggaagtgggatattgtaaaactatttttacctattataaaatgcttcctgaggtccaggaaaggcaattctcacgtttgtctctgctcttctataccttttgcccctaattatcctttgtttctggaactcagaatactaaggatcataaagttaggcatttaagaataggaacattaatttgattttatatattatttccctagggaaatgtgttctggcctcattaaaaaaatagttttttcatgaatttataatttatttttttgggacagagtctcactctgttgcccaggctggagtgcagtggcgccttcttggctcactgcagcctctgcttcctgggttcaagtgattctcctgtctcaccctcccaagtagctgggactacaggcacacgctgccacacccaggtaatttttgtagagacgcagttttgccatgttggccaggctggtcttgtgaatgcctgacctcaagtgatccgcccacctcggcctcccaaagtgctgggattacaggcatgagccagcgtgcctggccaaatttattattagtagtagtagtagtatttttgagatggagtttccatcccaggctggagtgaagtgacatgatcttggctcactgcaacttccgcctcctgggttcaagtgattctcctgcatcagcctcccgagtagctgggattataggcgcatgtcaccatgcctggctaatgtttatgtttttagtagccaggctggtctcgaactcctgacctcaagcgatccacctgcctgggcctcccaaaatgctagggttacagacgtgagccactgctcctggcctcattaatttatttatttttattttttatttttttgagaccaagtctaactctgttgcctaggctggagtgaagtggcgcgatcttggctcgctgcaacctctgcctcctgggttcaagcaattctcctgctttagcctcccgagtatctgggactacaggtacgcaccaccacaccctgctaatggggtttcaccacattagcccagccagtctcgagctcctgacctctagtgatctacctgccttggcctcccaaagtgctggagttacaggtgtgagcgactgcacccggctacttttttcatgaatttagaagtatttatcgtaatgattggctatgttcattgttaattctgtgttcagattttttctcttttctttttttcttgagatgggtctcagtccattgcccaggctctggagtgtggtttggcatcatggctcattgcagccttgaccttctggtttcaggtgatcctcccaacttcagccttatgggtatctgggactgcaggcgtgtgccaccacacctggctgattttttttggtattttttttgtagagacagggtttcactatgttgcccaggctggtctcgaactcctgagctcgagcgatctgcccatcttggcctcccagagttctgggattacagctgtgagccaccgtgcctggccctcagatttcttcttgagtaaactcaagcttacttattttcctttccctcttattcactaagttacagagacatgggggtaacaaaccatttgcagttaaagggcagtatctgacccatttgtttgttatatttttgtctgccctttattacgagacatggagaaatgctttttaaaagcacactgtacttcaaaaaggggtagttcctttttacttcattttatttatttttttgagacaaggtcccactctgtcacccaggctggagtgcagtggtgtgatcactgctccctgtagccttgacctcccaggctccagtgatcctcctgccttagcctaccaagttgataggactacaggcgctcaccaccatatggacctggacctggctaagtttttgcttttttttttttttttcctgtagagacgagatctcactatgttgcccaggctggtctcttaactcctggcctcaagtgatcctcctgtctctgcctcccaaagtgctgggattacaggtgtgagccaccacacctggcccacagttcccttttaataagaaaatactaaaaatttttttaaaagaatgtattggtgggtccacacttccaacctgttctacaaaaacacaaaatagggccaggtacagtggtttacacctggaatcccagcacttcggataccaaggatgggaggattgcttgaggccaggagttcaagaccagcctaagcagcatagtgagaccccatttgtacaaaaagtaaaaaattaaaaaaaactcagaacagataaagaagatgaaattaccacaaagaaagcaaaaaaggccaagagtaaaattaaaattgaagaagatggagaagaaggaaaagtagtagtggtagaagaagaggtctctgtgaagaagaagaaggataaaaagaaaccgtggttgggcatggtggctcacacttgtaatcccagcactttgggaggctgaggtgggaggatcacttgaggccaggagttcaaaacaagcctggttaagtagcacctgaggagggagaaaaaaaaagaaaaaagagactatcctggccaacatagcaagaccccatctctgaaaaaaaaaaagttaaaaaaaattatctagccatggtggtgtctgtagtcccagctactcagcaggctaaggcaggaggcttacttgagcccaggagtttgaggttacagtgagctatgatcgtgccactacattctagcctgggtaatggagtgagaccctgtctcagaaaaaaaattttttttcactaatattgctagtttaataggttaaaaaaagggataatctcacacttttaatcacatctgattttcttaaaacaataacatcagtattgcatggtcatatatctgataattaaaggtaagtttgggtcaccgataatgaggttctctgatatagccagttgctttagtactcaaccaatttagtatgttccattttagcaagttctcttgggctgagtatattttaagagtgtcagtggctacccagacagttgttctttatcaagctaaaataagataacaataatagggacaaaaaaatgtttgaaagatattctgaataactttgtgtgctcagtatagctgagacttgctgagatgcttcagaggcaaaccagtcagcctatttcatcagccagaggtggggtgcctttcaacagtgtgttgtctaaaagtctaaggtagacttgcccaaattaacaaactttgcaattatcagtgacaggcaactatagtatggcagtaatagcactggactgagtgtcaaaagaccaaggttcaggtttcatctgtaccacataataactgtgaggtctggggcagatcagtctatctgtttccttatttataaaatcaaggttgtgagaattaagggcttcgtgactgggatgggtgaccttcagaatgctagtaagacactgtctagtgatacaaatcagaaaataatttttgtgtatatggaattggtgaagcattgatgttttcaatggaaattacattccctgtaagtttcattgggttatatagatggcaaattggctgtgaaatatgaaactcatggacttactggaaccactttgagtcccagaataattctgccttctcctaaggtcatttactaagttgtagctgagtcagaatttgaactttaatctctagcattctttctactgtgttcaatttaataccacggatatttatataccttctaggtgcatacactgtggtaagtgctgtaggtgattttttaaaaagtaaaatagaagaaacaatacacactgactttaaaacactgactttattattaaaagtgtcatgatacacactgtaaatgctatacatattgtgcataggtatgaatgactaagtggatttaaatgaatgtcttaggagcctggcatggtgaactgtacccatagtcccagcttctttgagacggacgctctgttgcccaggctggagtgcagtggtgcgatcttggctcactgcaacctccacttcctgggttcaagcgattctcctgcctctgccttccgagtagctgggattacaggcgcctgccaccacacctggctaattttttgtatttttagtagagatgggatttcaccgtgttggccgggctggtctggaactcctcgtgatccgcccgccttggcctccctaagggctgggattacaggcgtgagccaccacacctggccagtcccagcttcttgagaagcagaggcgggagaatcacttgagccttggagttcaagtacaacctggacaacatagtgagatcctacctctaaaatataaataaataaaataaatgccttaaggagatcatggtgctttgttgaattgactcacagccaaggattcagttaattttcattagtttttaattagtagagctggatgtttattacttaaatattcctttttttttttttttttttgagacagaatcttgctctgttacccaggttggagtgcagtggcacgatcttggctcattgcagcctctgcctcctgggctcaaatgatcttcccacctcagcctcctgagtagctgggattacaggtgtgtggcaccatgcctggctaatttttgtattttttgtatagatggggtttcaccatgttgtccaggctagtcttgaactcctgagctcaagtgatctgcctacctcagcctcccaaagtgctgggattacaggtatgagccatcacacctggtccttaaatattatttaaaatagtttttaaaaaaatgcttctctgggccagttgcagtggctcacgcctgtaatcccagcactttgggaggccaaggcaggtggattgcttgaggccaggagttcaaaaccagccttgccaacagggcaaaaccccatctctactaaaaatacagaaatcagccggccatggtggtgcatgcctataatcccagctactcgggaggctaaggcaggagaatcgcttgaacccaggaagcagaggttgcagtgagccgagattgtgccaccgcactccagcctgggtggcagagtgagactctgtctggggatttaaaaaaaaaaaaaaaaaaggtttctcttgttaactttgagacagtaacggggaggtggtattattcaggtagtcagaagcataaatgcccagaccgcctctatatttttaaacctaagaaagtgaaacccctgtctctacaaaacatgtaaaaattagctgtgcactgtggcttgtgcctgtagtcctagctactctgggaggctcaggtggtagaattacatgagcccagcagatagaggctgcagtaagccatgattgcaccactgcaatccagcttggcgcaatcacgccaaaaaaaatttaaaaatataaatgaaaatacaggggaacataatattccagacctttagtattgtgttgaggtttttttttcccctctactgtaaaatgagagtgttcagttttaagaggcacattttcggagcatggatagagtctttccaggagaaaacagtctgtctggtgatggagtaattaaaatgatttgagacattatttaaggaattagaggctgggcgcggtggctcacgcttgtgatctcagcactttgggaggctaaggtgggcggattaccaggtcagaagatcgagaccatcctggctagcatggtgaaaccccatctctactgaaaatacaaaaaattagccgggcgtggtgatgggcgcttgtggtcccagctgctcaggaggctgaggcaggagaatggtgtgaacctgggaggcggagcttgcagtgagccgagatcgtaccactgctctccagcctgggcgacagagcgagactccgtctcaaaaaaaaaaaaaaaaaaaaaaaaaaaaaaaaaaaaggaattagagatgtttcatttagagaataaagaggtggggacagctattttcaaatacagttgtccctcggtattcatgggagattggttctcagacctcctgcagataagaaaatctgaggatgataaggtcccatatataaaatgatgtacctctgcatgtcctgcgatatacttggcgcacgcctgtaatcccagctacttaggaggttcaggcacgagaatcacttgaacccgggtagcagaggttgcagtgagcggagattgcgcctctgcactccagcctgggaggcagagtgaaactgtgtctcaaaaaataaaataaaataaaaaatatatatatgtgatggctgaatccaaggatgtggaacctgtggctttggagggctaactatatatcaaagatctggcaagtggaataggcattagatttagtattttgttgctttgacaaaagaacaaggaccatcaagtagaagttaaagagaaaaatggaatgtaactttcttataagatagtgagtttcctcatgttaaagtaagatactgagtttaacttatgttaaaacagagccagggtatttagagatactggggaggaagttaagttgaatgacctttaatgtttttgtaaataaatggttcttaatttcatgagtatatatccccttgagaatctaaccaacagcaaagaccctgtccccagaaaacttctacggatatactatataggtatatattttctttcatccttgaaaactacttttttggggggcatagtattgtatgtttgtttgtatgtttattagtattgcattttattttctttcagtttattgaatttatcgtttctttttttgttgtttttgtagagatggggtcttactatgttgcccatgcttgtctcaaactcctggactcaagcaatcctcccacctcagccttccaaagtgctggaattacaggtgtgagccaccctgtccagccttgaacttatcattccattatcttctggcttacattgttgcttgagaagttagccttggtgttaatatctgtcaggtactctgtggcatcactagttttttatttcctcaaactgcatgacttgacagtcattggcttatccagattataagaaactaagatgccagtgcatacagggattcctcgtggctatgatttctcaggaattttttattcttttgatttgctcaacaccaaggcaggcttctatatagtccgctagggatagtgaaaaatttggggcttggtttagattggagaggtatatggtggggtgtcttataaggcttaactttgggagggcccagggccttgatttctgtcccccttgccttgtgtggcctttgaattgaaagctttggattaggccttcatagattttagtgtgcatacaaatcacatgatctttttataaggcagattctgattctgaaggtttagtgtgggacccaagattttgcatttctgatctataaggtgatgctaatcctgttggtctacagatgacactttaagttgtaaggagttagattgctatgtttgagatgtgagtggtattagtaatgttagtcatggttatgaggtggtacagtagtatataaagaatgaagatcattccattgtgcagaggttcttttttaaaattaatagacttttcttttttttaagagacagtgtcttgctttgttacccaagttggagtgcagtggcacgatcataactcactgcagcctggaacttctgggttcaagcagtcctcctgcctcagcctccacagtagatgggactacacgtgcacactaccaaggctggcaattttttttctttttttgtagagatgggtactttctatatagtggagctgaaaatttttcattgcctagtgatgtaatgcttggcataacaccttagtttttctgtttttagatatgtttagatacacagatgcttaccattgtgttacaactgcctgcagtattcagtagttacatgctgtacaggtttgtagcctaggagcaacagattataccatatagcctagatgtgtagcaggctgtaccatctaggtttgtttagtacactctatgacagttgcacaatgatgaagtcacctaacacatttcttagaatgtattcccattgttaagtgatgcatgactgtctaattgtaaccacccaacggggtcaccttgcccgctggctcaacagaacctatttatcaagatgggaattacagtagagaaagagtaattcaagcagaactgactgtgtgggagaccagagttttattattacttaaatcagtctgtccgagaatttgtgaattggagttttaaaggataattttgtgggtaggggaccagtgagtcaggagttctgattgattgggttggagatgaaatcataggtagttgaagctgtcctcttgtgctgagtcagttcctgggtgggggccacaagacaagataggccagtttatatcagtctgggtggtgccagctaatccattgaatatagggtctgcaaaatatctcaaacacgatcttgggttttacaataatgatgttatccccaggagtaatttagggaggtttagaatcttgcagcctctagctgcatgactcctaaaccatgatttctaatcttgttagaatttgttagtcctgcaaaggcagtctagtccccagccaggaagggggtttgttctgggaaaactaacctaaactgtaaactaagttcctcccaaacaaagttagtttgggctaagtctaggaatgaacaaggacagctgggaggttagaagcaggatggagttggttagatcagatctctttcactgtaataattgtctcagttataatttttgcaaagatggtttcataataatatgtatatggaatagtttcactgccctaaaaatcccctgtactccacctatttatccctacttcttccccttaactactgtaaccactaatatctttctgtcttcatagttttgcctttttcacaatgtcgtatagttagaattatacagtatatagcctttcagattggcttttttttcacctagcaatatgcatttgaggtttctcaatgtctttttgtggcttgatggctcatttctttttattgctgaatagtattccattgtctgggtacactacaatttgcttatccattcacctattaaaggcatcctagttggttccaagttttggcaattgtgaataaagctactataaatgtccacatgtaggtttttgtgttgacatgagttttcatctttgggtaaatatcaaggagtgcaattgctggattgtgtggtgagagagtatgtttagtattgtaagaacctcccaaactgggtataactttttttttttttttttaagacacaggtctcgctatgttgttcaggctagactcatctcctgggctcaagcaatcctcttggcttagcgtcctgagtagctgggactataggtgattccagctcaccttgctggctgtaccattttgcatttccactagcaatgaatgagatttcctattgtttgacatccttgtcagcacttggtgttgtgctttggattttggccattctgatacggacacggtggcatctcattgttgtcttttttttttttaatgaatttgaagtctttttttcttattaataatttcttttaaccacggttgtcagaattattgttgtcttaattggcaattctctgatgacatatgttattgaacatcttttcgttcatatgcttatttgccattcgtatatcgttggtgaagtgtctgttcagatcttttgcctatttttaaaatggggttgttcattttctttcttttttttttttttgagacagagtttcactcttgttgcctaggctggagtgcaatggcacgatcttggctcacaacaacctcccgcctcccaggttcaagtgattctccttcctcagcctcccgagtagctgggattacaggcatgtgccaccacgcctggctaattttttgtatttttagtagagatggggtttcttcatgttggtcaggctggtctcgaactcccaacctcaggtgatctgcccgcctcagcctcccaaagtgctgggattacaggcgtgaaccaccacgcccagccacattgttcattttcttttttttaatttatttttaattttttaaatttttttattttttaaacattattttatttttaattgacagataacaattgtacatagtcatggggtacatagtgatgtttttttttttttttttttttttattgatcattcttgggtgtttctcgcagaaggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgctccgcccttaatccatttaaccctgagtggacacagcacatgtttcagagagcaccgggttgggggtaaggtcatagatcaacagcatcccaaggcagaagaatttttcttagtacagaacaaaatggagtctcctatgcccacttctctccacacagacacagcaacaatctgatttctccatcttctccccacatttcccccctttctactcgacaaaaccgccatcctcatcatggcccgttcccagtgagctgttgggtacacctcccagacggggtggcggtcaggcagaggggctcctcacttcccagaaggggcggctgggcagaggtgccccccacctcccggacggggtggcggccgggcggaggcgccccccacctcccggacggggtggctggccgggcgggggctgccccccacctccctcccggatggggcggctggccgggtgggggctgccccccacctccctcccggacggggcggctggccgggcgggggctgccccccacctcccggactgggcggctgccgggtggagacgctcctcacttcccagacggggcggctgccgggcagaggggctcctcacatcccagacgatgggcggccaggcagagacgctcctcacttcccagacggggtggcggccgggcagaggctgcaatcttggcactttgggaggccaaggcaggcggctgggaggtggaggttgtagctagctgagatcacgccactgcactccagcctgggcaacattgagcactgagtgaacgagactccatctgcaatcccggcacctcaggaggcctaggctggcagatcactcgcagttaggagctggagaccagcccggccaacaggcgaaaccccgtctccaccaaaaaaatacgaaaaccggtcaggcgtggcggcgcgtgcctgcaatcgcaggcactcggcaggctgagggaggagaatcaggcagggaggttgcagtgagcagagatggcagcagtacagtccagcttcggctcggcatcagagggagaccgtggaaagagagggagagggagagggggagggggagggggaggtgttcattttcatattaaattttaagagctctttgggtccaggcgcggtggctcacgcctgtaatcccagcactttggaaggccgaggtgggtggattacgaggtcaggagattgaaaccatcctggctaatgtggtaaaaccccatctctactaaaaatacaaaaaaattagccgggcgtggtggcgggtacctgtagtcccagctacttgggaggctgaggcaggagaatggcgtgtacttgggagacggagcttgcagtgagccgagatcgcaccactgtcctccagcctgggcgacagtgagactccgtctcaaaaataaaaaaagttatttgtatattttgtttcgtttttaattttttatttattttgagattgggttgtaagactggctacattttttttgtattattattatttttttttttgtagagacagggtttcgacacgttgcccaggctggtcttgaactcctgggctcctgtgatccatctccctcggcctcccaaagtgctgggattataggcgtgagccactgcgcctggcctctgtatattttggataccagttctttgtcagagatgtgttttgcaaatattttctcccaatctgttgagtttctattctcttagcagtgtattttgcagatcagaatttttaacttcagtaaagtccagcttatcagttttttctttcctacatcatgtttttggggttgtatctaagaagtcattgccaaaccctaggtcacctagattttcttctatgttatcctctaggagttttatagtttcgtatcttacatttaggtctataatccatttttttttaatgatccatcaatcttttaatcttccacagttttggtgggttctcttggactttattctgtagcagttcatgaccatgtaccatttacaggcatgagtgataaacttcatagtggctgagaaagatcaacagaatgagttgccttgtccaaaggaaatatgtcagtgacatatgagtgactgagtttttactaattgagattacatccaggtaccttttggtgatgaaactgtttattgtttgttgcagagttctactgcagactaacaattcctgaacccatttaataacccatgtatattaaatgtgatatgattgggattttaaaggccagaggtttaagagagagatgttcaaaagtttttttttttttttgagacagagtctcactctgtggcccaggccagagtgcagtggcacaatctcagcccactgcatcctccaggttcaagcaattctcctgcctcagcctcctgagttgctgggattacaggtgtgtaccaccaagccggctaattttttgtattttagtagagatggggtttcaccatgttgcccccagggtggtctcgaactcccgagctcaggcaatccgcctgcctcagcatcccaaagtgctaggattacaggcgtgagccacccgcttcagcctcccaaaatgctaggattacaggtgtgagccactgcacccagcccaaaagttgttgaattctcaaataattaagatttcatgtgttcatatggaccataaaggatcaaaataagtatggcttgccattattgtaatgttgctatcctgagtaggtcttttttttttttttttttttttttttgagatggagtcttgctctgttgcccaagctggagtgcagtggcacgatctcggctcactgtaacctccacctcccaggctcaagtgattctcatgcctcagcctcccaggtagctgggactacaggcgcacgccaccatgcctggctaattttttgtattttagtagaaacggggtttcaccatgttgcccagggtggtctcgaaccactgagctcaggcaatctccccaccttggcctcccaaagtgttgggattaaggtgtgagccactgtgcctggccctgattgggtttttatcattatctgttcagttcatgtagttttggctgttaattctgtacttgaattattcaatcacaaagtgtttttactgactgctgactctactttcactttcattacttaatgatgaaggctgtttaaaataatgttgtaatgccgggcacggtggctcacacctgtaatctcagcactttgggaggccaaggagggcagatcacctgaggtcaggagttcaagagcagcctggcccacatgatgaaacccatctctactaaaaatacaaaaattagccgggcgtggtggtgcacgcctgtaatctcagctactcggaggctgaggcagggagaatcacttgaacccaggaggtggaggttgcagtgagccgagatagtgccattgcactccagcctgggcgacagagcaagacctcatctcaaaaataaataaaataaaataaaataatattgtatctagattttcaaatcaggtgtttatgcaggaaaagacaattgttttattggttttagaaaaccaacaaaccaaagcaacaataaagattcctgtatacatttttttctttaattaatgaattacttgggtcattctggtaaaataagatgctttcttgttaccgaatgccagttttatcagatgaaaaggactgtgttcatagatgatggagataatcaccagttctgatagttactctaaaagataagacataatcctgttcagccagacctagtgaaaatcagaaataccgatgaaacttggacacgtagagtaagatttttggcttaaaacacctttgcaagtgggtgggtatgtgtagtatttatgtgtgctacttggtttctaaagactccctactatatgctaatttttaaattatgtacatggtactttttaagcctcgcaggctggccagccggcctactggcctccctccctctctccgtacaataaattagccaaaataatgaggtaatatctaagtcattgtagtctaggactgagtcatttttctctttgaaaaaattccagaatactttatattttcttgaaggtaacttttttgcacttgttttaaggtattgttactttatttacagccaacgaaatggaactgttaggtttgtaagcatcttatatttttgaagtgctgattgtatgttcaatctaattcaataaatatttattgtctaatatgttctaggctttggtgtaggtgcttgggatataaggatatgtaactcatagttcagccttaagtctaaatatttagtatatttgtgttttttaatttagtttttaaacacagttttttaaaataattttgagataattatagatttacattcaattgtaagaaacaataatacagagatatcccttgtacactttacccagtttcccctggtggaaatttcttgcagaatcatggtacaatatcacaaccagggtattgacattgaaacagttaacagtaaagtggtacagccactctgaaaaatagttcggcagtttgcctaggagtacagttgctaggccatatggtagtcgcatgcttacttttttttttttttcttttttttcttttttatttatttatttatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctggttacttgagattagggattggtgatgactcttaacgagcatgctgccttcaagcatctgtttaacaaagcacatcttgcaccgcccttaatccatttaactctgagtggacacagcacatgtttcagagagcacagggttgggggtaaggtcacagatcaacaggatcccaaggcagaggaatttttcttagtgcagaacaaaatgaaaagtctcccatgtctacttccttccacacagacacggcaaccatccgatctctcaatcttttccccacctttcccgcctttctattccacaaagccgccattgtcatcctggcccgttctcaatgagctagtgggcacacctcccagacggggtggtggccgggcagaggggctcctcacttcccagtaggggcggccgggcagaggcgcccctcacctcccggacggggcggctggccgggcaggggggctgaccccccccacctccctcccggacggggcggctggccgggcggggggctgaaccccccacctccctcccggacggggcggctggccgggcagaggcgcccctcacctcccggacggggtggctggccgggcaggggggctgaccccccccccacctccctcccggacgggtcggctggccgggcggggggctgacccccccacctccctcccggacggggcggctggccgggcagaggggctcctcacttcccagtaggggcggccgggcagaggcgcccctcacctcccagacggggcggctggccgggcggagggctgacccccccacctccctcccagacagggcggctggccgggcggggggctgacccccccacctccctcccggatggggcggctggcggggctgaggggctcctcacttcccagtaggggcggccgggcagaggcgcccctcacctcccagacggggcggctggccggggggagggctgaccccccccacctccctcccggacggggcggctggccaggcggggggctgacccccccacctccctcccggacggggcggctggccgggtgggggggctgacccccccatctccctcccggacggggtggctggccgggctgaggggctcctcacttcccagtaggggcggccgggcagaggcgcccctcacctcccggacggggcggctggccgggcggggggctgacccccccacctccctcccggacggcacggctggccaggcggggggctgacccccccacctccctcccggacggcatggctggcggggcgggggggctgaccccccacctccctcccggatggggcggctggccgggcggggggctgacccccccccacctccctcccggacggggtggctgccgggcggagacgctcctcacttcccagatggggtggctgctgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacgtctcagactatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgggaggtgtaggttgtagtgagccgagatcacgccactgcactccagcctgggcaccattgagcactgagtgaacgagactccgtctgcaatcccggcacctcgggaggccgaggttggcggatcactcgcggttaggggctggagaccggcccggccaacacagcgaaaccccgtctccaccaaaaccaatcaggcgtggcggcgcgggcctgcaatcgcaggcattcggcagactgaggcaggagaatcaggcagggaggttgcagtgagccgagatggcagcagtacagtccagcttcggctccgcatgagagggagaccatggggagacggagacggagacggagacggagacggagacggagacggagagggagagggagagggagactttttaaagaaactgccatttgtattgatataatatggtggaggcccaggttccccacgtggtccccgctgatcttgttactggtctgcagggatgaaattcctggataccctacttggctttctgtctccaccttggaaggggtattgagtgcttaattacagctttgagaggttggaaatctaggctccccacttggcctttgctagaacgggtaggttttaaaccacagtattttcttggtgtttggctggggtagattggttattgtctaaaacttttctgtcttgctagactgctactttcttggtcttttagctaaagaagactgacttttgttggggcttttcttttcttttttttttttggagacagagtcttgctttgtcgcccaggctggagtgcagtggtatgatcttggctcactgcaacctctgctttcaggtttcaagtgattctcgtgtctcagcctcctgagtagctgggattacaggagcccgccaccatggccagctaatttttttttttttttttttttttttttttgagatggagtcttacactgtcgcccaggttggcgtgcagtggcatgatctcggctcactgcaacctctgcctctcgagttcaagtgattctcctgcctcagcctcctgagtagctaggattacaggcgcccgccaccacacctgtaatcctagctactttattgtatttttggtagagacggggtttcactatgttggccaggctggtcttgaacttctgacctcatgatccacccaccttggcctcccaaagtgggattacaggcgtgagccaccgtgcctggcctgctccagctgattttttgtttttgttttttgttttttttgttttttgaggtagagtcttgctctctcgccaggctggagtgcaatggcgcgatctcggctcactgcgatctccgcctcctgggttcaagtgattctccttcctcagcctcctgacttgctgagactacaggtgcgtgccaccacacctaatttttgtatttttagtagagatggggtttcaccatgttggccaggatggtcttggtctcttaacctcatgatctgcctgcctcggccttccaaagttttgggatcacaggtgtgagccaccatgcctggctgggtatgtttttaaaatgacatttattttttctttttgcaaaagttttatttaatgtagataatttagaaacacaaaaattataaaagagaataacattttcatatatattcttctagacatttcctgtgaatatatatacatatttttcttgtgaaaataagaactatatatactactcatgaactttttgctcgatataagcatcattccttgttaataaatgcatgaatatagcaccaatttggtatcaatcaggttgtaatgtgcacattctggagatcatcaatatgtgttactcccctaggtcgagtgcctgagagacagatcatgtacaaataaacgacgtacattttcacatgaatctcatagttcagacatcacttatatactagagagagttagaagtaaatcagatttagtcattagttttagaaacactgggtatttgggtaggtatttagattttaaagtttaaaaataaaaaaaataaaagtgttcatgtggctttacgaatgctattttgattaaaattcttgttcatattttccataatattataagaagggtcattatacttttcagaagaacatttgagataataatggctttcttgtttgttcttggaggaaataggagatactagcagtgttgtttcaatgaaccctagcattagttttctgctggaacttgcaaaacagaaaccagaacgacttaaatcttttccatagtacagttttttctaattgctatgtggtatacttgcagatgttcagatttattgggaaatttagatttcatagcttaggatttttggtattagctattcagattgatgcatcaggtctaattaaaaattatactcaagtttattcttgtactttatgttgtctttttcttatgatgtgagtagctgcagtataactcaaaaccagtaattataaaaccacttaatgaatgaatgtagatgtaaaagcatataatatttggagttgttttagtttctgtttctttaaaggtgaaggtacatatgtcataatttgggaagctatcctttcaacttaacatggagttgaaattgaaatgtgttcttagacataaatttgagatgtgttattgaacatatttaacacgttatcagtttccatatttttccaagcagttaaccattgggtagtgcacagcaagctcattttcctcttagccgttctgtgcatcttgtggtttgagatgttcatcactgtctggctgtgaaccccaaatgtcctcctagtgatcctggaaggtattttagaatagttttggctttctgcttttgattctaatttatgagatctggagtggagtccagaatctgaattttaaaaagaatagctctattgagatacaatttataaaacatacagttcagccacttaaaatgtacagttcagtggttttcagtattttcacagttgtgcatccattaccacaatcagttttagaacattttcattactcaggcaggacgcggtggctcacaccagtaatcccagcactttgggatgctgaggcgggtagatcacttgaggccaggagttcaagaccagcccgaccgatatagcgaaaccctgtctttcctaagaatacaaaaagttagctgggtgtgatagtgcacgcctataatcccagctactcgggaggctgaggcacgagaatagcttgaaccaggacgtggaggttgcagtgagccaagatcgcgccaccgcactccagcctgggcgacagagcgagactctgtctcaaaaaacaaaaacaaaaaaacccaccctgttctccttagctactcttccacctaatccttccatttccctgcactcacaactcctagatttttatggtgtatggctctcagttggcgtaggggtagagttgtgattttgccctttaggggacatttgacagtgtctggaaacattctcatgggtcacaactgggaaggtgctattggcatgctattaaacatcttccagtttagaggacaacctctcataacaattttcttgtccaaaatttcagtagtgaaggtgttaagaaactctggaagagagttagactaaacaaattgcaagatcaaatttttagccctcacattggcagtaggatattatcttacatggtcgatttataatttatgtaaaattgttaaatgtattggggttatacagatgatagaaaaaagagtcttagggacctaagggactcagtttagtctagtctggaatagtatgatgtcctcgctgggagccatgaaccctagtctagagcctgggatgtagttgttgaatgaacatgattatgtggtggtagtttgaactaaaatgattcttagttatttcataattgatggatatctagattggtagacttcacatagctgtatagactattccctcttttaatcctcctatcttgccaaaatcaataaccataaaaaagaatgtgtagaagagtctgatttttatagtttatttcaaagaaatttaagagtctcaatggtgctataaagaaattaaagactggctgtggtttggttgacttgaaaaggatatgtgggtctgagtgtgtgtgtttaattttttaaattttcttttgtttttgttttcagagagagtcttgctctgtctcactgcagcctctgcctcccgggttcaagcagttctcctgcctcagcctcctggtagctgggattacaggtgcacaccaccacacccagctaatttttgtatttttagtagagacggggttttgccatgttgcccaggctggtcttgaactcctgacctcagatgatccatccaccttggcctcccaaagtgctgggattacaggcatgagccaccacagccagcctaagtgtgtgtgtgtgtgtgtgtgtgtgtgtgtgtgtggaaattgaatggttttcaaaggtgatttgattagcatttgcatagactgtgaatccaagatgtttgtgttcccttccctcattcttccattcttttctctgtttgtcaatttttgtaccgcgatatatgagggattaaagaaaaatcttttagaatagttttggctttctgccttttttttttttttgagatggagtttcactcttgttgcccaggctggagtgcaatggcgcgatctcagctcaccgcaacctctgcctcctgggttcaagcgattctcttgcctcagcctcccgagtagctgggattacaggcatgcgccaccatgcccagctaagttttgtagtttcagtagagatggatttcaccatgttggccaggatggtctcgatctcttgacctgtgatccgcctgcctcagcctcccaaagtgttgggattacagttgtgggccaccgcgcacgtcctctatagtttttttttttttttaagtttatgataaattgaaacaacactaagaaaatcagataatacaggaatattaaatgaaaaccgaatctttctgagaaatgaaaaatagtatctcattgtttaatttgtatttctttttagatgaaagaggctgaatttttttttcacatttattatttggatttctatgaagagtttgtgtcctggactcatttttctgttgggttgttgatagttgttctgtttgtttgtgagagcacttagtatattataaaaattaatccattgtgtagtacatgtaacacaaatattttcttctactccgttatttgccttttgactttactattttttttttttttttgagatggagtctcgctcttttgccaggctggagtgcagtagtgtcatctcggctcacttcaatctctggctcccgggttcaagcgattctcctgcctcaacctcccgagtagctgggattacaggtgtgtgccaccacgcccagctactttttgtatttttagtagagacggggtttcaccatgttggccaggctggtctcaaactcttgacctccggtgatccacccgccttggcctcccaaattgctgggattacaggtatgggccactgcacccggccaaaaatttttaatttaatttaattaatttattttttttcccagacgaagtctcactctgttgcccaagctggagtgcagtggtgcgatctcggctcactgcaacctccacctcctgggttcaagcaattctactacctcagcctcccgagtagctgggactacaggcacgcgccaccatgcccagctatttttttgtgtgtgtgtttttagtagagacagggtttcactatgttggccaggctggtctcaaactcctgacgtcgcgatccgcctgccttggcctcccaaagtgctgggattacaggcatgagccaccacacctggccttaatttaatttttactagtcaatttttttagtagacctggtctcactctgttaccctggctggagtgcagtggtgccatcattgctcactgcaacctgaactcctgggctcaagtgatcttcccacttcatcctcccaagtagctgggtctataggtatgcactatcatgcccggctgatttttgcattttttgtagagacagggtacggttatgttactcagactggtctcagactcctaggctcaaacgatcctcctgccttggcctcccaaagtgctaggattacaggtgctggatccagctggcagtttctttaaaaattaaacatgtacttaccatactacccagaaatcactcctttggttatttactccaaataaaataaaatttatgttcacttaaaaacttgtacgtaactgttcatagcagacttattcaaaacagcaaaatgtgaaccaatccaaatgttgtgtcaacaagtgtaaagcaaaacatatgacatccatagcatggaatactactgagtaatcaaaaggaacaagcaagctatagataacctgcaacaccttgaatagactacaagggtaatgtgcttagtggaaaagcttatctcaagaggtcacatattatatagttccatttatatgacattctcaaagtgacaaaactgtaaagatgaagaatagattagtgattgccaggggacaggggggtagtaggtggaggggctataaatacagagaggtagcagaacagttctgtatcttgattgcagttgtggttataaaaatctatacatgagacaaaactgcttagaaatacacacacaaatgcaggttaaaaaaaatagtgaaaactgaataaggtctgtagtctagttaacagttatgtatcagtgtcataatgtttgagaccagcctgggcaacatagtgagatcctgtctctacaaaaaaatttaaaaaattagcccagtgtggcggcatgcacctgtggtctcagctactctggaggctgaggtgggagatcacttgagtcctggaggttgaggatgcagtgagccttggcgctgccactgcactctagcctgagtgacagagtgaagactttgtctcaaaaaaaaaaaaaaaaaaaaaaaaaaaagataattgagatctggatctacctgatgataaagtgtgtgttccttgcacagtaccatccagtcttgcctggtaattcctttcaggcctttacttggttcttaaatactagatgttgccaaataagtgatgctacttttactaggtgtggttaggaggcacagcatccaaagcaaggacatgagattgtaatacaaggaaggtgatgacttgctccattgtctgtggctttcttatgttgtaatgggagcttatcagtgtgcaccatgatcaggttacagcatcaggaggagctctacaacctattttagattcacagttaatattgtctgcttttttctttgttcttgtcattttcttttctcttttgtactttctctttctctctctctttttaaaagatgggagtctagatacattgcccagtacagtggctgttcacaggcataatcatagctcattgcagccttgaactcctggactcaagcaatcctttctgtctcagccttccaagtagatggaactataggctgtgtgtcactgtgccaaacatctctctctgtctctttattttttaagtgatagagaaccacaaatgtgttttttaaagaaccagcattttttcaaataccaaatatttgtgtagctgatgatgaggcatcactaggagtttccttttgttgacaaattcaagagagacatcattccaaatgaaattttattccgaaagtgaattttgtgaaaaccagtgctaagaaaataacaaaatgaacgaacaccaaaacacccatgtgtttacaaggaaacaagaaaacatggagttaaagtaagtaattgtgtctacttgacagatgttgggttttctttccctcttggactattgtgtttcctcaatttgtaggtttcatgtcatctttttaaaatagtagccgtcttttgactccttataagttatgttgggccaggccaccttaccacatgaattccctccccactttgcttggtatttgataccctgctttcagccaccatggcttcctccccacccctaaacgaagactctgattttgctctgcttgctctaccctacctgatggctttaggctaaattgtttatgctgaccggagtcagattttatttttagagagataattctggtgaccatatggagaactgggtgagagactgtcagtgttcagttgagtctagtgcagaatctaggtgaggggtttgaaccaaagtacatggggatggataaggaagactaagcactctacagacgatgatgataatatgataaattatataggttataatttactgaacacttgccatccctcataacaacttcatgattgaaggccttaacatttttatttatttatttatttatttatttatttatttatttttgagacggagtctcactctgttgcccaggctggagtgcagtggtgtggtctcggcttactgcaagctccgcctcctgggttcacgccattctcctgcctcagcctcccgagtagctgggactacaggcgcctgccaccacgcccggctcattttttgtatttttagtagagacggggtttaaccgtgttaaccaggatggtctcgatctcctgacctcgtgatccacccgcctcagcctcccaaagtgctgggattacaggcgtgagccaccgcgcccggctaacatttttattttatagatgagtaaacagtcatggagagattacataccttgcccaaatttacctagctcaacagaggaaaagaaaggataggaattcaggtggtctgattttagaacctgtgcttttgaccattatactagctgggggctttatttttctaactgttagaagtgttcaacaatgaaagagccaccctgtgaagtaatgtgggcatcacttgaaatggtcaggcaggaagtagacgggtcattaatactacatcaagggtccacatacacactgtggctagattactgtgaagaaggcttttaagttctgtgattttgtgatgtgatatacagggagttgttgctttatgtggttctcatatacactttcacttaccatggtttggttaaataataccaattccctaataacatggtttaaattttacacagcatattaactgtgaataatcgtataaagtacaaaattcgctgccagctcttctgtcactacataagtaacaactgtgcaaagcatgggtttgtgttacctccttgtctcccagtgataaatctatgtgatagttaagaaaaatcgataaccgatagagagaattggccgaaaaagatgaaagttcaggaaaaaaccaaaaagtaacaacagtggaagtgaaattcaaattgaactcaaatggagttatagaagaaatagatcactgagggaatgctgatgctctcattcaaaacactctggatatgtagccgaaataacttagtgaaggtgagcttatctacataagtgaagaaagtggtttggtaaaaaaaaaaaaaaaaaaaagaagtgatgcaagaaattttgtagtgaaagaactctcgaaggtattctgtgatattgaaatatgaaacataaagtatttgatgctattccagactcagacaggagtgtgacaattggctaaggcatagaaaagatgtctattgcagccgggcgcggtggcttacgcctgtaatcccagcactttgggaggccgaggcaggcggatcacaaggtcaggagatcgagaccatcctggctaacagggtgaaaccccgtctctattgtatgatgagaagaatgtaagcactatttaaactacccctaataaattttttcaaagaacttaaacattataattttcaatatttctatgttctctagtgcagtggtcctcaacctttttagcactgatttagtggaagacagtttttccatggaaggggacgctgggggaggggatgttttcgggataaaactcttccacctcagaagatcatcaggcattggattctcataaagagtgcacagtctagagccctcgcatgcacagttcacagtagggtttgtgctcttatgagaatctaatgccacgactgatgtgacaggaggcagagatgctcgcctgcccttcgctcacctcctgctttagtgcattaatgattagttttcctgttctttcaattttcctataattataactgacagagtttttaatgtttcaatgaaattttttttttttttttttttgagactgagtctcactcttgtcacccaggctggaacacagtggtgcgatctcggctcactgcaacctccgcctcctgggttcaagcgattctcctgcctcaggctccctagcagctgggattataggcatgcaccaccatgcctgactaattttttgtatttttagtagagatgggttttcaccatgttgtccaggctggtcttgaactcctgacctcaggtgatttgcctgcctcagcttcccaaagtgctgggatctcaggtgtgagacactgtgcctggcctcaacaaaaaaaaaattcttttttttgagataggatcttgctctgttgcccaggctggagtgcagtagtgtgatctcggctcactgcaacctctacctcctggattcaagcaattctcctgcctcagcctcccgagtagctgggattacaggtgctcaccaccacccctgggtaatatttattttattttttaaattattttttgagatggagtctcactgtgtcacttaggctggagtacagtggtgcagtctcagctcacgcaacctctgtagtgaacccgtcctaggttcaaacaattctcctgcctcagcctcccaagtagctgggattacaggcgtgtgccactacccctggctaatttttgtatttttagtagacatgaggtttcgccatgttggccagggtggtctcgaactcctgacctcaagtgatctgcccacctcggcctcccagtgctgggattacaggcatgagccactgtgcctggcccaaaattttttaaaaattacagagtggcggccgggcactgtggcttacgcctgtaatcccagcactttgggaggctgatgcgggtggatcacgaggtcaggagatcgagaccatcctggctaacatggtgaaaccccgtctctactaaaaatacaaaaaaattagccgggcgtggtggcgggtgcctgtagtcccagctactcgggaggctgaggcaggagaatggcatgaacctgggaggtggagcttacagtgaaccgagattgcgccactgcactccagcctgggcaacagagtgagactgtctcaaaaaacaaaaacaaaaaaaaattacagagcggctgggtgcagtggctcacgcctgtactcccagcactttgggaggcttaggtgggcagatcacgaggtcaggagatcgagaccatcctggccaacatggtgaaaccccatctctactaaaaatacaaacattagctgggtgtggtggcacgtgcctgtagtcccagctactcaggaggctgaggcaggagaatcgcttgaccccaggaagtggagattgcagtgagccaaggtcgcgccactgcaccctagactggacacagagcgagactccgtctcaattttaaaaaaaaaaagattacagagcaattgcagtttttctcattaattattatgatcactttgcatggtttcagcgtgcattcttacttttacggttttgcactattgtgtaaaatgaaagctgcctgtttgtaaactgtggaaagtttaatttttcttcttagtttttaggggtaccccctaactagccttttctttgcagagtttgtatatgcatctctaacaaagtatgtttcctttgacaagttttgcttttaaaaaacttggactgactgaaaataatatttgtagaaaatattctaaaagtaatgcaaaaaggaaatatccttaaagctagtattaagaataatctcataggaaggaagtttcatgtgtttggtgttatctctctttttggtaacagttttgttgagatatattttatataccataccattcacccacttaaagtgtagaattcaggccaggcacagtggctcatgcctgtaatcacagcactttggaaggccgaggcaggtagatcacttgaggccaggagttcgagaccagcctgaccaacatggcaaaaccccgtctctactaaacatacaaaaattagccgggcatggcgacacgtgcctgtaatcccggctacttgggaggctgaggcacaagaatcgcttgaactcaggaggcggaggttgcagtgagccaagatcatgccattgtactccagcctgggtgacagagcaagactccatcacaaaaaataaataaataaataaaatgtacaattcattgttttttggtatattcacagacatgtgcaccattagtgcagtaaagtctagaacattttcatgacccccaaaagaaatcccatgttctttatcactccctaatacaataaaccccaagccccaggcaaccatgaatctactttctgtataaatttacctactctggatattttatatacacagattaatatagtaggtggtcttttgtgatgttttcagggttcacccatcttgtagcatgtattaggactttattcccttttatggctgaataatattccattgtatgtatgtacctcattttatttatcatttatttgttgaggaacatttgggttatttctgctttcatatggtaactctgtttaatcttttgaggagctcccagactttttcaaggtggctgcaccattttatgttctcattagcagtatatgagggttccagttcttgccacatctaaaacacttgccattcattacctgtttttttttattttagtcatgctactgggtgtaggatctcattgtggttttgactttcatttttctggtgactaatgtgtttattggccatttgtatattatctttggagaaatgtacagattctttgttcatttttaaattaatttgcctttttattattaagttgccagagtttttggtattttagatacaggtgtgtgtggaaaaaacaaactccgtttctcctactgctgatattcttatagcaccctactgaaagcagatgtgtggggatttctccccaccagcaggcaagcaagcagtcatttctgcagctgacagccactcaattctgacataatcaacctggagatagcatcaagattccacaggttgagggctcagtttccaagactgcctctccccacacttcacatgccagttgtaagctcccgcttattttacctgtgcttctgactgactggctataaattggtgttcccatttatagccatgggcttaacttgctagagcagctcgcacaactcgaaaacacatgtttaccagtttattacaaaggatattttaaaggatacacataaatagccagctgaagagatatataagacaaggtctggaaaggtcctgagagcaggagcatctctcctggtggaattcgggtgtgctaccctcccaggactttgtctgtgcttatactagtaccacattgtcttgactattatagctttctgtagtatgttatgaaagtggaaagtatgtgtccgtcaaccttgtttttatttcagggttgttttagctattctgggtcccttgaatttccatatgaattttaggattgattgtcaatttctacaaagaagcttggtgtgattttcatgtatttttttggacacagggtcgcaccgcatcacccagactgagatggggttttgccatgttgcccaggctggtcttgaactcctgggctcaagtaataatgcccagtttggcctaccaaagtgttgggattacaggagtgagccactgtgcctgaatctgtagatcagtttgggaagcattgccatcttagcaatgttaaatcttctgatccatgaacttaaatgtctttccatttatttaaatcttccttaatttctttcaggaattttttttttttaatttttcagagtataaattgttcacttcagccgggcacggtggcttatgcctgttatctcagcactttgggaggccaaggcaggtggattacctgaggtcaggagtttgagactagcctgaccaacattatgaaaccccatttctactaaaaatacaaaaattagccgggcatggtggcatgtgcctgtaatctctgttactcaggaggctgaggcaggagaatcgcttgaacccgggaggcggaggttgcagtgagccaagattgtgccactgcactccagcctgggcagcaggagcaaaactccatctcaaaataaataaataaattgttcacttcttttaagtatttttttatgctattttaagcagaattgttttcttaatatcatttttggattgttgacgcaggtacttggtgcatttaaaatacaattttattggctgggcatggtggcttatacctgtaatcccagcactttgggaggccaaggcttgcagatacctgaggtcaggggttcaagaccagcctggctaacaacggcaaaaccccgtctctatcaaaaatacaaaaattggctggatgtggtggcgcacgcacgcctttaatcccagcactttgggaggctgaggcgggcagatcataaggtcagcagttcaagaccagcctgaccaattggtgaaaccccgtctctactaaaaatacaaaaattagctgggtgtggtggcgcatgcctatagtcccagctactcaggaggctgaggcaggagaattgcttgaacctgggaggcagaggctgcagtgagccgaggttgcggcactgcactccagctgggtgacagtgagactctgtcttacaaaataaataaataggctgggcgcggtggctcacgcctgtaatcccagcactttgggaggccgaggcgggcggatcacaaggtcaggagatcgagaccgtcctggctaacatggtgaaaccccatctctactaacaataaaaaaaaattagttgggcatggctgcaggcgcctgtagtctcagctactcgggaggctgaggcaggagaatggcctgaacccaggaggcggagcttgcagtgagccgagatcacgccactgaactctagcctgggggacagagcaagatgccgtctcaaaaaaaaataaaaaaataaaaataaataatatgattttgtcaaatttaaaaccttaagatcctattggcttgtaatagcaaggagtagaagcgtggattgtagaatgttcttatgaaggctttatttcatcaatggcttttaagcactttggggtcagactttgagctgttagtgattgtttttgagctgtagtccttagagattccaaactgatgactgcatatgtcacttgtatagtcaatgtgactggttttcaaaagccctttcagttatagagccaatgactgggcaacagaaatgcctttcatttatatcattcttctgttttcttggtgcaaagggctgtagttaagaggaacagttagattttagtggcttaccaagttgctttagaggaagtctatgaaaggactgttgagccaaacaatgttcagattaaaaaccagtctgttagcaggacagaatcctcttgcagatactttgtttaacctttaacttagtgcaagaagagttcaagctatgacttttgagattaaatcttaaattatgtaagcatgtttctgataaggattgttttatcatctgcatcagaaccatttggactgctttaaaatacagatttctggactcctacccagatttactaaatcaaattctgggaatagaacttcataatctcttttaaaccacctttccatgggatgtccacgttaaagtttgaaaactacttttatttatttttggcatccatatgtgtttattgatatagtttcccactcatcttgattcagggttctttcagtgctgtctctatctgaaggagagccttcctgtaggctggcagaggacagcagagcagccagacacacaactactattgtgcatgactgacgaccatggtgattttatagcatcctgggcatttcacgttcaggaagtaagaattggggctctgcaccaggcacttcttgtgcttgctctttttttctggagagggagggagattctttgtgagaggcctgttctcgtgaggggatcgtcagcactggaaaactgaaaaccagttttaatagtacctctttctgttaagagattggtttttaccaggactgaaatttttcaaattatgactcactgccaactattttttctgttgctgtttttgtttgtttgttttttttgagacagagtttccctctgtctcccaggctggagtgcagtggtatgatctcggctcactgcagcctttacctccccaggcttaggtaattctcctatcttagccctcccaaataggtgggactataggcgtgcatcaccatgcctggctaatttttgtattttttgtagagactggatctcaccatgttgcccaggctgatcttgaactcctgggctcgtgtgatctgcctacctcagcctcccaaaatgctgggattacaggcatgagccatcgcccttggcctacagccaactcttaaaagcaaaacaacactagaagataatggaatagaagatttcagtaggccgggcacagtggctcacgcctgtaatcccagcactctgggaggccgaggcgggcggatcacgaggtcaggagctcaagaccatcctggctaacacggtgaaaccccgtccctgctaaaaatacaaaaaattagctgggcgtggtggcaggcgcctgtagtccccgctgcttgggaggctgaggcgggagaatggcatgaacctggaaggcagagcttgcagtgagccaagatcgtgccactgcactccagcctgggcaacagagtgggactccatctcaaaaaaaaaaaaaaaaaaagtttcagtgcattgtacatagtatggatgagtattgatttataaaacttctgtttcatttatatatgtgtatgtgaatatggatcataatataaatttttttttgccatggatggtgataaaaagaaaaaaatgaagacttgagaattagaaaaacacatatttttctttccttcactctttcatacgttcttttgcatctgccatgctcctggaactgggataggtgctgggtgagcatccaaatattccgaaaatcctcactcttttttttttttttttttctttttttggagatggagtcttgctctgatgcccaggctggaatgcaatggcgtgatctcggctcactgcaaactccacctgctgggttgaagcgattctcttgcctcagcctcctgagtagctgggattatagacgcctgccaccaatgcttggctaatttttgtatatttagtagagatggcattttgccatgttggccaggctggtttcaaactcctgacctcaggtgatccacccaccttggcctcccaaagtgctgggattacaggcgtgagccactgtgcctggccgaaaatcctcactcttgagctcacagtttatagagggtaataggcacataaataataaagtggtatagtagaagcacatgtcatacattaactgtgtactagaagtacatatcatatagagtgctcctgaagtcatggcgactttcatagggatggaggtaggttgaggggtaggtactgaaaatattgaagctgggtgctgtggttcacacctgtaatcctagcactttgggaggccaaggtgacaggatcgcttgggcccaggagtttgagaccagcctgggcaacatggagaagccctgtctctacaaaaaatacaaaaattagccaggcatggtggcatgtgcttggagttccagctacttgggaggctgaggtgggaggatcacctgagcctcaggagatcgaggctgcagtaagccaagattgtgtcactgcacgccagcctgagtaacagaatgagaccctgtctcataaataaataaagtgaaaaggtggagaagaagaatagcattttaattattaagcgtgaaagaattattttagtattgaagatggacaataattgatataaatcatttttgatttagtattcttatccactcttattcatatgttactcattctgatgcagcttttgagtatataggatcaatccagcacatgaagagctaaagggaggttctgtacctcttgtgacagcttttcctattcttggagggacccttttttactttcctcagaactttatttactagagtttatttcctttttagattttatttcatgttgatgctagtattcttactgaatgtattctgacccactaagaatcaatgacagggtagggaggtgtagttgagatttggggagagccttatgcatttcataggggtccaaattctgtatctgatttttggcttcagaatacttttcaggctgtaagccagtaacctcattttagtctttatctctcagccttatagtcatcttttgttttatcttactgtaggctaacattcaccattagaaagtcagacagctggtctacacaccagaagatactatattagctttcattgcttatgtttgcctgttgcaggctcttttgtttacatcagccgccttcactcatttggttttcatatgcatactgattgatacatataaacttagggagattcactctaaacagtgctcttgatctattttgtgtttcttaagtgttttagctcagagactggtactgtttacatagaaagaacagcctcgtcaagagtctggaggggcataccctatgtcacagcatttggccatagctctatacatgacgatatcaagaaggcgcccccttggacctacgaagacagaaggcacattcatgtactttgagtacacagaaatatgataaatgatgaataacaactgtttttaagaattaaaaaacaggaggcataaagttaataggagatgaatgcttaatgtgtggcagtttcacgtgttacatttgagggtcaggtcggtagtggtgttggtgaagggagctaactggttacccagcctggatgggattgggtggctgtgggtggaaaaggtgggaggtagcgttataaacaattaaactagtgttcaattgttaaaggctattatcatagcctttgacttttcagtctgttgaatgatcattttgctttgcatagagcttgctataaagattgctgtgagagacaatatttggtagtaaattaagagttgtgccactttactagctgagcaatcttaggcaagttatttaacctctaagtgccctggtgtcctcattttaaatggggttatctatgtcctagagttgttcaacatattaagcaaagtaatttatgtaaagtgattagaatggtctctggaatataagtctgcaataactgctgtttttttttgagagggggggatggagtctcgctctgtcgcccaggctggaatgcagtggtgggatctcggctcactgcaacctccaccacccaggttcaagcaattctcatgcctcagcctcccgagtagctgggattacaggtgtgtgccaccacacctggctaatttttgtaattttagtagaggcggggtttcatcatgttggccaggctgatctcgaactcctgacctcatgtgctcctcctgccttggcctcccaaagtgctgggattacaagtgtgagccacaatgcccagctggctcttcttatttttatttttagtctattgagacaggatctcactctgttgagtgagtgcagtggtgccatcacgactcactgcagcctcaacctcctgggttccagcaatcctcccacctcagcctcctgagtagctgggaccacaggcacataccaccatgcctggctaatttttaaattttttgttgagacgggatctccctatgtttcccaggctgatctggaacacctgtgctgaagcagtcctccctcatcggcctcccaaagtgctgggattgcaggtgtcagccactgcatctggtctagttcttatttttttatatgggttggagtttcttttttttttttcctttttcttcttcaattttaatattttgtcattttattatattgcatctcccactgaagacttgtatatttcttggggtcttattggagagaaatccttttttttttttttttttcatacaaatcagacccaaggtaggtttagtgtttggactgtaatatgaagtttgctttttaattgttaaaataatgatttttttcttgcattaaacaattctgaaagtttttctttttgttcacttgtagtcagacaccaaagaaagggggaaaactgtagaataagttattttttttgacagtgtctcactctctgtctcccaggctggagtgcagtggtgcagtcacagctcactgtagactcaacctcctggtctcaagcaaatctttcacctcagcctcccaaggagctgggattacaggcatgtgccaccatgcctggctaatttttgtatattttgtagagacaaggtctcagtatgttgcctaggctggtcttgaactcctggactcaagcaatcctcccacctcagcctcacaaagtgctgggattacaggtgtgagccactgcacctggcctaagtgaaaaaaaattttttattttttggatacagagtctctctctgtcgcccagggtggagtgtggtggcatgatctcagctcactgcaacctccccctccaggttcaagcgattctcatgcctcatactcccaagtagctgggattacaggtgtgtgccacaatgcttagctctttttttgtatttttagtagagacggggtttcactatgttggccaggctggtctcgaactcctgacctcaagtaattcacctgtcttgggctcccaaagtgctgggattacaggtatgagccactgtgctgggcccctaagtgatttttttaaatggtcaatgtgtgagctgttttttccttatggttttctctgttccttttccttgccataaaagtaaaaatagatctggtttcctgggttatcacagcttttaacaaaaagctttttgataaaattagctgttgggtcagtgggatgagatcattcctttctaagtagtgtgaaatgtcctctaagcatttgtgagacaaaggcatgccagataggctaaccacacaataagcctaactctgtggttatgtttagggcaggagtgtgagttttctgtgaaatagaatactactgatatgtagaaaaaggtgaaaggtacttggcacaatatgtatgcactctggttggccacgtgtagaaagagattagaatgataaaagggctcaggatacacttgatatgagggcataggccatcattatcttcagatgtgattaattaactgaaaattgagtagctcatctacatttggattagtgcatctttaattaaaaattcttggctggacacggtggcttacacctgtaatcccagcactttgggaggttgaggcgggcagatcacctaggatcaggagttcgaaaccagcctggccaacatagtgaaaaaatccgtctttactaaaaatacaaaaactagctggctgtggtggcgtgcacctataatcccagctactctggaggctgaggcaggagaatcacttgaacctcggaggcggaggttgcagtgagctgagatcctaccactgcactcaagcctgggtgacagagcgagactcccgtttcaaaaaaattaaaaataaaaataaaaaaattcttaaggacagtttgaaactggagagaaatcataatgtactttaaaatggttaattgtatgttatgtaaacttcacttcaattaaaaaaattaaggacagctggaaagaaaactaatatacttttctgtttgtacaaaataaaatggtagatttaagaagctttaaccagggcttcaactttcacatcatagatactaactgtagaagcatagtgcgataactgatagttaaatagaagataaaaatccacatgaggagggcatgccattttaaaaaggagagctatgtgatgctatttccaatacatagatatagctggacttaccttctttatccctgagaaacgaaagcattctaagttagcagaggaaatgatgatcagaatgataatacctcctaccttttccccttgcttcctgatttgggatataggacagaaaagaaattctacttttagttgagaactcagggatgactttgaacaaatatatttgttaatctccttggacttttctcacttttaaaataaggaggttggattcaaatgccctttctaaagttttgtgatttggttggaaatattagatgtgcacatcaccaagttactttgttttgtttctgtgtacatgaataagcttttattagacttggtcactgttgtctctctgtgatcaacaagggtaagttagcttctaagagtaccagtggtagaactttaagatttgaagctttaacgagagtcagctagtttgcagtgattagagacttgtaagttaattgatatacacacttttgtctatatttattaagtttctcaggggaattgtagattatttcagagtgcagttttaggtcgtggatcagatttaagttggaagtaaataatggttattactagaattttttgtttttgtttgtttttgagaaggagtctttctctgtcacccaggctggagtgcagtgccacaatctcagctcactgcaacctctgtctcctgggttcaagcgattctcctgcctcagcctcctgagtagctgggattacaggtgcctgccaccacacctggctaatttttttttttttgagacggagtcttgctctcttgcccaggctggagtgtagtggtgcgatcttgggctaactgcaacctccgcctccgagattcaagtaattctcctgcctgagtctccctagtagctgggattacaggcgcacaccaccatgcccatctaatttttttattatttttttttagtagaaatgcagtttcaccatgttggccaggccgctcgcgaactcctgacctcaattttcatacattattattaactaaagttcatagtttatttagatttccttaatttttacctaaatacctttttctgttctaggatctcatctaggataccacattatgtttagttatcatacttagctttctcttggctatgacagtttcttacacctcccttgtttttgatgactttgacagttttgaggagtactggtctgatattttgtagagtgtccttcagttgggagttgtctgatctttttctcatgattagacagaggttatgctttttagaaggaagatcacagaggtaaagtgccactcttatcacattatatcaagggtgcatactatcaaatcatgtcagcatgatttatgtctgtgtgtgtgtgtgtgtgtatgtgtgtgtgtatgtgtgtgttttgctttatcactcaagctggagtacagtgctgtgatcacagttcactggaacctcctggactcgactcaagcttcctctcaactcagcttcccaaatagctgggaccataggcacatgccaccaagcccagctaatttttttttgagaaagagtcttgctctgttgcccaggctgggttgcagtggcacgatcgtggcttaccgcaaccctggcctccagggcccaagtgatcctcccacctcagcctcccgggtagttgggactacaggcacgtaccaccatgcctggctaatttttttgtttttttgtttttttttgagatggagtcttgctctgtcgcccaggctggagtgcagtggcgcgaccttggctcactgtaacttccgtctcctgggttcaagtgattctcctgcctcggcctcccaagtaggtgggactacaggcatgtgccaccacacccagctaactttttgtatttttagtagagacagggtttcaccatgttagccaggatgatctcaatctcctgaccttgagatccccctactttggcttcccaaagtgctgggattacaggtgtgagccaccgcacccagcctaatttttgtatttttcatagagatggggtttcgccatgttgcttgcctaagttggtgtcagaactcctggcctcaagtgaacctcctgccttggcctgccaaagtgctgggattacagatgtaagccattgcacccagctgatttatcactattgatattagtcttgatcacttggcttaggtagtatttgtcatatttctcttacccccccctcccattttcatattgtactctttagaaggaggtcactatgtgctatgcacatgtaaaggatgaagggttatgttctacctcttggaagtggagtatcttgtttggaattcttcactgaagacttgcttattctctctcatttatttattcagtctattgtttatattgttccagctttggtcattgggaacttttttagttgactcctgtgtaattgagttacccctatcttttttttttttttttttttttttttgagatggagtcttactctgtcgcccaggctggagtgcagtggtacaatctcggctcagtgctacctacacttcctgggttcaagcaattctcctgtctcagcctcccgagtagctgggattacaggcacccaccatcatgcctggttaatatttgggttttttatagagacgggttttaatcatgttggtcaggctggtcttgaactcctgacttcaggtgatctgcctgccttggcctcccaaagtgctggcattacaggcctgagccacctcgtccggccaacttacccctatcgttgtttttttttttttatttttatttttagcacttcctaactttctggaaatacaaggtacttcaggctcatcttgaatattttgttctcagtcctagaattagtcatttctccaaagagtcttggtttctttatcagagaatggtattagaaaccagcatctgggtgtgaggtatgctgttgctttactggggtgtcccctgaagattttaattaaacttcatctgagtttgaaaggactggaaatgctgtgtttaaatttttttttattttctaattgagacagggtctcactgtgttgccaagactgaaatcaaattcttagccttagatgatcctcccacctcagcctttcaaagtggtgggattacagacgtgagccaccacacctggccagaaatgccatatatataaaatatataatatatattacatgtgaatatgtaatatataatacataatattacatatgaatatataatacatatattatatatatatatttttttttttgagatggaatcttgctcagttgctctgtgcagtagggatctcggctcactgcaacctctgcctcctgggttcaagcgatttccctacctcagcctcctgagtagctgggactacaggtgcatgccaccacgcccagctaattttttgtattttaatagagacggggtttcaccgtgttagccagaatggccttgatcccctgacctcgtgatcctcccacctcggcctcccaaagtgctgggattacaggcgtaagccaccgtgcccgacctacctctttttactacgattttattactactggaactagatcttaaaatatcatgtaagatctctgccattatactagttgtctgtagctacatgtatggaattttaaaccgttcagattactaccttaggaatcagtatgcattcttgccttttccataaagcagaggtgtcaggaccaagcttttcaggtcattgacaaaactgaaaaaggagttagtgattattgcttcctagggaagtaagacttaaaaaaatatgcatttacttatttatttatttagagacagagtctcgctctgtcacccatgctggagttcagtggcgccatctcggctcactgcagcctccgcctcctgggttttaagcattctcatgccagcctcccgagtagctgggattatgggtgtgcaccaccacgcctggctaatttttgtatttttagtagagacagggttttaccatgtcggccaggctggtcttgaactcctgacctcaagtgatctgcccgctttggcctcacaaagtgctgggattacaggtgtgagccaccccacctggcttatttaattttgagacagagtctcactctgttgcccaggctggagtgcagtggcacaatttcgactcactcatcctcaacttcccagactccagtgatcctcacacctcagcctcccaagtagctgggactacaggtgtgtgccaccacaaccagctaaccttttttgtattttttatcgaggcaggggttcaccatgttgcccaggctggtcttgaactcctgggctcaagcgatctgcccgcctcggcctcccagtatgctgggattacagacctttgccacggtgcctgaccagaagtaagacattttggatgtgtgaatgaagttctgattatgttctaaaggaattaccactagttttgtggtacctttttttttttttgagaaggagtctcactctgttgcctaggctggagtgcagtggcgcaatcttggctcactgccacctccgcctcctgggttcaagcagttctctgcctcagcctcctgagtaattgggactacaggcgccggccaccatgcccagctaattttcgtatttttagtagagacggggtttcaccatcttggccaggctggtctggaactcctgaccttgtgatccacctgcctcaccctcccaaagtgctgggattacaggtgtgagccaccgtgcccagccattttgtggtacttttgttttccatttctctccctctcacacctttcctgtctactgactttgtgatttagttaaaccaagccactaaaacccagccaaaattctactaccaataagaaatgtttagagttgatgttgatttaaatagctttagtgcagctgtgtcgtacttaaactcctgcaaatttccctccccccccagagatggtgtcttgctttgttgcccatgctagagtacagtggtgcgattttggctcgctacaacctccgcctcctgggtttgagtgattctcctgcgtcagcctcccaagtagttgggactataggcgtgtgctaccacacctggctaatttttgtgtttttagtagagatgaggtttcactatgttggccaggctgatctcaaactcctggcctcaggtgatctgcccaccttggcctcccaaagtactgggattacaggcgtgagccacagtgcctggcccctgcaacgttcttgaagttaaagtgagtgaagttggtcttgattaagaacttatgctgcagatattgtgtgaatgggtatctacagaggcagttatttctcagctccagtatattgttgctaagtggaaatacatagtcatggcctgatcttcggattttttatttttttgagacagggtcttacactatcacccaaggctgaggtgcagttccgcaatcatggctcactgcagccttgacctcccgggctcaaacgatcctcccattttagtctcctgagtagctggaaccacaggtgcatgctcggctaattttttttattttttgtagacacggagtttcactgtgctgcccaggctggtctcgagcccctgggcttaagggatcctcccatttcagcctcctaaagttctgggattacaggactgagccaacgcgcctggccctgttttttaaaaaagctgtaaaactgtattttcattcaaagattactgattttggagatattggccatttttcaaaacactatatgggccactgcaccaaggggcctgtttgacctaggtttgcactctgaactggtgcttctcttgtgggttcagtgagtattcattttggggagggaactctgggcttggtgggagttgggagatgtttgtcctaattgtagctttgtctctagttttctagatggcttttggcaaagggaaaccactttggatctctcttttctgagttttaaaatttgagagtaaactggagaatttaaggttctcccttactcttttttattttacatgttcatacatgtatttacttgagctgtgaaacaatgaccatttatgagttggagacttcaggaagtcttactagtcttaagtgctttgggaatagaggagactattatgttttctctagatacacttttttctaggctacagaagattctcacctgctttttggactcttggcatacttgccgcctctaatcattatctggcagatgtgtacatagtaatgggtgatgcatatgtttctgttttttcaagcaaattgattctaatttgatgaaagctgtattgatatgtagggtttttggggggtagtcgtggtgatgggtagaaatagtaaagctgacagtgacagtattttcttagttatggagaacattttaatactttatttcattatttttagtttgaactaattaattgttggtggttctatatggaaataatgatgtaggtgggtgttcatcacttaaaatcaactgcataagataatggcataacttaattactgtaacagcaaaaatgaaatctgagaaacttctgaaatttagtcttttattaatttgagataagatttatttggagataagatttcagacttccttttatcagacaggtggttttataggaagattaagattcttctagaaaaatcttaaagacaagggaaataagtttttcttacactctaaccatatattcacttgacatatagtgtttttgtaaaaatatattcgtttcttacatcttcagaataaagcatcttgatgtaatgtgatttactaagaatcatacctctctgtcctgaaggccaatctaaattgctgttttgtatagattgccaatttttaaaagagaaactgttgtatttgagtgggatgtaataaatatgagcgtttatgatgtagtctcttgtgggaatgtttatttacaagtaatttaagcctctgtgagcctgacaaggcaaactcaatcttaaatccttgattaagtggaagtataaactgatggaataataggcaagcaggatttatgtttacatggtaattgcaacaattttggccaaaacatttggcctaatagtcactaattttgatcctttatgttcattagctgaaattgtatatgtagtagtttctttgtaaggtaatacaaagcagtaaggacacaggagaagagtatatttaaaagaaatttctcttcagatgtatagactttgctttatagttctaatgacaatagtccaggagcctctaagtcagcatattattattattgttattattattattattattattattattattatttttgaggcagagtttcgcacttgtagcccaggctggagtgcagtggtacgatctcggctcactgcaacctccgccttccaggttcaagtaattctcctgcctcagcctcctgagtagctgggattatgggtgtgcaccaccacgcctggctaatttttgtatttttagtagagacagggtttttaccacgtcggccaggctggtcttgaactcctgacctcaggtgagctgcccgccttgaccgcccaaagtgctgggattataggtgtgagccaccacacctggccaagtcagcatattatttcttcttgtaaaaagatgtcatggtggctcatgcctgtaatctcagcactttgggaggctgaggtgtgcagatcacctgaggtcaggagttggagatcagcctgcccggtgtggtgaaaacccgtctctactaataatacaaaaattagctgggcatggtgatgcacgcctgtactgcccgctacttgggaggctgaggcatgagaattacttgaacccaggaggcagaggtggcagtgagccgagatcgcaccattgcactctagcctgcatgacagagactctgtctcaaaaaaaaaaaaaaaaaagtgtgtaggtatgtatacctaataaaattagcgctttctaaaaatgcagtgcttgtcatttactattaagtcaagccatatgaaatcacattttgtcagtaaataaatgttcagatatccacaatcttatacagttctaatagatactcaagaaattttgtcgacatgaagagagtcaaatcataaaatggtagactgaaaaagaacttcgtggagaattcttttctttttgcaaacagaggtgactgggaggtcgaggctgcagtaagtcatggtcatgccactgcactcgagcctggacaccagagtgagaccctgcttcaaaaaaaaaaagaaaaagaaatgattgcactgcctttttttggttttggaacaaatattgtgataataacttttacttataaatgtagcacagaaatcttttactttgtaaaagtccctgaatagaaagtcaggagacctgtttctcctaccaactagtataatttttggaaagctcattgttcatcagtttccttatttgtaaaatgaggatgttagatatgtaagatctctgtattaattaggatagttgatgctaactctttaacataactagcatttcagtgacttaacacaataatggtttatttcttgctcacgtcatagtgtgagtgtttagcctgtggctgtcatgtaattgaggaatttcaactccttccatctggtgtcttggagtctcctgctggattctttgtatttagttggttgatagcaaagagcaccagcaagcagaatttcatcaagtgctttgtagtgaagcataattcttcagctcacattgcactgtctagaacccactcacatggtctcaacttctaactccaagggaaataggaaatgtctttctgagcacccagggagaagaaacagaatccccatctttgccacggtccctttcattttgtacatttttaaaatttttttatttattattttttttaaagacagagtcaaactctgttgcccaggctggagtgcagtggtgtgatctcagctcactgcaacctctgcctcccaggttcaagcgattctcctgcctcagcctcccgagtagctgggactacaggcacgctccaccacgcccagctaatttttgtatttttagtagagacaggatttcaccatgttggcctggatggtctcgatctcttgacctcatgatccacctgcctcggcctccccaagtgctgggattactggcgtgagccactgcacctggcccattttttgattctttattcacacccaaatactttctcctgttgcatattgctttttgtatctttggttactctgaatttacttccaaatttcttggaaggagtttagtattgcaagtcaaagcagccctttggtgcttgctatgtttaggagagggtctccccccaacccctgccatccccagatgagtatatttgttatttttgttagtagtttcatttgtggtgtaagtttgtcttttatattgtcatggcttgcttagttttaaatgattaaaaatacatcaattgcaaaaatctcccagtgcttgtataagaaaaacaatagaatattgaacacagccaacttcagagggaaagtcattgtctaccatgttcagtctagcagcctgctagcagaagggaaaacagacaaaccttatactgtcttttaaaggtcagcacatgcagacttagagaccaatagagaaacacattccagtgagcaggcaaagttctctttgacttctgcccacttaagagtaaactcagagagtcagcaaaagtctttcagttgatttcagctgctgttttggagtcatctccatctttccgaagcctccttctcttttctccttttttgttctttcttgatacattatattgtacatgttcatttgtatgtaaatacaaaatatccttctttatggatccatcttatgttggtaagtttgatgagagtgttctaattctaagccttgtctccttaaaatatataattatctcagaataatgccatagttcagtttgccttatgtttggattagtactttcttgtgtagttctctttcagtaaactgctcccctcccctgtttttaattgcaccttttttcatataccatttgcaccacatgtctaagtcattggtctttttaaattacactatggaaaggttaattttggacagagttgtttctagatcctagtgcattatcgtcatcctaggattgcatttcatttctcttgtaggctaatggtactattttttggatattgcagctttaataggatgctgtgttcatttttcatttcctggagtctgtgctgaagttcattttcagaaagaatgcctggaaaataaatttttttttttcccccctgagatggagtgtcactctgttgcccaggctggagtgccgtggcgcaatcttggctcactgcaacctctgcctcccgggttcaagtgattcttctgcctcagccccctgagtagctgggactataggcgcatgccaccacgcacagctaattttgttgtgtttttcgtagagacggggtttcaccatgttggctaggatggtctccatctcttgaccttgtgatccgctcgcctcagcctcgcaaagtgctgggattacaggcatgagccaccacgcccagccaataattttttttaaattgtgtgtttgaatttcccattttagccttcacttaatggatgagttggctgtaaaaatctagcttcaaaatagtttttctcagttttaaaggcatcacttcattttttaaaaaaaatcatttagtgttacaattagaaataagcccatctgtttcttgtaagttggtaagtactgctgaggggaatttccctccctcccttcttgccaccttgccgaggctgtattcaaattcctgggctcaaatgatcctcccacctcatcatcttctttttgcttttcttttttccttcttttgtccctgtctctctactctctccattgtctgttcgttttcttcatctgcctctgtgatcatgaaaatattcgccatgttattgtttaccgttcacatttagggctgccatccacctggaattactttttgtatatactgtgaggtagagctcaaaatatccagttgacccagcaccacttattgaaaagacagttaattcccccactattttgcagtgtcacatttgtcagatattaagtatccatatgcatgtggttccgtttcaaaaccatttttttgcattggcctcttgttttgttttgttttgtttttccatatgttcagcacaccaagtacattggcctctttcttggtgattgtgcaggtaccacaatgttttcattactatatttatgtatttttagtttcaaacatatgacattgccataggttagaaactcatcagttttcagcattttcacatggttcaatccatcagtaagttttgatatccagtagtttaagttcctctaagtttgttctcaaagattatcttagctgttcttgactttttaaattactatgtaaaacttaggatcaacttttcagtttgatttgaaaagaaaaaacctactggactttgcttggggttatgttaaatctatagattaggccgggcgtggtgtctcacgcctgtaatcccaacactttaggaggccaagacaggtggatcacaaggtcaggagtttgagaacagcctggccaacatggtgaaaccctgtctctactaaaaatacaaaaattagccggatgtggtggcgcacgcctgtggtcccagctattcaggaggctgaggcaggagaattgcttgaacctgggaggcggaggttgcagtgagccaagatcatgtgccactgcactccagcctgggcaacagagtgagactctgtctaaaaaaaaaaacaaaaacaaacaaaaactatagattagtttggggatagttgatacctttaaaatatcataaaaccttaaaataaaataaaaccttataggtttttcctaaaagcactcccttagtaaatcacttgtacaaaaatccgtgcctcagattctacatctagtaaactgattctaaaacaccttcctaacaagggggagtgtgatgtctttctattgttaagttgtattaatcctgtgttgcatttcatttcagtgaattttatcttgaatggattaggtagattgttgattaattcagtgaccctcaattgtgggtgcctctcggactcaactttaatgagatttctctgtgtcatgattacccttactgcaagaaaaccaacaacactgagatttttggtgcagtagcacatgcttctagtctcagctacctgggaggttgaggctggaggatcgcttgagcccaggagcttgaagctgtagtgtacaatgagcacacctgtgactagccaatgcactccagcctgggcaacatagtgtgacttgtctctaaaaaaaacaaaacaacaacaacaaataatactcatattgcttaaccctgtccctgaacaattctgatccagcgtgttttttttgtttttttaatacttttaattcagatttttacttgtatttcaggtaaaatattaaaagttatgttactaataacttgaaagatctcttcaacttttgctgttcaattttcatttaataatgatattccccccctcctttttgaaagcatctgtaagatattaggtcaaagtaaggcctttgccacgactacaaaatgcttgttaagtactcccatagagtttgtatcttctccttcttgctcagaaaagctgagctactctacccttagtcgtgcctagaaccaatacttagaagaactatgagggtgcttccagctgtgcaaacatcaaccccagcaagagaaggctggtatggtatggagcagagcgcacctagcaggacaaatgtgcatttaatgagagcctgtgaggtttcaagtttattatatttagatgtccaggataaaaggtgagaaagatgctatcctagccatcgaggaactcaagcgttaaggggaactctgggtgggacacacattgtaaataaacaattacaagggtgggcatggtggctcacacctgtaatcccaacactttgggaggctgaggcaggcgaatcacttgaggtcaggagttcaagaccagcctgactaacatggtgaaaccctgtctctactaaaaatacaaaaatctccgtctcaaaaaccccacaaaaaacaaaacaaaacaaaaattatagaattggcagcacaaattcctatgtcctcttctaccttccacttttctttattttcactgatataaaatagagtgaaacttcactttgcttaatgggagaagtttttcttttgttatctattattttcaagacagggcctcactctgtagcccaggctggagtgcagtggtgctatcacggctcactgcagccttgaacttcctctgctgaagtgatccgtccacctcagcctcccaagagctgggaccacaggtgtgcaggctaattttaaaatgttttctgtggagacgcagtctcaactgtgttgcccaggctggtcttgtactcttgggctcaagcagttttcctgcctcagccttccagaatgttgggattataggcatgaaccaccatgcccagccaaaagagagttttttctttaataaaatagttctcaaaagctaagagctgatcaagtatgaatattcttcctttcttccaatctcctcagcactaagtcatcctaaagttacatgatatgcttattactttctgacagatatatgagctgataactatagagatttaatattttaataattataaagttttaatatttatatgatcatattaacatgatggtagtggctgatatctttctctctttctctctctgtccctcagagatgtggtctcactttctcgcccagactggagtacagtgttgtaatcatagctcactgcatcctcaagctcctgggctcaaggaatcctactgcctcagcctcctgagaggctggcactacaggcacacaccaccatgcccagctaattaaaaacatttttttttgtagagatggtgtcttgccatcttgcccaggctagtcttgaattcctgggctcaagtggtcttcctgctttggcctcccagagttctgggattacaggtgtgagtcaccatgccaggccagtaactggtcgaccatcttgaatatttgtttttgccacattgcatcatgtcatgcttttctaaaagcagagagagctatttttattgctatgcctaataatgataagatgaccagcatggagagctggttcgtacggttactccttactggctttctttctataattccagacaacatgcttgctcttgtacaaactgtgtttagaaagtggaagaaaataggtgaatattcttttttatttttatttttttgagacagagtctcactctgtcacccaggctggagtgcagtgacacgatcttggctcactgcaacctccacctcccaggttcaagtgattctcctgcctcagcctctcgagtagctgggactacaggtgcacaccaccacgcccggctaatttttgtatttttagtagagaggggtttcaccttgttggccaggatggtctcaatctcttgacctcataatccacccacctcagcctcccaaagtgctgagtgctgggattacaagcatgagccaccacacctagccaaggtgaatatttgtaattggtgataacctttcagccttgaatctgtttattctttttctagttgtgaagagtttttgtaattttggaacttctgattaatttcaaattagattcaatttctaataactttcatcgtgtcattttagaaatgtgtttttagccccttgttttgttggtttttatcattttggcctgtctcctctgtagtctactaggaacagagaaggtgtgcacatcactttgatgtggtcctctcttctgggacccagcagtttacaggagctggtatatacaactaactacagtggggggtccccaaccctcggtctgtagattggtaccagtccatggccagttaggaactgggctgcacggcaggaggtgagcagcaggtgaacagcattacattaactttgcgataagtgtgcctgagttctgccttctgtcagatcagcagtggttttagattatcataggagcgcaaaccctattgtgaactgcacatgcgatggatctaggttgcatgctcctgtgagaatctaatgactgatgatcggaggtggaagagtttcatcccgaaaccatctcctccctctcacccctcctgctatctgtggaaaaattgttttccacgaaacctgtccctggtgccaaaaggtttggggaccactgaactacagtatagatcagactctactgttacaagtacagatgatgtattagttctgaatactactgggagaaagattctaaaaagcagtcacagaaaaggtggtaagacaatttatgtggaccttgatttcaagactttcacaaatgaggagggagagaagataacttcaagtttggagagcaaatgagcatagggtgtacagtgataatgtaagatggtagatggtcccatgtgactaaattgtagggagaccctacatggaaagctgctgatgattatggtgggtgataggactgagtcttgtcagtcagccttgatattacacgtaagagtttggatttacaaaaaaaaaaaaaaagaaaaaagaaaaagacatctaggcattggggtccctttaaagatcaggtggaatgttttcctgatgttcaggattcttcctgcctgcctccctccttgcagaagaaaagataggtaggtataagtagtaggtaggtaaaggtatgtataagcaggtataattcaaaaggtatatgaagtacagcgaagtcattgtgttagataaaagcagaaactacaaaactgtaaggttttgcttattttgtcacgctctgcttctgtttttggtgttctgtggctcttttcgccgatcctttgtctcagcctcatttgtaagtgacttgttttttccatttctcatttttttttccatctattaaagtgaggggattggatcctagatcagttcaactggtgtaagcctttagagccaggcatggtggctcatgcctgtaatcccagcactttgggaggccaagatgggtggatcacttgaggccaggagtttgagaccagtctggccaacatgatgaaacctcgtctctactgaagatacaaaaattagccaggcatggtggtgtgcatgcctgcaatcgcagctactcaggaggctgagttaggagaatcacttgaacccaggaggcggaggttgtagtgagctgagatcatgccactgcattctccagcctgggcaacaggccaagaccctgtctcaaaaaaaaaaaaaatgcctttagaatgtggttagaaataatttttggattggtatagattaactctgaatgttttcctgtgttagaggaaggaagtgggataaatgtaaagtttaaaaaaaatgctcctttttcaaaattttgaggggttaggtattaagaatcttttaaagttttactcatttaaaaaatttagataaaatggaagattcattcttaaggttggtgatatcagaaatgtaagtgctgtgtcattgtcatttcttattttggcctacataaccgtaaccagacttcagacatcatgctgcctgtatcacatggctaacagtgggaggtatctggtgtgttcttcctggagaaatagattgaaattcatttggacagaaatgttgaaggcaggtgcctgatccaaaatgcatttagtcaggactgaacacaagctgcctggatagttcctgtaagtaagcaaggtagccttttaactttgtgatgcaaggttttatgtatgtgagtatgtgtgtgcaagtgtatacagtatttttatatccagagaacagggctcccttaaatggggggtgggggggactctggtaactacatgaaagtaaaatataacttctttaaacctatatcagtgtgttctttcatgtaggaatgtagctgtgtgatggcctcagctattctagtaatcaagggctctctgctgttgctaatcctatgatgaacaggacaaatggtggttacgaacagaaccctgtcaagcctggaaattccatcagtttgtaatagcacagctgttgtccttgaactgtgtagggaggaacctaggggtggacagttaatatattcttcaggggggttgtagtttattgctcaggatagtcaagatcttcctcagttgtctgttgctatctgcaagtctggtttggaggagaagcaggagaaattcagatttgtctgaggaatcatatgtgtctgtgaactgtgtaagttggtagttgattcctgtagacatccttgctaaagatttatttttaagtaaaatatcattttgcttgaaagtataaatcaaggttttgtggttaaataaattaaaaacagcacagctgccagacaaagttcagcttgatgtataacaggcctctgaaagaagttcagtaagaaacaaatctgggtaataaagttaattagtaactaaaaacctgctaggcatactaaaaaaaaatctgatgttgaatattaaattattatgaagcaggctatacctgtatccatcaagattataaatgatctcccacactggcgacgtggggttcctttcaagcctgaggaatgagcactatattttggccacagcattctcactaatgtcctaggatagcagcttagtgttggctttagaattctctgtcatttaaatgtcatgcaaaaacaaacgtataaaagaaaacattaacccagatatctttatggttccttgtcttgtccataaccgcccccgcccccacccacccaaaaaggacaggctatcagttatagagaaaatataagtgagcattataagcagtatcctacctttagtaataattatttaaagtttattaaatgggttgtttggaactcaaaatgatttgcctcaaagtagcctaggtcactgagaagaaagtttatttctttctgctgaaactgacaggaggcgatattttgaaagatagcaagcttgtctttggcatggtattaactccctttcttttgcctcctagggctcctgggcctgtataccctttccctactttgataccatatctatatctgctttattccctgaaagttcccatgttgccataatatttttcttcctttttcacaccagaaccaagaactcagacatcttcaatagaaccatctctgggatgaacaatggtctttccagggatgtacattttcttacccacttttaaattaagaaataggattctatacttttaaaaagagaatgctggctactgcaaatgaatgtcggtagaaatttggctaatgtgacacagtaaaatgaaggtttcctaacacagtggttaggaaaagtgagtatgatggtgggaatcaggcttctgttcttgctttttttttttgagtcagggtttcactctgttgcccacgccggagtgcagtggtgcaatagtggctcactgcagcctcaacctcctgggctcaatcagtcctcccacctcagcctcctgagtagcagggactacaggcatgtgccaccatgcctggctaatttttacatgtttttgtagagatggggttttgccattttgcccaagctctgttctagcttttcatgagttttttccctgcattttagctcccatagtagcacctttcaaggggtgaatagaagaggacagagacagcaacaggccattggtaaaccagattgccaatttctcatcagacagaatgagcacagaccccgagtgagtggctctagatgcgaatgacctaaaattttcaggaggacttcatggagcttaaaaggttcttcagaacttctgtgtaattaagttagatattaacactgtttaatctgtatagacctgtaaaatatttttagtacagtaattaattccagagtttgtgaactatccaaagtaaagcatacaacaaagtactgtggcctcatcatatatccttatttcctgtttatgagcacctagctcttaatagtgagattgtagtcaagagagtattttatcatcatgccatgtagttgcctcttgccttagtttacctattttaaaaaacccggctcactaatagtttcacttcaggcatgtcatcagaatgaaagatcagatatacaaagtgctgtgcttgaaaactgtgtgttcccttagtgcctggttagataatacagggcttattttctggcagagtggtgttgagtctcctttgatgttagccagaactgggtggagtttcttaagctccagtcagattggctcaagcagggcaccatgcagtggtgaatttgttttcagtccctccctttgccaaaaagcttttttttttttttttaataaacctcaacccaattataaatgagaatacttgatatatgaaataatatgaaatgatagttgttcatattcacactgagggtcttagggggtttatttatagctaactgaaatgatgcagctgaattacaagtagctgatagaataatcaacctcagtaaacatttaacataacactctcattttacagattagagaactcagccctgaaaggtgactcattcaaggccacagtgagtgtcagattaaactggtgcttcagtaaagcatacagacttctgtacccagctttcaaattctcttgactcttactcacaaatctatttaaagttaactttattatctgtatggatagaagaggaatagtataaatggtcaattggtcagtgagaggttttttttttagagtaaatgcttctcattcacaagggttcattttttgatcctcctgaacatccagatttgaaaataatagtgtcatatccttttatccataaaatatgtaactaagcatttaaggcataaccgaatagtaagtaacttcaagtgattctgtgtgagatgaaattcatacatgaatttattaaaattaattttggaatacttgaaccagtttaacatctatagagcatttaaagagtgtattgtacttatacatgtttcagaataaaataactataaaattggataatcgctttaatttattgaaaactggggatttctgggaaaaaaaaaacaacagtactttaacttgaaagatgacactagcattacctttctaggatcattttccataagggggtgtgtgtgtgtattttaaaatcatattctatttatgtggtgacaagtaaagaatagcttaactgttgatgaaatacagatgctaagtggctagctagatgtgctcatagcttcatgaccttcccactttccaattgtataattttctatcagttttaccctcttaggctgaatttcagctactgttcatattccatgaaccacatgcagcccaggaagtcatctgagagtgtgtggctgggggcggggtgggggtgctgagggttggataggggaaagattacaatggataaaagctgccctttgataatctgcattctgataaatgatatttaaaatgtattggtgtttttgactgtatttttaccctgtgccttaaatgaggaaaagatttgagtagattgcatcttatgtcattatgtatttctggggaaaattaaattttggatttttatggtatgttgttaaggatggcacagatgtccttttaagttctctttgaccatgaaactgatgcaggatttttgctccttagctcaactaggtccaggttcttatctcaggagcggaagaattaggcacgtggacatcaaagagtgagtggagtagaatctattaatcgaaaggaaagctcttagcaaaaagagagaacatggtaggtggttctactacctgaagacaggaaagttccgtaatatggctgagcctggggctctttattggttcagaatgggagtgtgtggtcattggtttgtgagtatgcaaaaaaggtcaaagcgaagacaccactccaaggtgggcaggacagtgtagaaaaccaattaggaaagggtaggtacaggttaaataggtgaaggatggggatcaatcatgccaaacgggaaggcaggttcttaatccgatctcaggatttacccaggacagtttccggattaaagttcgggtttcactgaggacccgcccctgtctgcctagacatttgtttgcctcttgcctctatcaaaactagttacagacgtcctttttagtttttggttcataacagctcccaaaggataactactaataatagttgtcagagatagaatagggaaatggcataaccgaatagtaaaagcaactgaatagttgcttttcatggaaccctttgacattataatctgttaggcttttaaaagctctttaatgaactcatttctcagcattttccctgtcatgatctggagttacaataatactttatatgtaaagtaggctggacgagcatagaatagggcttcccacccacattcgtctgttgtaaatgggtcacaggtgtgccactactactataggaacttttttttttttttttgagacggagtcttgctctgttacgtaggctggagtgcagtggcgtgatcttggctcactgcagcctccacctcctgggttcaagcaattttcctgcctcagcctcctgagtagctgggattacaggtgcataccatctaaataataaaaatcagtgcccagctagttattctgtttttgtatttttagtagagatagggttttactgtgttggccaggctggtctcaatctcctggcttcaagtgatccacccgccttggcctcccaaagtgctgggagattacaggctgggattaccaagtccagttcctactataggaaccattgaattcctatttatggttccttcagaaaagctgctaaatcctgaattcggcagtggttattcaaatagtggaatttataattccagtagtgtgagatggcatttgctgtggacaacagctctgtcatgccacaggagcccctttggcagcaaagctatcagtttttgtcacgagccccacactacttgttttagtcaggattctcttagagggacagaactaataggatatatctccaaaggagagtttattaagtattgatttacgtgatcacaaggtcccacagtaggctgtctgcaagctgagaagcaaggagagccaatccgagtccccaaaatgaagaacttggagtccgatgttcgagggcaggaagcatccagcacgggagaaagatataggctgggaggctaggcccatctcttcatgtttttcttcctgctctatattcgctggtggctgattagatggtgcccacccagttaagggtgggtctgccttccccagcccactgactcaaatgttaatctcctttggcaacaccctcacagatacacccaggatcaatattgcatccttcagtccaatcaagttgacagtattaacattacaagtccactccttgtcaacttgaacccatatacatctgagatcgtatgtaatcttaaaataaagacaataataaggtcataattacacctaatgtaataaaactatccttcatacaaccagaaacacaccaatccccaacccaaatactattacataaagttaataatacttaaatgctgttatgaaatcaataaatcttatgtcacatgataaaggaaaaggaaatataaagtgaagatattagtacatgtgtatacatacacaaacatgtttttaacaaatgaaggaggaaatactcatggcagttacagtcctcatttctgcagctggtcacgtggtcatagctggtattgatgactaccttcttctacccattctgtattaactttgccttccccaaatacctcagcaggtcatgggtttttttcctggtggagtgatccaaaccttcattcctgaatggtccggatcatttgtagtcctgcctggatttggctgttgtggttttgcattgacagtaatcacagggcatggtaatacgaagagatgccctaatgggtctcatgtattccatgcatactcttccttacttccgttgtgaagttgtagactgatttcatcttgatagtctgggtcagtcaccttagccaacactgtaactccccctctgagcctgttgacttaaagggaggaggagcccaaagtgtccaggtgacaatcttaacttccagtttaatggaatcattgttgtgtctcctggtggcagcattcttccctctggaattaagacctctaggccagcagaacataatgttgcaggagaggaagcaaaaattttgctagtggatcactaggggtgatggtgagtggtgccacttccagttccacccctcgattcctggacctgtgaatcctggctatgggagaaacagtaccttatattggacgctgattcagaggatacacggccttctggaggactttcccacagttctgcaaagtattgtcacctagttggcgttgtaattgtgacttcaataggccattccactgttctgtcaatccagctgctttaggatgatggagagcatggtaagaccagtgaattccatgagcatgagcctactgccgcacttctttagctgtaaagtgagtgccttggtcagaggcaatgctgcgtggcataccatgatggtggataaggcattccatgagtcagctgggtgcggtggctcacgcctgtaatcccagcactttgggaggccgaggcaggcagatcacttgaagtcaggagttcaagaccagcctggccaacatggtgaaaccctgtctctactgaaaatacaaaaattagctgggtgtggtggcgggtgcctgtaatcctagctacttgggaggcggaggcaggagaatcacttgaacccgggaggcggatgttgcaatgagccaagattgtgccactgcactccagcctgggcaacagagtgagaccccttctcaaaacaacaacaacaacaacaacaacaaaccaaaaaaacattccacaaatggtagtcttggtagaagcattgcatacaggataggcgaacccatatccagagtaagtgtctatttgagtgaggacaatcctctgccctttccatgatggaagaggtccaatataatcaatccgccaccaggtagctggctgatcacccaaggaatggtgacatactgagggcttggtgtcggtctctgctgctggcaaattaggcactcagcagtggccgtagccaggtcagccttggtgagtggaagtccatgttgctgagcccaagcattacttccatccctgccaccatggccactttgttggccatgggcgatggcaggggaaagaggctgagtggtgtccacaaaatgggtcatcctatccactagattattaaacccctcctccgctgaggtcacttgttggtgagcactcacatgggatacaaatatcttgtctttgaccactcagagaggtccatccacatacctcttccccaaatttgtcaccaagtttccaatcatgctccttccaagtccctgaccagccaaaccattggctacagcccatgaatgagtatataatcacacatctggccatttctccttccattcaaagtgcacaaccaggtgcactgctcgaagttctgcccactgggaagatttcccttcattgttgtccttcagggatgtcctagaaaggggttgtagtgctgcagctctccactttcgggtgttgtctgcatatgatgcagaaccgtctgtgaagcaggccctaatcttcttttcctctgtcagctgatcatagggaactccccatgaggccatcagtgcaggctgggagagagaaggcagggtggcaggagtggaggccatgggcatttgagccacttcctcatgtaatttacttgtgccttcaggacgtgcttgagcccgatcacgtatataccacttccatttgatgatggaatgctgctgtgcacaatccactgtatggctagatgggtctgaaagcacccagctcatgataggcagggcagttcaggtcgcatggtgacttgatgacccatagtcaaacattcaatttccactaaagcccagtaacaggccaagagctgactctcaaaaggagagtagttagctgtaatcagcactttgggaggctgaggtgggcggatcacaaggtcaagagatcgagaccatcctggccaacatggtgaaaccccatctttactaaaaatacaaaaattagctggatgtggtggcacgcacctgtattcccagctacttgggaggctgaggcaggagaatcgcttgaacctgggaggtggaggttgcattgagccgagatcgcaccactgcactccagtttggcaacagagtgacactgcgtctcaaaaaaaaaaaaaaaggagagtagttatctgtagaagatggcagggccttgctccaaaatcctagaagtctccattgcgattcacctatgggagcctgccaaagactccaaacaacatccccatctgccactgacacattaagcaccattggatctgctgggtcatatggcccaggtggcagagcagcttgcacagcagcctggacctgttgcagagccttctcctgttctggaccccactcaaaactggcagcctttcaggtcactcagtaaatgggccggagtaatacacccaaatgaggaacgtgttgcttccaaaatccaaatatgcccactaggcattgtgcctctttcttggttgtgggagagaccaaacacaacaacttatcctttaacttaaagggaatatctcaacaggtcccacaacactagatccctagaaattttactgagacagaaggtccctgaattttagtcggatttatttctcatcctctggcatgcaaatgtcacaccaataagtccagtgtgtttgctatttcttgatcactggatccagtcagcataatgtcatcaatgtaatggaccagtgtgatatcttgcggaagcgaaaagcgatcaagatctctccaaataagattatgacacaaagccggagagttgatatacccctgaggtaggacagtaaaggtatattgctggccttgccagctgaaggcagattgcttctgatgggccttatggacaggaatagagaaaaaggcatttgcagagtcagtggctgcatagcaggtaccaggagatgtgttaatttgctcaagcaatgaaaccacatctggtaacagcagcagcaattggagtcaccacttggttaagcttatgataatccactatcattctccaggatccatctgtcttctgcacaggccaaatgagagagttaatggggatgtggtgggaatcaccacttctgcatctttcaagtccttgatggtggcactgatctctgcataccttccagggatgtgatattgtttttgatttactatttttttaggtagaggcaactctaagggcttctatttggcctttcccaccatgatagccctcaacctagcagtcagggagccagtgtgggggttttgccagctgctaagtatgtctatgccaattatgcattctggcactggggtaatgaccacaggatgagtccagggacccactgggcccactgtaagtcagacctaagctaaaacttcattaattacctgacttccatgagcccctagtttaactggaagaccacagtgatgttttaagtcccctggagtcatcatcagcccagagccagtgtccagtagtccccaaagtgaaaggttggatggaggtctccttggggaaggatgggagaaagattcactgcataaattgtcagtaaagtagtggggtcctttctcaagggtacctggcctccccttcattcaaggggttctgggtctgtaaactggctgaagtctggaaatggattgagtgaggggccatgattctctttttataattcaaattagtcttttgtccattcgacctagaagttttgtgtttgtataaattaagtgggaatgcagtaggcttcctgtccgtttcacttctaggaataccgtgattaattagccaatgccagagctctacatgagtcagactattctgattgtcactttgcctctgctgtccattacggtagctacgcccaccttgcctttgatggttgagtgctgctacttggcccctgccaccttgggatccagttattcccctcgtatttcaattttgtaattgagtgactgcggttctcaccattaggtctgacatgcagagaagagcaattacagggctcttcaaagattcaagtgctgccctcacaaatctatttcacaaggcattggtcaagggtatatcttctggaccctcccagctgggatgagtaggtctaaagtgagtaatccactccaccacctcaatctccctaagcttttggatgccttcctctacattaaaccaagagatatcaggcatttccagctccctcacagtgggccatcttttaatgcatatttcagctaaccaagcaaataaactattagaaccttattttaactccccgagctgcaacattaaatgcagagtccctacttagtgggcccaaatcaataaattcagcctgatccaactctatgttccttccaccattatcccatacccttaatacccattcccatgcctgttctccagattgctgtttatataaattagagaacagttcttttttttttcttagagggagtctcgttctgttgccaggttagagtgcagtggcacaatctcagctcactgcaacctccgcctcccgggttcatgcaattctcctgcctcagcctgccgagtagctgggattacaggggtgcaccaccacgcccggctaattttttgtatttttagtagagacagggtttcactatgttggccagactggtcttgaactcctgacctcgtgatccgcccacctcggcctcacaaagtattgggattacaggcgtgagccaccgtgcctggccgagaacagttctttttgagtgtagcgcacctcctcctgggtcacactctcaacctcacctctagggacctgtgggacttgagttataggtctagaagcaaatgggtgttgcaggtaccttctaaggagaatcaacattatcttgcctggcaactgcctgagaggaggccatgactcttgcctcaggcagctcagggtttatgtccgtagacaaagatggaaaggttgatggcggggatggggggttatgctgccactatgggggatggggaagctgttccttctggcaaaaaaagttcaccagagtttataaactcagtgttcccagcttcatcagggtcctcccacacatccccattccaagtttctgggtctcattcttttccaatcaatgccctcactttagcagtagacacctcaggtggctgtgcatgcatcttttgttgcaggtcagccactcgcatgataagagcttatgtctgtttttccacaatttcagctctttctcaacaggagctaagactctcactcagggcaatcttagcagatttgagactcagtatctgcttctgaagccaggaaacagaatccctgagttcatcattttctttcatcactttgttcactgaacttaggagcaaccaaccagcttcattatgttcgttggttttccacatatggtcaaaggtattatgtatagagtcactaaagtccttacctttcatgagcagtgaatcaggagtgtcaaatgcatttattttgcataactctctaaatagttcacgccaaggactatgaatgttctccatgctattagaagtagagtcctcagcatttttggatcaatcatattaagcagccaactccagaaacccccaaaccaacaaaagaactccatccttaacattctgttcctctggaaccactcctggtaccagagtctgtgttagtctggggtcagagttttcttagaggaacagaactaataggatatatatgtatgtttataaaaagaggaatttagtaagtattgacttacacaatcacagggtcccacaaaaggctgtctgcaagctgaggagcgaggaaagccagtccaagtcccaaaactgaagaacgtggagtccgatgttcgagggcagaaagtatccagcacaggagaaagatgtagactgggaggctaggcccctcttgcctcttcatatttttctgcctgctttatgttcgctggtggctgattagatggtgcccacccaattaagggtgtgtctgccttccccagcccactgactcaaatgttaatctcctttggcaacaccctcacagacacacccaggatcaatgttgcatcctttattccaatcaagttgatgctcagtgttaaccatcacactaataaaagtgtaattcttgctgaccaaactgagctgtgggctaagatgggagtggaaacagctctagacaaaagggccatagactcttcctggtcttaaccaaagctcaagcagatttcgagaatgcaaagcttctcaacttgtgttctacagtttgttgatgtccagtgctttggaatggctgatcataacagttttgtacaatttaatatgttttttttttttttttttttgagaaggagtctcactctgtcacccaggctggagtgcagtggcgcgatctctgctcactgcaacctccacctcctgggttcaagcgattctcctgcctcagcctcccgagcagctgggattacaggtgcccaccaccatgcttggctaatattttgtatttttagtagagaggaggtttcaccatgttaaccaggatggtctcgatcttctgactttgtgatctgcctacgtcagcctcccaaagtgctgggattacaggtgtgagccattgcgcccggcccatatttacttttttatggagaagattcaacagcttctttatgacatctattattaaactctctcagtgcgtgtctttctttgacataatttgctcttgtcgctatttttcttctaacagactgattaaattggatttaactttattatagttattagatatttctaaatggaattaaatttatttatttatttatttatttatttatttatttatttttggccttaatgttaacagccagagtgtgatttattttttacttatttatttaaaagtttttaaatttaatttttgttttttgagacaaattttctgtcacccaggctggagtacagtggtgcaatctcggctcactgcaacctccacctcccaggttccagtgattctcatgcctcagcctcctaactgggaccacaagtatgtgataccacgcccagctaatttttgtgtttttagtagaaatggggtttcaccgtgttggccaggctggtctcgaactcctggcctcaagtgatccagctgcctcaggctctcaaattgttggggttacaggcatgagcctctgtaccctatttattttttatttttatttttaaaaattttttgagacagggtctcactctgtcacccaggctggagtacagtggtgccatcacaatcatggctcactgcagtcttaaactcccgggttcaagcgattgtgacacttcagcttcctgagtagctaggactataagtgtatgccaccgtacccagctaatttttttttagtttttgtagaggcagggtctcagtatgttgcctagctggtcttgaattcctagtctcaagtaatcctcccacttcagcctctgaaagtgctgggattacaggtgtgaaccaccacgcctggctcagagtgtgattttttttttcttttttttttctttttgagactagagtcttgctctgtcacccaggctagagtgcagtgatgcaatcgtggctccacacctggagttgtggtggctattcacagacgtgatcattgcacactatagcttggaactcctagttacaatctccctgccccagcctcctgaaaggctagaactacaggtgcatgccaccacatctgggtcacacgtatcttttgacattttttgagacctaaatgaacttcatcaaattccaagtagtatgatgacagagtcgcatgaacctgggaggtggaggttccggtgagctgagatggtgccgttgcactccagcctgggcaacaagagtgaaactctgtctgaaaaaaataaaaaataaaaagatatgatttaggaactcattagtatagtcacaggaaatttaaatatcacatttgctttaagaaaagtaagcaggctgggcgcaggggctcacacctgtaatcctggcactttgggaggccgaggtgggtggatcactttgaggtcaggagttcgagaccagcctaaccaacatggtggcaccctgtctctactaaaaatgcaaaaattagctgggtgtggcggtgcgtacctgtaatcccagctactagagaggctgaggcaggaggatcacttgaacctgggaggtggaggttgcagtgaggcaagactctgcctcaaaaagaaaagaaatcagagaaacagctcttttctactacatttttgtataatggtactacctagaatttgaaaagataatcatttaaaattattgatgaggaattaaggttgttatttcaaataggaaaactcataaaattaggcacatggaagaaggcttaaatttatttgaaatttttagattttatttggaagtctatataaatataattgattatttaatatctttccaaatcttggtattgtatttttttcttagataatataaagaatatgtaatgaatgttttcactaagctccatataggtagagacaaactatctccagcattcccagtactgaacacatactatcttttttttctagacacttgcctagaagatgtagatcttgcccctggccttaattatcctgtctgtacttatttgggtatcggatcttgattcttaagcctctgtgccaccactctaatatatagcaacaccctttgcttgttggatttgggaattgggggtacgatgacttctgatttttcagggtctggaagtatttgctttgtacatgttttgtaatcatggtagcctcacagcatgtaagtgggaggagaggagtgtgtgggaacaaagatgaagataaaataagaaggaaggaagataggaccatattccttgctttaattctatttctttttcctaagtacatttgttggagagaggtagacggtggataacagcttgaaaggaaagcctgaaaattaagtggcttgaatcatagtatatttttactttttcaagtttgggttggagaaagactgtgtattagttgagattcttccattgtaaacaacagaaatagattggctaaattaggcaaaagaaagatgaaggccgctcacttagacttgaagtagtcaaccagggcaactaaatagctgtcactcatggacttttcttccagcgtgtagtcaataaatgatcctttccaactgtcttcttcttgacttctgattgacccaactctagtcatgtcccaaaccctataggggtagggattggtttgtattaggggagataggaagaatagatttctggacaaacacaagtagtggccattacattgtgcaactaaggatctgtttgacttgtatttaccttgtcaacaacatagcttatatgtcaacttatcctatggagtctcttggagtttctgttagactttttgaaagcaggcgtagtaccttgcacactttatttcctattatgccctgcatttgaatggtgcccaatttattgcaggcctttggctcttttttttttttttttttttttttttgatgggggagtcggagacttcctctgtcgcccatgctggagtgcagtggcgcaacctcggttcactgtagcctccatctcccgggttcaagcgattctcgtacctcagcctcacaagtagctgggattataggtgtccaccaccatgccttgctaatttttgcatttttagtagagatggggtttcaccatgttggccaggctggtcttgaactcctggtctcaagtgatcctcctgcctcggcctcccaaagtgctgggattacaggtgtgagccactgcacctggcccctttggctctttttactacattatttctgtattttctaggctattcacctatggtttgcttatagatttactttttttttttttttaaactttattttaggttcaagggtatatgtgaaggtttgttgcataggtaaacacatgtcacaagggtttgttgtacagattatttcaattaagtctagtacccaatagttatcttttctgctcctttccctcctcccaccctccaccctccaggagaccccagtgtctgcagtttctttgtattcgtaagttatcatttagcttccacttacaagtaagaacatgtggtatttggttttctgttcctgcgtcagtttgctgcggataatatcctcctgcttcccatctatgttcccacaaaggacatgatctcgttcttttttatggctgccagtagatttacttaactgcagattatgtaattaagaagctggtagtctgtaaaaatggtaatatacgtgactacagagagggaccatctcccttagctaattgagggaaacgtgtctttttttttttatgctggcagggctaagtagtttggttgacaggactatccacaagtgattcatgaagaagcaggtactcactccaagataagatccatactcacagtctttggtcaagaaagttgatttcatttgtccgatagtaatgtaactatgtaaagacctgatttgaatcttactggctatagctttggatatgttgattgtggggtttttttacacctcacttttcttataaatagaaaggacacaattgcaattgctttgtcctgccaccaccacctccctccacccccagaaatgtgagaaaagagtaactagcggtgagttaccttgggtcagactgtccatttcttagctttatttttctcatctttcaaatgagggagcctcttctagctgtaaaatcttagattttgattcttttgtttgtttcaaacaattgacaagagtttctagaaatgtttttccttttgcagtgctcgttacatgaaagatctttttcctcttcaccaggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaaggtaagtatttaaaccagactgcttatatatgttcagaaagcaggttagggattatgcctttggtataatcttggaaactgagaattgagctgagtttttttagtgtaggctagtaactttatgtttctttgttagataccgaggaggtagacttaccaccctttgagtgagcgttcatgagtctgtggatgacttttaaccctaatgtttcttctctaatgtttcaacaaccatataatcttcttcttaatttcctaaattaaactgtctactgtgccttttctctgaaagtagctttgaaaagttaaataaaattctgcggttatatcagaacttcatttagactggaatcagatgccatttgttgtctttggagtcatcccacctcaggattaaagcataattaaagcctttaagagaaatttgccattttcctggatcagatgtgctaataattggctgagtatttttgtatctgtgttcatgagggaattggtctgtagttttctcataatgtcttctgtccagttttagaattgaggtcacgccgacttcataaaatgaattgggaagtgttcccttctttctcttttctagaatagtttgcatagaattgatattttttcttcttttcagtgtttgatagaattcatcaataaagctatctgggcctggaattttctgtcggatttttaaactaggaatttagtttctttcagagatcatagaactattccagttatctgtttcttaagttagctttggtagtttgtatctttcaaggaattccttggtccctttcctggcataaatgttgcagattaatggagatatgcttttaatgtctgtaggatctattatgtcccctttttcatttcttatactagtaatttgtgatgtttctttctttctttctttctttctttctttgataagtctaggtagaggtttatcaattgtattgaaagatccagcttttggtttcattaatttttttctattgtctttctgtttttaatttcttctcatatctttgttttttcctttcttctgtttacttaagttgatttattctttttctggtttcttaaggtgacagcttaaatcaggttttgatctgagacatttcttttctaatgtaattacttaatgttataaattaccctctaatcaccattttagctgtgtcccatggattttgatatgttgtatttttattttcattcatttaaaaatatttaaaaatatttcctttgtgaattcctctttgtgtctgcctttaagattttatctttttttttttttttttttagcagtttaaatatgttgtgtttagatgatattttggaagttttcttcttgggcttttctgagcttcttgatctgtgcttttgaagtggttaagtcagctgggaaatttttggccattatcttttaaaatatttcttctgccccattctttttcttttctcctgggattccaattatatttttgttaaattgttggatagtgtcctgtatctcttggatgcattgttggtttttttctctctttatttctgtttgtgttttactttgggtactttcttttgacctatcttccaattccctgatcttttcatagttgtgttgaatctaatgatgagctttcagtggcattatctactttagcattttttatgtttttaatttctagcatttctgtttgcctctcttataagcttccttatttctgtcaaaatttcccatctgttcacctatgttttccaccttttctactgtagactttaacatattaatcatagttgttttaaatctctgtgtgataatttgaaaatctgggtcatctctcagtctgattgctctgtgtgtgtgtgtgtgtgtgtgtgtgtgtgtgtgtcttagtttttgattgaatgctggatctcacatgtaaaatagtaggctgaggccaaaaggtgttatggttggaaataggcatgtctcttgggtttagtcattttaacaggagctgagctagttttgggttttgtcattaccgtaattgccttcagtgtactactgtcttcaatccctttaattctatgcttagagtggggactgaggccctggaaggtatttctttaatgtgcttgctccactctttcagccttccctgtgtacccgtgcctcagaggggtccttgtccatgctcttttctctcttatcggaagagttctagccaggtggcaggcagagtttgtttttttattgtcccattttgtgcttaatcctgtgcttaatctcacggtttgggtctttctcaacgttattatccttttcacagtagtagcgtcttctcatggtattggtgtaggatcctggatgaggagtttttcttgctcctctctcaggtttataaagtatgtttctattactctttccctagctacagccggtcttcttgtgtgctctggggttgacagggtttgtactccttccccaggagagaaagatcccagtgggaggggttcatgcttttcccttaatggtggtggccttctccaggtctgtaccatggagggaggctctgtctggtccctcaccctgcttccaatctttcctgtgagcatgcggcagacatctgtgaagacaatcctgcaaatgagtgtgaattccctttgtgtctgtggatttgaggggccccatagtctcatgctagccttcatttacctttgacaaatcactacaatttttacttgaatttttcttacctgcttgtagggtacccaatgtctcttctgcacatgctctgatacaggagagctggtgttcacctcccatatttcctggaggggcttgtttttctttggatttcatactactaggtggctttccaattaattcaagttttttgtagttgatatggctgtttcttgttgttagggtgggagtgacgttgcttttggctttctacagccaagtggaagaagaaaacctgcttccttaatatatgtttaatttgtgtgttggggagggggggcagaccacaactcatttaaaaaagtaccgagagttctaattatatccatataaatatttactccagaccaggtgcagtggctcacgcctgtaatcccagcactttgggagaccaaggcaggtggctcacctgaggtcaggagtttgagaccagcctggccaacatggtgaaaccatacctctactaaaaatacaaaaattagccaggggtaatggtgtgcacctgtaatcccaggtactcaggaggctgaggtacaagaatcacttgaacctgggaggcggaggtggcagtgagtggagagcgtgccactgcactccagcctgggcgagagaacgagactctgtctcaaaaaaaaaaaaaaaaaagaaaagaaaaaaagttgctatcattgcttacaaaagtatcttgatgttgcaaaagcttatgttgagaagtaaagttcatattttatttttatcctttaattcaattttccagaaactcatacattttttgaacaggctaaaaaatacacatgtacaaaatccaattggtccaaagggatgtacggtaaaacaaattctcccaatccctacaccctagccagacagttctccttcctggagtaaccactcgccaatttctggagtagtctttctgagttaatgaactttttttttttttttttgagatggagtcccgctctattgcacaggctggagtgcagtggcacgatctctgctcactgcatcctccgcctcccaggttcaagcgatcctcctgcctcaacaccccagtagctgggattacaggcctgcaccaccatgcctggctaatttttgtatttttagtagagatggggtttcgccctgttggccaggctggtctcaaactcctgacctcaggtgatccacttgccttggcctcccaaagtgctgggattacaggcatgagccaccatttacatatcaaaagtagcagggaggatttaattttttataaataaaataatgtcttaaaaactttcctcctcttgggccaagttaatgttacatggatcaaataactcaagatgaagcacaagaaaatctactgctaccacctcactgtccttatccacctaggctcattcccagatgatggaaacaatgcacagttaaaggaaattagaaaacgaaaagcagctagcttctttcacctatgactgatgagggtaagttaatattaggatgggaagagcatctcaaccatgactagttgctaccatatttacatcttatcattcctttcttcatactaggttttctttgtttatgttagtcagtcaaagaacaaatgtctccaccgtgcattatggattaagagagaatagattttcccgttttccattaaggaatccaaattttttggagtaaatatttgtttttcttttgtgctgggattataggtgtgagccactgtgcctggcttttttacattattaaatgaagaaaaatgaagaaatgaagaaaaatggatgccctttaaagttttttttggtttaagtttttaattttttgttgctaccaaagatttttttaaagattaggaaacaaaaaagaaggaaccaaatcaggactgttgtaaggtggttgcctaatgatttctcatcaaaactgtcacaaattatctttgttgatgaaaggaatgaacaggagcattgtcctggtggagaaggactctctgatgaagctttcctggctgtttttctgctaaagcattggctgactttctcaaaacaccctcataataagatgttgtcattctttggctctccagaaagtcaacagacaaagtgctttgagcatcctaaaaaactcttgtgtttgctcttgactgatccacttttgctttgactacagcacttacgcctcttggtagccattgctttgattgtgctttgtctttaggattatactggtaaaaccatatttcatctcctgttacaattcttcaaagaaatgcttcaggatcttgatcccacttgtttaaaatttacatcgaaagctctgctctttgcagctcatctggatgcaaccattttggcaccagttgagtggaaagtttgctcaattttaatttatcagccaaaattgtataaactgaaccaattgagatgtctgtggtattggctattgtttctgctaattgtcaatcctcttcaattagatcattcttttttcctctcaaattgatattggtggtctgccacggtgggcttcatcttcaacatcatctcctcctttattttttttctttttttgagacagagtcttactacattgcccaaattagagtatagtgactatttacaggtgtaaccatagcacactacagccttgaactcctgggctcaagtgatcctcctgtctcagccttccaagtagctgggactataggtgcggaccactgcatctggctgatgtcttaaaacaagttattcatgtgtaaactactgatttgtttggggcattgtccccataaactttacacaaagcatcagtgatttcaccattctttcatccaagcttcaccataaatttaccatttgcttttgcttcaattttagcagaattcatgttgctttattaggggctcttttcaaactgatgttttatcctttttagtgcttcaaactagatcctgttcagacgtgttataacaagttagtatgagctttttttttttttttttaagatggagtgtctctctgtcacccaggctggagtgcggtggcacagtctcggctcactgcaacctctacctcctgtgttcaagagattctcctgcctcagcctcctgagtagctgggcttataggcacatgctaccatgcccagctaatttttgtatttttagtagagatggggtttcgccatattggtcaggctggagtatgagttattttgatacaaaaaaactcccttgaaatccatgaataattttttcatagaatgcattttccacgaacttgttgaagataccatgtttaaagtttataattatagctgggcgtggtagtgtgcgcctgtagtccgagctacacaggaagctgaggtaggaggcaatcacttgagccccagaggtcgaggctgcagtgagccataaaagcaccactgtgctgcagcctgggtgacagagagagaccccgtctctaaaaataataataataataaagtttataattatgataggttgtaaattactacattttttccataccagcttcctaaaagttgtagaagtcttaacttaaaggaaggggtgatggctgtttggagacatcaaataagaaaaacgaaggaagccgccttatttagtcttgtagaaatctggtgcaattagtgagttctttatgaatggagacttctctgctgtgggtctgatttttatacattatcggactgatggtttttgccataatgacaggtttcatatttgtgtttttcctggagaacattctaaacaagatgttcttctgaatacatctttagaagtgatggaagggccctagacttcattaatgttttattatacatctaactttaagtttgattttgttcttagatgaggttcagtaaactactgctgattgctgacactttttttttttttgaagacagggtcttactgggcgcggtggttcacgcctataatcccagcactttgggaggctgaggcgggtggatcacctgaggtcaggagttcgagaccagcctggctaacatggtgaaaccctgtctctactaaaaacacaaaaaaattagctgggcgtggtggtgggcacctgtaatcccagctactcaggaggctgaggcaagagtaatcacttgaacccgggaggcagaggttgccgtgagccgagatcgtgccattgttgcactccagcctgggcaacaagagcgaaattccgtctcaaaaaaaaaaaagaaaagacagattctttccatgtcacctaggctggagtgcagtggcacaatcatagcttactgcaacatctaacgtaactcctgggctcaaacgttcctcctgcctcaggctcctgaatagcttggactacaggtgcgcgtgccttgcttatccttttatttttatagcgacagtcagactgtgttcctctggctggtctggaactcatggcctcaagcgatcctcctgccttagcctcccaaagcactgggattacaggtgtgagccaccacacccagcctagtgctctcgatatgttcttacaacaggcttagttaggccaaccagtggaagtttatcaaccattttcttgcctctagatatagaagggacggttgagtaggttacacataatagaactctttgaacaatggtgttttatttcctttaattcttacatgtccaccctaattgtcttcaacttataaaatgagaagtaagaaagcagggttgcttttatggcatttatgacaaagtaggaaaattgcttttttctctaagtatgatttctgccttcatgcctggcaacacaagaaccccccgacctttattccttttctttggatctactatactcatttccttttgcacttcaacttattcttgcttctacaagtattttatcttagcattgcctgtgtaaaccatctaaataccaatacctagaaataaaattggtgtcaaactcttcttctaaaatgcctatcaccttgggaaacaattctcaaatactttttcaggatatgtgtactacttgttttgcaccacggctgtaataagaaaaaaataaaaagaaaattatgtacttcctgacttttttccttaaaaaatggtgttttccttaattgttcattatcagcattatatggccctattttctaggtgagggagacaaaagatagaaccctttctcttagatgtgaatgacgaagcaaacatctgtgactcttgttctttcagatgatcatctagcacagtattgaccctcagacacaaatagcacatttatggaacaagtcacttaatttttctgttctctgtgtgattaaatagttcttcttctgaagtcgagaaaatgctttctcctcaacattccataaggcctttgaagctaaaagcttattcccatagaataagaagttaacacagggcaatggcctggctaagttttttgcatttttagtaaagacaaggtctcactgtgttgcctggactggactggttttgaactgctgggctcaagtgatcctcctgccttgacttcccatagtgctgggattacaggtgggagacaccgtaccctgccacacaccagcagtctgttttaacaagccataataggtgactcggatacacatgcatgattgagaaacactaatccatggaaaagggcctaagtgacaactattaatagatactgcagaatttctccttaatacactggtatttcttttgcagaaaattgcaaccagcttaattggccagtagagggcagtgttggcatgggtctgacagcaccagagggttcccttgcattgagacctggctgttttgcccaaggctgactcacagcacacatgccttctcaggttcttgctacttctctgccaagctgatttgcctgctgtgggaatctgacatctcctggggagagggaatcaacaaaataaagtaaatttgaatatctttatatctcagagaatgtgattagtttctaaaaaaaaaaagtgtgctattttcgatgctgtgtgtatttcactgagaaagttttcatttcatgaaatgggggttctctggggaagtcagtcagtgagaaaacacattatagcatcttttgaattaggacttttccagtaatgtgcagtatgattagggtccagtatgtcttatctggcagggaaatatacaagccttttttctacttgtcaaccttattgtttttagtgttgttacgttgtttttattctctcctgggcttatatttttagattgtgaggtgttgtatgtatagtagaatccagcttctcttcttcctttctaacctcttcttgctttcattttattttattctagtaaagtttcttgatcagcctacagttattctataggtggttgatagataaatttacagttggtcaacatatagttaataacagtgagaataacaatagctaataacagtgagaataacaattactatttagcactgtacagttgacatcctgtattactgcatttagtcccacttcccaggtgaagcttaagtattagaaatgagaaggttgcatttgatcatttagttaataatgacagcacaacctgaacccagatcttctaatctcacttttatttttattaaacaattaaaacaatattttttaaatagagatgtggtcttgctatattgcccaggttggtctcaaactcctggcctcaagcagcccttccgcctaggcctcccaaagtgctgggattacagacatgagctactggatcttctcattttaaacccctgttctggctgggcatggtggctcatgcctgtaatccccagcactttgagaggctgaagcaggcagatcacgaagtcaggagttcgagaccagcctgatcaacatggtgaaatctcatctctactaaaaatacaaaaaattagccaggcgtggtggtgctcaccagtaatcccagctactcagggggctggggcaagagagtcttgaacccagaaggtggaggttgcagtgagccaagatcgtgccactgcattcaagcctgggcgacagcgagactccgtctcaaaaaataaataaataaaataaacccctgttctttctgtgaaactatacctttttcatgaacacatactttctacttgatctagtatctcactgatagtttttaaaaactaaaaatccattttttaaattcaaatagaattattagatgtatgttcaggaaatgtaaaagaatcttgcttcatttcaatacagagcacaaactgagggactctgccactaattcacatgagtttgtaaaatatttcactttcctagacaactgtttcacatctactctctgaaacttctggcacttgctctcctgttcatattcataagtcatattcataaattaattggcttaatcagaacagaacttccacatggtcccaccacatatttcctcctcacctatgttcatctatgcccttattgtctgctctttttctgttatgggtgaactgttcatgctgtcactcaggccactgctgtcacagttacctcttctgtctcctgcatcatcagttcttttctttcaattgggtcattcaccagcatcaaacatactataatttttttatcattaaaaaaaaaatcctgtctgaatctcacatccatctcatctatctttttgctttgctttctttttttttttttttgagacggagtcttgctatgtcacccaggctggagtgcagtggcgcgatcttggctcactgcaagctccgcctcccgggttcacgccattctcctgcctcagcctcctgagtagctgggactacaggcgtgtgccgccacgcccggctaattttttgtatttttagtagagacggggtttcaccgtgttagccaggatggtctcaatctcctgacctcgtgatccgcccaccgtagcctcccaaagtgctgggattacaggcgtgagccaccgtgcccggcctgccttcttttaaagagacgtttctactacctgtcaccaattcctttccttccatttcctcttgaattcactctcatcagactttaacatatgcatgaccccaaaacttctcttacctaaagtataaggccttgatgttgccaaggacaaatccagtattactccaggggttttgcctgagcaactgaaaggaaagaattgccatcatctgagatggggaaagctacagaaggagtaggatttgaagggaagagaagaaatttagcttgggatatgttcacatttagttacctgctagtcatcgaaatggagaagatggatacacagataaggagtccggagtttggaggacggttctgggctggaggttgatgttatataaagcttttgctagagttgttgttctaaaatcctttaagattggatttagatgtaactttccagaacattccctgacttctgttccctttcccttctagacctcccactacccccacaccctgccagcctttcttttcatcttcctcttggtaagtgcttttcttccctgaactttcctctttcctctgtggtacttgtaagatcataattaagctatttgttatcttacacttattaacatgctctagcacaggaataatattttgtttactgccatatttcatggagaatgacacatttagcgaaagcaggatggcacagcataatcaaagtttactagcgacctcaagtttctcagggttaagaaatcaaaggttacagtgacaagtgaccggagagaatcatggagaagcagatcaagtgaaattatgaagaatctcatggtttgtgagaaactgagggcgcaggggtactgagaaacctggccagatctgcattagagaccactgctcttggcacatgatagatgtgtaatcattgcttattacactgaattgaaatggtttttgtttgtcagtttattcaggtttgggttgtgttaatgtacagactaacaaacaattgtgtctccaaaatggtagatatttatttagggtaggtgtacttggtctaatcctaaaccctcttaatagtctcatgatcatatttagggaagtttatatatatgcataaaaaattagtgtgacatttttgcaaaaatagttattttctgactttgatttgaaaacagacttttatctcataactaatagttctttttggggaaaaaaaatatcgtaccaaaatgtatagttcataataatagtaccctagtctgaaagaagagcaggggaccgggacccgggggctcaagcctgtaatctcagcacttgggaggccgaggcagatggatcacctgaggtcaggagtttgagaccagcctggccaacatggcaaaaccccgcctctactaaaaatacaaaaattagccaggtgtggtggcatgcgcctgtaatcccggctgctcaggaggctgagaaacgagaattgcttgaacccaggaggtggaggttgcagtgagctgagattgtgccactgcactccagcctgggcgacagagtgactccatctcaaaaaaaatacaaaaaaaccccccaaaaaacaaaaaacaaagcaacaaaaaaaccacttcattgctaaaaatattctgcaagcaagccaggatggtggtatgtacctgtagccctgcccgagctacttaataggaaggaggattgcttaagcctaggagtttgagtccagcctgggtaacatagcaagaccccaaagaccccacctcttaaataatattctgcaagcaaatgactttgttaaacttcacactgcaagaacagagccaagaacctaccatgtaccctttacttggatttatcattactgttttgcacatttgctttatcattcttgttatatttacatatagttccttccccttggattatttgagaacaaactgcagaactcacacctctttccccgaagaactaggcattagcacattacaagaatacgatgatagagatcagaagttaaatgctgatgagatattcctgtctaatccacgaaccttatttcattgtcatcagttgtcccaacagattcaacacattcctttctcatttttttcttcttgtctgcaattaaatctggaatcacgttagttttcatgtctcttcagtcttctttaattggaacagttcctcaactcttctttgtctttcatgaccttaatattttgaatagtatgggcaagttattttttagaagtcccctaatttgggtttgcctggcatttcctcataattagattcaagttccacatttttggcagtagtactatgtaaatatgatgtgtcctaagtgcaccacatcaggaagcacatgatgtcactaaatcacattattggtgataataactttcatcacttgttagtgtctgcctgttttctttactgtaatttttttccaattaaaaaaaagcatttatttatttagagacagggccttactctgtcaccctagctggagtgcagtggcacaatcttggctccctgcagccttgacctccccaggctcaagcagtcttccagcctcagcctcccaagtagctgggactgcaggcatgcaccaccatgcctggttaatttttttttttgacaaagtcttgctctgttgcccagactggagtgcagtggcaccatcttggctcactgcaacctccgcctcccaggttcaggtgatcctcctgcctcagcctcccgagtagctgggattacaggcatgcaccaccatgcctggctaatttttgtatttttggtagagatggggtttcaccacgttggccaggctggtctcaaactcctgacctcaggtgattcacccacctctgcctcccaaagtgctgggattacaggcatgagccaccccccagcctaatttttatttttattttttaattttttttaagacggggtctcactttgtctcccagtctggagggcagtggcatgatctcggctcactgcaacctccgccttctgggttcaagtgattctcctgcctcagcctcctgagtagctgggattacaggtgcgtgccaccacacctggctaatttttgtatctttattagagacaggttttcaccatattggccaggctagtctcgaactcctgacctcatgtgatctgcctgcctcggtctcccaaagtgctgagccaccacccctggccacctggttaatttgtgtatttttttttttttaatagagacagggttttgtgatgttacccaggctggtcttgaactcctgggctcaagccatctgctctccccaccctcccaaagtgctaggattacaggcatgagccaccacgcccagcctctttactgtaaaatttatatttttctccttgtaatgaataagtaatttgtgaggagatattttgaggctatgtatgtatcctgtatctaatccaactttcacctactattttagtatctaagcaaatagcttttgaataattttctggtttccaagccagttgaaatgtgttctgctgcatcttatatgaaagtcacattttatgaatcagaaattcccttttgcacattttaggtcaaaaataccagggaggccgggcatggtgactcacacttgtaatcctagctctttgggaggcagaggcgggaagagtacttgaagccaggagtttgataccagccccagcaacacagcaagactgcatctctacaaagaaaaaaaaaataaaaaattaactgggtgtggtggtagtcttaactactcaggaggctgaggcaggaggaaaggcagggagaaagtaaacagatatgtgcaaatgagacttccattatgcatattattcgcaattaaatctcattatttatgcccttcactggaaaaaaaaattacctttaattgcacagatcatttataaaaagactgttggagttatgctccaaagcccacaatgacagagatagtgtgtcagagggacacaggagtcaactgaaagagttcccaatagccaacactggaaaaatttgagcaacaaaataaataaagtagcattgaattaaagctcagtggacgaggctgatcatggtggctcacgcctgtagtcccagctacttgggagactgaggcaggagtaccacttgagcccaggagtttgagaccagcctgagcaacttagtgagaccctgtctttatacaaatagaattgtctgggcgtggtggctcactcctgtaatcccagcactttgggaggccgaagcaggtggatcacctgaggtcaggagttagagaccagcctggccaacacggtgaaatcctgtttctactaaaaatacaaaaaattagccgggcatggtggcacatgcctgtagccccagctactcaggaggctgaggcatgagaatcgcttgaacctgggaggcagaggttgcagtgagctgagattgtgccactgcactccagcctgggtgacagagggagactcagtctcaaattaaataaataaataaataaataaataagccaactgtggcggtgcacacctgttgtcaccatatacttgggaggctgagggaggaggatcatttgaacccagcattttgaggttacagtgaggtgtgattataccactgcattccagcctgggcaacagagcaaaaccctctctcttaaaaattaagtcaaaatctttgccgggtgccatggctcatgcctgtaattctatcactttgggaggctgaggcaggcagatcacttgaggtcgggagtttgacatcagcctggccaatatggtgaaaacctgtctctaatgaagataaaaaaattagctgagagtggtggcgcacgcctgtagtcccagctaccagctacttgggatgttgagacaggagaattgcttgaacccgggagacagaggttgcagtgagccaagattgcgccactgcactccagtcttggcgatagagctagactctgtctcaaacaaaaaacaaagaaaactcccttcattttcatgtaatcttatttatttcctcaagaagggtagatcttttaagactttattctttgcagttacaaacatacaataaaaaatttagtggctttactttcatttgattccattttacaaatggaatcaaatcgtatgaattttaacttgctttttttagtttattatcttagaaaactttctgtcagtatatatcaagctttctttttaacttggtctaaagtagtggtcttaacttttggtcacatactcagaattctgataaattctgtctctttgtacattaagtttacatctaaaattttgtagcaaaagtttagttgtaaaacatgtaattttgagaatgttttacttttgccacataaaaataagttacctcattctgctaaatgtatccaaatgcttctaaatatatagcattttggtttccatcatctagtttaaaaatatacgaacaagctgttctttatcattggaaatttaaattcttcttttgagtccttgaacttttatttccataacatgtctcagacttttatcctaatgtaatatatttttatgcttaaaagttttttcttgattgtgctaatatgtttctgctactaaatatgtatgtaaacttaaattttaatttttaaagttcctgtgacaaaggttctgtgttttaacttggtccagaggaaatttatcagtctattgcatgtattatgttttttttaaatctcccttcattttcacttaatcctatttgtttcctcaagaagagtagagatgggctttactgtgttgaccaggctggtctcgaattcctggcctcaagtgatctgctcaccttggcttcccaaattgctgggattacaggcatgagccactgtgcccggccaacataggttgtaatttttgatgttattactatacaagttgaattttattggaaatgcttttcttatgagatgatggggtctgttatttttctcaattaaatcatgggtctgtggatcaatatttctttctctgatgaaataggattggcaatttttcctgtttttgtagctatcatagtgaagaaaccctaatcacataggtaaatatatgggaataaagcttttttttttttttgggagatggagtcttgctctgtcgcccagactggagtgcagtggcacgatctcagctcactgcaacctctgcctcccaggttcaagctattcttgtgcttcagcctctagagtagttgtgattcacacgccactatgcctggctaattttttgtattttagtagatatggggtttcaccgcattggccaggcaggtctcgaactcctgacctcaagtgatccacctgcctcagcctcccaaagtgctgggattataggcttgagccactgcacctggccaggttcttttttattattattattttttattacgagataaggactataggcgtgtgccaccacacccagctaatttatttatttatttatttatttttagagatggggtcacactatgttgcccaggctggtctcaaattcctggactcaagacacccctctgccttagcctccctaatagctgggactataggcataccctagggtgtcttggcctttatctatatttagctattagatacctgttatcttcctgtatcggtaacacgaagtgctctcatttcttttattactgtgtactattttacaatattataatctgttggtggacatttgttgtttttaagcagtgccatcataaacattctgtttatattcacttttttatacttttatgtctctttttgaactaaatacctaaaactgattgttgagttgagtattgcagaatttgataggctgccaaattgtctcataaaaaggttattcctatttacattcccccaaatgatgtaatgaaattacccttgtcaatgctggttatcaaattttaaaaggttttatcactgtaatagctgctcttataccactcgctggatatcagtttttgtaatttccattttcttataatatgcattctttaatgaagcaagtttttaaaaatatgcattctttcttgagcgaggaagaataaatcttataagcttattgtgtgaatgtgaaagggaatttacttatgccaaatgtgggatggagcatatttatggcatctctctggataagtaaaatgcagtttgtgaagacttagcagggtatatgttacatagcggctatttaatagaattctgttgtctttccttccttatttctttcttttatttaaattatattctggttttggactgccttgttcttttagattgttctctttggctgttcctcttaagtaacagaatgaatgatcttttcaacaagaagcttgtgtgaaagatttctgccttgtatttatgaggactaaggggttggacagcatgtttgtggtcttccaaagtaaaatcttgcattttttattttagtagcatatattgtagatattcacttattgtcttaggaataatatctctgaattcttcggtcagcaaggtgactgcagagctaggctggttgctaaaatgttagatatagtcagagactttcagaaaaagttgtacatccccaaattgatctatatagtcaatccccaaattgatctatatagtcttatatgcaattgcatataagatcccatcaagaattttagtataaatcaaaaactgattctaaaatttatatggaaaagcaaagaaacaaaacaaggccaggcgcagtgactcacacctgtaataccaacactttgggaggccaaggtgggaggattgcttgaggtcaggagtttgagagcagtctgggaaacatagggagaccccgtttttccaaaaaataataataatgaaaaattaggcaggcgtggtagcatgcacctgtggtcccagctacttgggaggctgaggcgggaggattgcttgagcctgagcagtcgaggctccagtgagccacgattgcactactgcactccagcctgagtgacagaatgagaccctgtctcgaaaaaacaaaacaaaacaaacaaaaacatttttggaaaagactcaagttggagggctcatattaccttatttaagacttatggctgggcacagtggctcatgcctgtaatcccagcactttgggaggccgaagcaggcggatcacctgaggtcaagagtttgagaccagcttggccaacatagtgaaacctcgtctctactaaaaatacaaaaaaaaattagctggacgtggtggcacgtgcctgtagtcccagctacttggggaggctgagcctggagaatctcttgaacccaggaggtggaggttgcagagcgtcaagattgcgccactgcactccagcctgggcgacagagagagactccctgtcaagaagacttactgtacaaatacagtaatcaagacaggatggtattggcaaaatggatagccttacaaattgatggaacataacagcccagaaataaacccaatgtaatatggtcagttgatttttttacaaaggtgcaaaggcaattcaatagaatgcagatgactttttccacaaatgactctgtaataattacctaattacctaattattaggtgattaggtaactacctaatcacctaattattaggtacaggaatagaaacttaggaatgtacaggaatagaaacttagacccacatcattacaccatatacaaaatttaactcaaaatgtaccgtaggcctcaatatgaaatgtaaatatgaaaactataagacttctagaagaaaacatggggaaaaaaatcctgtgacctacttcataaaaattaaaaactatttgaaaggcacagttaagtaaatgaaaatacagtataagttagaaacagggaagaaatttttacaaaatttatctgataaaggagtgatatttggaatacataaagaattttcaaaactcaataataagaaaataaacagttcagttttaaaatagtcaaaaaatttgaccattcaagtcaccaaagaagacaaagggatggcagagaaacacatgaaaagatgctcaacatccttagtcattagggaataagatacaactaatttccttaaaaaaaaaaaaaagagggaaaaaaaaaaaggagtcctctgcttccagaaatacagctggttacctccatgcaatcttcatccagaagcaatgatggtaccctggatttcctgtgtgggaattaataagtaattaataaatggcctccgctgggcatggtggctcacatctgtaatctcagcactttgggaggccaaggcggtgaatcacctgaggtcaggagtttgagcccgcctggccaacatggtgaaatcccatttctactaaaaatacaaaaattagctggtcatgggggcgggtgcctgcaatcccaactactcgggaggctgaggcaggagaatcactcgaacccagaaggcggaggttgcagtgagccgaggttgcaccatggcactccagtctgggtgacaagagcaaaaccccatctcaaaaataataataataataaaacaaatgccctcgtgttcttggagcgtttgatttggatttgaattgctgataccaaacctgtgttgctccatgatggttttactgaatttaatggtaatctttgataatttacagaatgaaaaagatttagacttgctattatgaggggctctcctatggaactggtactttacagagcttgggtgccctaggaattaatgattctgttcagttctgtttctgggtttccttttgttaaatgtttaaattttgaacagtttttaattgctttaacctaatgctacaaagagtgagaaaaactccattaataagacagtggttggatctgtttttcatttttctgtctgtcacaatgggtaattatttgtcattgttgcagatactccatcttctaaaccaacactcctagccaatggtggtcatggagtagaagggagcgatactacaggtaagtgattcccaggattccccaaatgtgtaggtgatgcacttacaatgaacaccttgataatctcctttgaagagcattattaatggaagcatatgaattatttctgagggtggtagtgttcttgttggaggtatttaaacccaggacattgccatgtaaaatctccaacaatggaaggagaataatgagtttgctttgatattttttgaatatttattggagctgtaccacacaagaactggatcaaccttaaaatacttttgtagatgcagaataatgatcaccaaaatatgttacatgggaggaatttggccactacaactcttaaaacagcaggtctgttccctgaatcacattgcgtttagctttctacagttcaatgttaggaagccagtgaacaacaaattaggagttatttattttgcccccagtgtgtttcctttatctttcccttaactgttgcttttgaaatttacttctaattaaactcttagctctttactagggttttgatattctttcagttagcattgagtttctgtgggttcctgtctcataaccagcaccaaccccctgccccaatgtctttgtagtgagcaaaattctcaaagcagtagcaggagtcccagggatatactatataaatattttcttaagtagctgatgtgagagttgcgtgttttattttcataaatacctgcatttactttgcagttgtgatcaggccaacactgctaacccaaatgagttgacttctaatgatcaatcccattgtttcctgcaagtgtgctcttaactgggccatacatttgattcatattattgcagtggaggtagttactagatttgtcatatttctgtatttctcttatatgcatacctcagctatgagaagcccttctgtgaggcaccacagtatttctctttttctaaggcttccagaaagccttctgttagcaatagcagctattctaggatttattctttattctatgaccataggaaagttgtatatatctttatacatcagattttttgatgaccaagttctttttgttgtgaatgtttaccaagtgacatatacatccttattagcaacttaataaattaggaactctttactttagaagctagaaacaaccagaaatgccactttatcttccagttttgtgaattgatgtttttgtatttctttgataatctcagtcaaatgtagtattgactttctgtgtctgctttgaaagcagtcatctatgtgatgtggtttttaagaaaacatttatgcaaatatccctgtgattaaaggagaagtttgaacatgaacttttaaaaaatgagtaaattcagctttctttaagcaggaaccagttaaccagggtaaggaaaggctggaggggattgacttgattaggcagttgaaagagtggatgccattttcatccaggaaggaaacaactacaaaaacgagtagatttcttctccagtaggaagtcatgcctgaccagaagagactcaaactctgtgtagcaggtgcttaccgctgccaggccttagtagtacagaatagaagggtaaaaactgtatcctggccctcactgtttcaggattcccttgtgacaaaaaagaacctggctctttatgaactacccagtggcattatgagagtaggtcgttctgttcttggatacctctctgcccttaggtagcatatagtttgcacacctggattgagttttgaattgaaccacttaactgtattaaaatagatactaggccgggcgcggtggctcacgcctgtaatcccagcactttgggagaccgaggcgggcggatcacctgaggttgggagtttgagaccagcctagccaatatggtgaaaccccatctctgctaaaaatacaaaaattagctggacgtggtggcacgtgcctgtagtcccagctacttgggaggctgaggcagaagaatcgcttgaacccaggaggcggaggtttcagtgagccgagatcgcaccactgcactccagcctggtcaacagagcaagactccgtctcaaaaaaaaaaaaaaagatactttactgaaaatatgcatgttttatttggggagggaaggtggagggaggggatggcagtgcatgtttttggagcatgtggtgacttcattctaatttggccatcactacctggagcatctaactcaatgccattttgaaaattcccatttctgtttccttcagaatgttatctatagtcccgagagcaaaccagcttcattaatagctttggtttatgagcatcttgtgatattgaacttgctgtttactaatgacctgtgcttttccacccttttcttccccttcctacttcttcctccctctctatttttctcctcctagaagcctagcgtgtctctcaacactggggctgctgcaacaccagaccagtgatctttcctaagcatcgttatacttctaaaaccttcagcattttgcagagctttgcttttcattcctggacatgatgtagaagaaactgagggtagttcttcggggcctatttctgctgatgcctgagcaaacaacctgcttcctcttgtgctctgcagggtttgatggagcctcatttccctttgtgaacacaaagtgcaaaatgaattctttttaattttagtaatttttacaaaggttatctaatgtcttttatttcttgttttctttatgattttatcatttgattcattctcacatttttttcctttaaatatttttagttgacctttttcctttggttttcaaatgttcaacatgaatcagaatagtgtaacaccaaatgagaacatgtgttttcataaaggggttgaggccaccagtactgcagcgaatttccttttcttctccctcctccttccttctctgagcttgcttttagggaaggttaatcttacaggctacctatgtttctctccaccttactaaaatctaaataatgatagatattttaagtttttaaattgagtagttctgagtaatcctagaatatttttccaaattaaataatcctttattatttgcaagttgggccaaatttttttttttttggagacggactcttaacaatctaagattgtttcaacaggactttcttattcccattcctaattttttcaaactaattgcttaaatctagaaccagttgagattagtactgtacaatggtatgctttgattgtatttatagaaatataacataaaacatggaccatgttttgaaatcttagaggaattctggtttaaaatctgaaatactttaaagttttctatccttttactgattatgcagcttcttataacccccaaggtacagattatttcagcttaaaagaaataattggcaccatgttctgagaaagattttgagatatacattgttttttgtttttgagacagggtctcactcttgcctaggctggagtgcggtggcgcgatcttggcttactgcaccctctgcctcccaggttcaagtggttctcctgcctcagcctcccaagtagctgggattataggtgtgcgccaccacaccagctaatttttgtatttttagtagagacggggttttactttgttggccaggctggtctcgaactcctgatctcaagtgatccacccgccttggccacccaaagtgctgggattacaggtgtgagacactgtgcctggccagatatacattgttttagatcccctgatacagaactacttttgagatggtaagattagaatatcatgaaagtttaaactgaatccttgcagcgacttccggaatttaggaagcattccctcttctacaggggtctggtcacaagggctggattctctgacaaaaatttcttctatggattctggacagaagacacttgagggtgatatgttttaaaggaaagaggttatgcttatcttcttagcagttgataaaatattaaaactctcttgccatagagaatacaccatcaaagaaaacacaaccctttccctttggtgtacagttatttattaagttgattttggggtttctttcgccagggatcttttcaaaactggtagtagttatttttaaaaatcatgtttgacatctttctattgctcgtaaccagtccctgtagctgtctaagttatgggtggagaagcctgggtatgactttccgttgtgtacactcacacttcatgattgacatttatttattcttttatttccatttggttatgcttatttttgtttgaaatttgtttttttcaaatatgtttcctttttgaacttacagaattgttgaaattttctactaacagccagctaaaatttggtatatgttagctctatctgtttcacttggacgtttcattttgaaagaaagaaattttatgtttcacatatagttttatacaaagtagccagtcccataatgaaatgctgtattgccatagtggtcacacccaagtggtccagtatctcaatggtgaggcagccagactggtcagggctgctttgttgaaatgtgatgattttcatatgccttctttctctttctctctctctttttttttccttttttggcccaatgttgaagatgtagaactttgtttttaaataatgtttttataatttcattcgtatacctaagtttgtattttttgtgactttggacttcaacagtttgtatattgggacttctaatgtgattactgtactaaataaattccactaataaacatcttacattaacaccttatggactggatttggttggggtcataattgttgaaatataatgttactaaaacacaagttgggtaaagacttgaggcccaagttctaggtctaatatagcttctaatcccacccggattaattgtatggacttttaagtttttgtcaagcattttcacttatgaatttttttttcttttttcttttttttttttgagacggagtctcgctctgtcgcccaggctggagtgcagtggcatgatctcggctcattgcaagctccgcttcccgggttcacgccattctcctgcctcagcctcctgagtagctgggactacaggcgcccgccaccacgcccagctaattttttgtatttttagtagaggcggggtttcaccatgttagccaggatggtctcgatctcctgacctcatgatccggccaccttagcctcccaaagtgctgggattacaggcgtgagccaccgcgcccagcccacttatgatttttgatagttattgtaaactctcttttatccagaattataaaagttaagaagttcaaatgactactgatatttaatgtcatttggtgagaaagtcacttgacagaaaggtgtgaagaagttattccaaaaggaggtttccatggtatatcaattgttgttagatgctttctaatactacatttattaatttctaacactacatttagtttagtgcagttaaaattcacattcaaagtcttcctaaagtgcctcctgaattatcagataaaatttactacattcagtaacatttaatttgataactttgttatttgataacccagtatgcagtatctgggaagaattcaacaaaatgcgcagttccctagccattctgggttagtgtttgtttacagtagggttgcaagtacaatatgttgactgaattaagacattaaaaatattttatatctaagtaatttgcatagcataaggaactttttaagcttggcagacattttagttaagaacacttaatttaatgtttttagatttcctttttattaaaacagctcagtaatctgttctcaggtttaaagcacagattttaaatactataaggaataattgaccattaactttcttatacataccctaggtttaaagcttttggtaattgaagcaattcttgaattttgttattgtcctcatccctgatgcgaagtgaaacctggcttcatttggattcttcctccttattgacttgataatatggtgggaggctagagggtgttctaggcaaagacacaggactggtccagcaggcacagaatgttagtttcattcctaaatcatgtgtaatactgtattatcctcaattttatgttgatgccgtttccattacagtgaaggtttaacaagacttaactacaaattatttgtgggataaagctctgtgcgaccatggaggtaaattactcttatttatagtgtttggggctagacacattgcactaagtgctgtacaaatggcagtgttactggttgtttccatcgtaattagagtaggtaaacagtttactattgtgataactgtttgcatgtgtaaagtcatgccagcagtgaaacagtaaatctacttttttagaatatcatgacacagaaggtattctgtgtgcttcatcactatctcatctggtaggatgcaaaggatttagcatcagaaaaatgcaaaagcaccaaaaatgtgaaatattaacagataaataaatctgtggtgtgttagagtttctgaacagctattggagccacgctgtaaattggcatcataactcacaagtggagcccagacataagctgcacattatgttgctatgtatagacagcaagacatccatccgaactccaccaaattcctggaacaaagttttatttcttttctttcattttccagttaatgagttgcatgctggagacacatcagcaaattaacagcacgtaatgtttcttaaagtttttttggttcatggttttctaataaaaatacagaatttctcttcagaaaagtccacatatacccatatacaagatgttacatttacgtttagagtgtttaggactccattgaaaccagctcatggactacaatccttttctaagccaagcatttaattaatactctaagccacgttatttcagtttcttttggggctttgtattgaataagacaaaatagcttcttcttgagctttaagtgaaaatataattctgatttttttttgtttgtttttgtttttgagacgaagtttcgcccttgttgcccaggcttgaatgcaatggcacgatcttaggtcactgcaacctccgtctcccaggttcgagcgattctcctgcctcagcctcccaagttgctgtagctgggattacaggtgcccgccaccatgcccagctaattttttgtatttttagtacagatggagtttcaccatgttggccaggctggtctcgaactcctgacctcaggtgatccacctgcctctgcctcccaaagtgctgggattgtaggtgtgagccaccacgcccagccttctgatgttttttgggtttttttgttcttgttttttgagatggagttttgctcttgttccccaggctggagcgcagtgcaatggcacaatctcagctcaccacaacctccacctcctgggttcaagcaattctcctgcctcagcctcccaagtagctgggattacaggcacacgccaccatacctggctaattttgtatttttagtagagacggggtttctccatgttggtcaggctggtctcgaactcccaacctcaggtgatccacccacctcggcctcccaaagtgctgggattacaggcatgagccaccatgcccagcttttaaagactttttaaaaaacctatcttaagttctagttactgagagaaaatccatattgaggcaagggctttgcatgtaggtagtttattttgggaagtggccccagggcacaagagtgggatactgggaaaagtgaaattagaggaaaagaatacagtgaagtatgactactgacctagtcactgctgtgggcaaagtgggcttaagtcttttggggtcttttgaggacctgtatagaatgcctctcagtgttcactacctgagtatcttggttatagaagtggataacatttattcaccatttaccatctctcattgcttaagactcttttttttttttttgagacagagtcttgctctgtcgcccaggctggagtgcagtggtgcgatctcggcccactgcaagctctgcctcctgggcctaacactcttgtacttctggatttgcacatgtgtggtgccaggatgcagatgtcttgtctcttggtgtcagagaagttgtagggcagaaaactctggtttggttgatacaaagtgctgtcaaatcacacctatgtgcagctggatgctgtagcaatagctagaataaatagtgaacttaacagagtgtgaggtgggggcacaagaagtgtctaaccaagaggttacttcaaagcaagattctcttaacataagatttgtctgcttatgccttaccatagaggatgagatccttcaactctgtagaggaaatttgaaggaactccatctattatggtactaatccttttttttttttctctccccgcgccccgcgagacagagttttgctcttattgcccaggctggagtgcaatggcgtgatcttggctcactgcaacctctgcctccagggcttgtgattctcttgcctcagcctcccgagtagctggggttacaggctcccaccaccatgtctggctaatttttgtgtttttagtagagatggggtttcagcatgttggccaggctgttcttgagctcctgacctcaggtgatccacccatgttcgcctcccaaagtgctgggattacaggcgtgagccactgcacctagccaggtgctaattcttgagctgcattgttagaaactatagagatagccacagatgttagttttggaattttccacccaaacgtttttttctttagttagttttagtagtttttatgtttctagaaatttgttcatttcatctaggttatataatttgtttgcctacagttcttagtattcccttataaaccttttttattcctgtaagattcatagtgatatctccttttcatttctggttttagtagtttgaatcctctctccttttttcttcataaatgtagttaaaagtttgtcaatttttttcatcttttgaaagaaccaactttcagttttggtgagttttctctattttctctcctctgtttcctttatttccactttaatcttttttatttccttccttctgcctcatttgagtttagtttgctatttttctagtttcttttggtagaaggttatgttagtgattggtgatttttattttattttattcttttaatataggtgtttatggctataaatttccctcttaccactgttttagctgtacctcttaagatttgatatgttgtgttttcattttcattcatctgaaagtattttctaatttcttttgggatttctttgacgtgttgattatttaggagtgtgttaatttctgcatatttgtgcattccccaatcttctgtttactttctaatttcatcccattgtggttggagaacataattggtattctttcaatccctttcaatatatggaggcttgttttctggcctaacatatggtctgtcctgaagaagaatgtatattcggctcttgatgcgggtggaatgttctgtaagatgtccattagatgtagttggtgtatagtgttatataggtcttctctttcctcgttggtattctgtcttgttgttctatccattagtgaaagtgaggtattgcagtatccaacaattattattgagtagtctattgtttgctcaagttctgttagctttaaattttacatgctttttacatttctcaaggataaattccttgtgaaaaatgctacggttgtggataagaaagatacacacaaatgatcgctacaactatgagcctcagaagcagcagttgaaatgtcggtcgctggtaggacgatttaaagtgtttttttgttttgaggcagggtcttactctgtcacccaggctggagtgcagtggtgtgatcatagcagcctggaactctgggttcaagtaatcctcccgcctcagtttcccaagtagctaggactacaggtgcacaccaccatgcctggctaatttttaaaatcttttgtagagacagggtcttgcttttttgcacaggatgggcttgaactctttgcttcaagtgttcttcccacctcggcctcccaaagtactgggattacaggtgtgagtcactgtgcccggcctaaatgtgtattttattttattatttttgagaaggagtcttgctttgttgcacaggctggaatgcagtggcatgatcttggctcactgcagcctccaccttccaggttcaggtgattctcttgcctcaccctgccgagtagccgagattacaggcgcctgccgccatgcccagctaatttttgtattttcagtagaaacagcattttaccatgttggccaggctggtctcaaactcctgacctcagtgatctgcccatctcagcctcccaaagtgttgggattgcaggcgtaagccactgcacccagcctaaatgtgttttttgttttgttttgttttgttttttgtgacggagtctcgctctgtcgcccaggctggagtgcagtgacccgttcatggctcactgcaacctccgcctccgggttcaagcaattctcctgcctcagccttccaagtagatgggattacaggcatgtgccaccacgcccagctaattttgtatttttagtagagatggggtttctccatgttggtcaggctggtctcaaactcctgacctcaggtcatctgcccgcctcggcctcccaaagtgctgggattacaggcatgagccactgcacccggccctaaatgtgtttttaaaagatgatattttttcctcaaaatctgaacaatgttttttgcagaaatagaaaaatccattcggaatctcaaggagccctcctgaatagacaaaacaatcttgaaaaagaacaaagttggaagtctcatttgttgattttcaaaacttactgaaatgctataataatcaaaactgtgtggtattgacttaaagggagacatatagatcaaggaacggaatggaaagcccagaaataaactcttttatacatggtaagatgattttagacaacggtaccaggaccattcaatgggaaaggatggtgttttcaataaatgatgaggggaaaactggatatccacataaaaaagttggatcctgctgggaacagtggtttatgccaataatcccagcgctttgggaggccaagtgagaggattgcttgaggcaaggagttcaagaccagcctaggcactataggaagacctcatctcttaaaagaaaaaaaaattggccaggtgcggtggctcacacctgtaatcccaacactttgggagtcccaggagggcagatcatgaggtcaggagatcgagaccatcctggctaacatggtgaaaccccgtctctactaaaaaatacaaaaaattagccgggcatggtggcaggcgcctgtagtcccagctactcaggaggctgaggcaggagaatggcatgaacctaggaggcagagcttacataagccaagattgcgccactgcacttcagcctgggcaacagagcaagactctgtctcaaaaaaaaaaaaaaaaaaaaaaaaaaaaaaaaaaaaaggtagtgtgggcctgtagtcccagctactcaggaaactgaggcaggaggatcctttgagctgaggagttcaaggctgcagtgagctatggtaaagtacaccgctgcattcaccctgggagacagagagaaatcctgtctctccctctcttttttttaagttgggaccattatcttatattcaaaaattaacttaaaatggatcaaagacctaaacaaagcaccaaggctatacatttcttagaagaaaacatagagggaaatcttcatgacattggatttggcagtgttttcttggatatacaccaaaaacacagacgacaaaagaaaaaacagataaattaggctatatgaaaattgaaaatttttgtctatctctgtagagtgaaaaggcaacccatggaggcaaaatatttgcaaatcttatatcttctcaggagttaatatccagaatatgtaaataacttctagagctcaacaaaaaaaaattaaaaatatgggcaaaggacttgaagaaacatttcttcataaaagatacaaaaattgccaagaaatacatgaaaagatgctcagcatcattaatcattagagaaatgcaaatcaaaaccacaatgaaatatcacttcatactcattaggatggctagtatgaaaacaagaacagaaattaacaagtgtttacgaggatgtggaaaaattagaacccttgtgtactgctgataggaatgtaaaatgaaagtgctatggaaaatagtatggtggctcctcaaaaaattaaaaacagaattattgtaagatccagcaacccaacttctggatatatgcccaaaggaattggaatcagggacttgaacagatatttgtacactcatgtttgtagcagcattattcacagtggccaaaagatggaagcaacccagatgtcccatcaacacatggaatgaataaacaaaaatgtggtacattcatataatggaacgttatttagccttaaaaaggaaggaaattctgatatggtacaacatgaataaaccttgaagacactatgctaagtgaaaaaagccagtcacaaaaatacaaatttatatgcggtacctaaagtagtcaaatttacagaaacaaatataaatatactccatttatataaattaccttaagtagtcaaatttacagaaacaaagtagaatggtggttcccaggggctgggagaggcggggaatggatgtgtttggtgttgcttaatgggtacaaagtttctgatttgcaagatgaaaaagttctggagatggatggtggtgatgattgcacaacagtgtgaatgtacttaataccactgaactgtacacttaaaaatcgttaaaatcgtagaaataaacaaatgcagctcatatttaaagggaaaaaaatttcaaattaaccatcatatcacagatctcttcagaattaaagggatgctttatatgttaggtattttgtacgtttgttctggtttgtccagttgcagagagaaatacacaaatatgtcaacattgcttaaatgctaagcagttatggggaacattttgtaagaacagatacaatattggttaaattccatgagggggttgagtgagaactaaggaaatttgaaattcgagcttgaaatctccatttggatgtagaattgatatctcaaatttgaaatgttctaaactgaattcatgattgccccaccccaaaatcaaaacagagaagaaaaagaagaaaaaaaccacctgcctccccatctccttaaatggaaattctgtcctggttgttaaggctaaacatttggtttccctatcctcttctgctcctctcacaccccacacccagtttgtcagaaaaagatatttggaacctgaccacatctcaccacctccactgctctctccctgattggaccaccatcattaaccttggctactgtaataacttcccaaattagtctctctgcttccatttgcttgctccctgcagcatattcttaaaaacatctacagtggtcctgtacattgatcatgctgttcttttgcacagaaccctccagtggttgcccatctcaaagtaaaagccaaagtccttatgaaataccacaaggccctatgatgtcgttgtcatctttctgaccagatcttttcttagttacccctttacttactttgcttcatggtgttcttgctactgttccttgaacaagccaggtgggcatctgccttgagctctgagcactagcagttttctctgcctggaatgttcttccctttgatatattcatgattgactcttcactttctcaatgagtacttctcgactatctttttaaaaattgcaccccttctattttttcgtcccactgttctacttgaattttcttcgtggcttttgtcatgtcactttctaataatttgtatagtttacttatctcatctgcctttccccaccagaagaagatattatagaaacaaattttatgagagggacagggcttttgttttggtcactgctgtggcccagcacctagaacactgtctggtggatagtagatcctctgtagctattgaatgaataatctttaatatctatttgtttctggcctcacatgggaaaagaaacttaaaaacaagaccagatacaatcgtaataattcttgccaggttattggtacgcatctttctggaaatatgttatctgtcatgaatttgtttaaattttgaggaagctgtggatagagcacctactagctttgatttcttaggcaagttgtttgccctctttgaggctaagattcctgctgtgtaaaaggagagctctataaaaatagttgtttgcctgaagtgacagaaattattttcagtgctttgaaacctcgttgaaggggttaatatttaaatgtaagatgatattagaatgatgattaatgtccacatagaaagttcttacagttcaacccattatatacttttgttaaatcattctgtttgaccatcagccccttttcctacttaattggttgtgtaacagtattttaatcggatgtaactggagcatattggtccattgtgaagcagaaatgctctgtttctagaggacaaaactggaggtgaaacttcaaaagtgagctccaggcagactgaaagaagagtttttttgttttgtttcttgtgaaaaaattaacttaggactctcactgcaaaaaactggcaagcctggccctccagtgggttttcagcaatttaaaatgaaatgagaagatgcaaaactatgtcaactgtaaacttaagtattaacattagactccttagaggtcttcattgaaggattttgctttctatttaacaaattaatatttctggtcttcagtttttctgtgtaaaacgaacaggcattctgctgtttctgctgctgctgttagtgctgagcaacagagatacagtatgttctgcggtaggtgatagctttttagacatttagagattaacatttgccttctgatttattttctttgggttaaacatctttcattttttcttccactctttcctattatgtagatttatgctgtttttaatggccaatatttggatcagagtctattcaggagacagaagctacaccataaattgaacagagaatttactataggggtaaagagaactctaaagaatacaggaatgacagatatagggaatagtcactacccttagggctggggcagagtacacaaagaaataacaaatttggaaaagtatgcgcccctcccccaccctgcccccaaagctgattgcatatcttggaggaagtctccatttggtagtaaagatgtttgctgagttgctgcaggtcagggtgatgtggggcaaacaagcccccagactggggcttaacccaggagggttcttggctttgccaggaaagaatttaagggtgagccagtagtgagagaaagaaacttttattgaaccagtgctgcttcttgctgagcagggctaacccataggcagtgtgcccagaatcggtgtctgtgagctgctagctagctgtttatatctgttattaattacatgctaattaagaggcaggttatttagaactttctggaaaaggggctggaagtttctgggaatcagataaggtaacttctaggctgttgccatggcatttgtaaactgccatggcactggtaggagtgtctttatgctaataaaccctgagggcaactcgaggttacttttgtcagcatctgctggtttcagccagatcttgttccaatcagcagggtgcgacaggaaattaagtcctgctggtcttctacctcaaaggtagttaagcaggaagctgtacttgggggtgctgcggcatcaccagcaagcctgtttgaggcactggtggaacttgcctgggaagatgtccatgagaatgcccactaaagcttgttgggatgagcaccatggggtgttctgcacaccagcagagcaccatggaagtaagaagatgcaaaagcacactagaaccaggaagagaaaccctttccttccatgccctctactaagcttagtgtcatcatgcccgctctctaggaagaaatgtttacattattacaggcagggcaatgaaaggtagatttggaattgagaggcaatatattgattacttgcatagcctattattttggctacttagcttccatatgcactttacacacatttgagctcccatataacaatgaaactcttatgtttctacctaacaagatacagctatgtcagagggtgaaactctcacccttgttctaaaatgaggaatgaggacatgctcagccccatagtcattgtatccattgctggctatatttttgtttgtttgtttgttttaatagaatcagggttttgctgtgttgcccaggctagtctcaaactcctgagctcaagcaatcctccggcctcagcctcccaatgtcctgggattataggtgtgagccactgtgcttggcctgctggctgtttatcagtcctcaaatagaagttccagcttcagagggccaaggtcatgtgatgggagccaggggcttggagttctgagggaagaggagtgaagtattgggggatgtggcagtatcactgacagtgaggttttttggaggcttttttggtctgatttgtgagattgatattgtccttaatgataaggaaacaaagaaaatggcagaagtgaaaactgaaaatggcgaagtagaaaaacaccatctcctctatgatggagaatctgtttcaggaaaggtgaaagagtctagaaagagctagagcaccacaacattagaattgaatttgtacgtcaaattgaacttttctatgataagagtaatattcaagagtttgtaaacctagtgaaagaactagccttacctggagagctgactcagaagttgtcatttggaatttatacatgttgaaaagtcatgagaatcttacattggtgctaatgtcctcttgatgtattgaagtgttagtagtaagaagactgacagacttggtaaaaagaatgtgatcttactgttcaccaacttgccagctatcctgatggaagtgggcattgaagattgtctacatatagaatttgaatataatgaagtatcatttaaaggatgtgactgttacaaaaatttacctcttataagtaagaataaaaacacaacatatggggttacaactgatcaataagactgttgttagcaggatatgacctaactccaacaatgaaagttatgaacaaaaaagtttcagtaaggtactttttgaatttagcgcctgttgatgaggaagacagagggtactttaggcagcagatcatttaatggagaaaagctcctgaaaaactgaggaaacagaataaacttttaccagtgatttgaacctccagaatcacaagcatctgctgaatagcctgaaatatactgaataagatgaaaaaagaaaaacaaaactataatcattaagttaaacaggttaaagatggctgcagcatgtggaggggcaaaatgggcataactctgcccgggcatggtggctcacacctgtaatcccagcactttgggaggcgaggcaggcggatcacttgagatcccaagttcaagaccagcccggccaacatgatgaaaccctgtctctactaaaaatacaaaaagttagctgggcatggtggtgagtgcctgtaatcccagttacttgggaggctgaggcaggagaattgcttgaacccaggaggcagaggtttcattgaaccaagattgcaccactgcactccagcctgggcaacagaacaagacttcatctcaaaaaaaaataaaaatggccaaaactccatttatattcatcttcctttatcttacagcgctacatttatttcatgatatagcaaaatgttcttcatgtatatacatttttttttttttttttgagatggagtctcgctctgtcgcccagggtggagtgcagcggcgcgatcttggctcactgcatgctccacctcccgggttcacgccatgctcctgcctcagcctcctgagtagctgggactacaggctcccgccaccacgtccggctaatttctttttgtatttttagtagagacggggtttcaccgtgttagccaggatggtctcgatctcctgaccttgtgatctgcccacctcggcctcccaaagtgctgggattacagacgtgagccactgcgcccagccacatttttttttttttcccttgaaaatcgctcttttgcccaggctggagtgcagtggcacaatcttggctcactgcaaccaccgcctcccagattcaagcgattctcctgcctctcagcctcccaagtagctgggaccacaggtgtgtgctaccacgctcggctgatttttatatttttagtagagacgggggttctccaggctagtctcgaactcctgacctcaggtgatccacccgcttggcctccaaaagtgctgggattacaggtgtgtgagttaccacacccggccaccttcatgtatatacatttttaaaagtgctttctttgaaatgctcaaattttcttaaactgccttttttttttttactgcacactttgatgacaagcattcagatatgcgtcagcataagctttaaagattttcatgtggcagaaaacaaagttccactgactagtttgttaccaaaagttgtattataaatctaatttcaaggcgggtgcggtggctcatgcctgtaatttcagcactttgggaggccgagttgggtggatcacgaggtcaagagatcaagaccatcctggccaacatggtgaaaccccgtctctactaaaaatacaaaaattagccaggtgtggtggtgcacgcctatagacccagctacttgggaggctgaggcaggagaattgcttgaacctgggaggcggaggttgcagtgagccgagatcttgccgctgcactccatcctgatgacagagtgagacttggtctcaaaaaaaaaaaaaaaaaaaattagccgggtgtggtgcacacccctggaatcccagctactcaggaggctgaggcaagagaatcacttgaagctgggaggcggaggttgcagtgagtcaagatcgcaccactgcactccagcctgggcaacagagtgagactcggtctcaaaaaaacaaaactaaactgaactaattccaacttataataatgggaagaaggaaagaagaaaatggttagaatatacaaacaaataccaaatataacaaagagaaagttcatcctcatttctgtgattagtaatgaggccacagttgatatctaggcttctttcttcagttacctatttcatgtttcccttgccttcagcacgaacctcagctggttgaggttctttacctggtgaaatgactcaaacatttattccctcattagtccagtccttttttggttgctgtagttttccattaatctttatttttggcatggaagtattaagaggtgccttagataatcccttgggtttcagacatagtcctccttgctttcactgtgtagcagcaaccgtttccccttgacaattgggctcaatctttcccaaccagtaggttcagcctgttggttcagtggtgtaaggagtcccaagtagccaagtggcagtctcatcttctaatgcaattgaaccattgttgtgtatgctagtagatatatttcctgcttagggactagcacttccaagccagcagaactcagttgttaggagtgaaagcaaaaattcagtgattgctagatataatagtgagtggagccgcacatacttctaccctttgattcccagacctgtatattctgattgagggaggagacagcaccatgtaaggtgtctctgattgaaatcattaccccatcctttcagggtgttgtctccctgaaactgtaacttagtcttcagtaatcaattccctattttaattaggccaaccattctgtgtgataggatgtgacaacaccagttaagtccatggacatgagcccatttctgcatttctttactatgaaatgactttcttggtcaggagcaatgctgtgtgggcttggcatggtggcatatgcctgtaaccccagcattttgggaggccaaggcaggaggatcacttgagccaaggagtttgagaccagcctgggtaacatagtgagaccttgtctctattttaaaaatacatctttttttttggccaagcatggtggctcacacctgtaatcccagcactttgggaggctgaggcgggcagattgcctgaggttaggagttcgagaccagcctggctaacatggtgaaaccccatctctactaaaaattcaaaaaaaattagccgggcatggtggcacatgcctgtagtcccagctacttgggaggctgaggcgggagaatcacttgaacccagaaggcagaggtttcagtgagacaagatcgtgccactgcactccagactgggcgacagagggagacctcatctcaaaaaaagaagcagccgcaacactgtgtggaatgtcatggtggtagattgggcacttatatataagttcatgggtggtggaactgccaaaaacattataggcagagaaggcaaatctgtatccagaatacatgtctattctagtgaggacaaatctcttccctcacccctgcccttattccccataatagaagtccagcgtaatcaacttgccaccaggtggttagctagtttttgggaaatggtgcatattcagggctcagagttagtctgtgccattaacagattagacatttagcagtagctttagtcaggtcagccctgtttaggggaagatcatgttgttgagtccatgcacagccttcatgatgattttttccatgggttttattgagcaagcactcttgtagctatggaaagtgtctaacatttatattcatgaagtacgtcattttgtcaacttgcttattaagagcctcctctacagtgaatgcaaatgattattcacatgggacacaaatatcttcacagtctgtgcctgttctgagagtttcatctgcatatctttcccccagatttccttgtcaccatttccttccaagttcctaactagccaacaaaatccttaataattgttcataaatgagtataaatctctgcttctggccatgtcttacctcaggcaaaagggaaaaccaaatgtacccctcaacgttctgccctctgaaggaaagatttttcttcatcactgcccttcagtcctacctctttaaatggggctgtagtgctgcagctccccacttttgggtgatactggcatgttgtgcagagctatgtgtaaaccagacttgagttttttctttccccagtcagctggtcatatggagctctcaggaggccattgacttggattgagggagaggaagcaatgcaacagaactcaatgctgaagtctgagctacctcctatgtaacttactcatatttctggacctgcttgaatttttttttttacgtgtttttcacttgatgatagatcgtgctgcacatgccaagctagactacataggttggataacatctagttcctgatgagaagctcaggacacgtggttgcattatgtcccatggttaggcatttggtctctgccaagacccaatagcaagcctgaaactattttttgaaaggtgaataattttctgcaaaagagggcatagattttctcaaaattctagaagtctgggcagtgattctcttattcttgcttgctaaaggctccattcagcatccctatttgccatggacacttcaagtatcattggatctgccagatcataaggcccaaatggcagagcagcttgaaccacagcttgaacttgctatagaatcttttcttgctctgaaacccactctaaactgtcaaccttgtaggtaactttgtagctgggttgaagcctaccaaacattgtaccctctttttcattgttggtgatgttaattagagcaacttaatcaccttggaagggaaattttgacatgttttgagcaattgaatcctgacatttcattgctgcagtgggtctctgaatttttgtagggtttatctcgcatcaactactttgtatatgtcttactaaagcatctaacgtatttgctacttgctatttatcagacccaattagcataatgtcagtatagttgactagtgtgtgtgtgtgtgtgtgtgtgtgtgtgtgtgtgtgtgtgtgtgtacgtgcttatttatttatttttttggaatgtcacgcgatcaagatctctgtgggctacattatggtaggagaatggcatagccctgaggctagattcataggcacgtaaaaggcaggtaaaagcaatgtgcttctggtggttcttgcagatttgtatgaagaaaaaggcattattcaggttaatagcagtataccaagtgccgtgacccatgttgatttgctccagtaaagatgctatatctggggcatcagctgcaattggaatcatcaccagattaagtttatgatagtccacgagtttatgatagtcactaagatccatctgacttctgcacaggacaaactggcgagttaaatcaagatataataggtatcactaccctgtttctttcaagtcttttgatggtgacattaagctctttaattcttgagatgtggtattgcttctggcttaatatcttagtagggagggtaagttctaggggcttccatttagcccttactattaaaatgactcttatcagttgggtcagaaagccaatatgggagctctgccaatagtcaagtatgtctgttccaagtatttattcaggaactgaggagataacaacaaagtaggcccattgtactatggggtccactgtgaggtggacttgagctaagcatttcatctattacctgaccactgtcagcactcactttgactgataggccacagtagcattttgagtccccaggaattagtaatccctgaaaggtctgggtatttccttttctctaatccgtagtcactctagtaaatggcctttggggaagcttggatgaggatttacagtatgtacttgtacttgtgggaacactacaggtttttcctcaggggacctgggcttgttaattgacttgggtctagaaattagatgagaggtcaaaacttttctagtcaggtttttactaccagagctggagtttttttcagttgtacagatgaatctgttttggtaggctgcttgtggaatactgtgtgatcaattactgccaaagatcctggtgggccaaggtgttctgattaccagtacaactttactgtatttatagtagatttcccaccttgtctttggtgattacatgctgctacttggcctctgttattttaggatcccgttacccctttaaatcagggaacccacttagtggtggcatttcccatggccatacctaggggttgtgacagagaccttagggactgtaaaacctaaaatgtttatctgtggccctttataaataaagtttgccaacccatgtctaggggaacagggacacactgcaaaggggagcaaccacagagcttttcaaggatgaaggtgatcccctcactaatgcatttctttttttgttgttgtttgtttttttttttgtttttttgagacagagtctcactctgtcacccaggctggagtacagtggcacgatcttggctaactgcaacctctgcctcctgggttcaagcaattctcatgcctcagcctcccaagtagctgggattacagttgtgcaccaccacacctggctaatttttgtatttttagtacagtcggggtttcaccatgttggccaggctggtcttgaactcctggcctcaagtgatccacctggctcggcctcccaaagtactgggattacaggtgtgaaccaccatgcccacctcactaatggatttctcaatgcctgagtgaaaggattatcttccgagcttttttttgcaacataggttacacatgaaaaatccattccaacatttctatctccctaagtttttgaattgcctcttctacatcttgctagggaaactttggcatctccacctcattaaacatagtggactcttttttaaagaaagttttatttatttatttagagacaggctctcactcggtcactcaggctggagtgcagtggcgtgatcatagctcactgtaatttcgaactcctaggctcaagtagtcctccttcctcagcctcctgagtagctgggattacaggcatgtgacactgtgcctggttaattttttattttttgtggagatggggtctctgtgtgttgctcattctaggcttgaactcctgggctcaagcctcctaccttggcccccctgctgagattacaggtgtgaactgcacccagtccttttgttgttgttttgtgtttttttttgtaagtttttaaagtcctgtttattgaagcatgaatttacattcagtaaagttcaccctaagatttgacaaatgcatagtcataccatactcaagatgcagaaccattgtaaaatcactctatcaattccctcctgcccctttgcaatcaacccctttttgatcccaaggaactaattgacctgtttttctgtcaaaagtgtcaaatttaatcactaaaatgacctacagtaccatggaaaaatatgtaagcatataaaatacacaaaccaattttttttttgtattttatttattttttgagatggagtcttgctctgtcactcaggctagagtgtaatggtgcgatctcggctcactacaacctctgcctccaaagttcaagcaatttttctgcctcagcctcccgagtagttgggactacaggctcatgccaccacacccgaccaatttttgtattttttagtagagacagagtttcaccatattggccaggctggtctcgaactcctgatctcgcgatctgaccaattttttatttttatttttatttttattttttttttaatttatttatttattttttccatttaaccctgagtggacacagcacatgtttcagagagcacagggttgggggtaaggtcatagatcaacaggatcccaaggcagaagaatttttcttagtacagaacaaaatgaagtctcccatgtctacttctttctacacagacacagcaaccatccgatttctcaatcttttccccacctttcccccttttctattccacaaaaccgccattgtcatcatggcccgttctcaatgagctgttgggtacacctcccagactgggtggtggccgggcagaggggctcctcacttcccagtaggggcggccgggcagaggcgcccctcacctccctcccggatggggcggctggccgggcgggggggctgacccccccacctccctcccggacggggcggctgccgggtggagatgctcctcacttcccagacggggtggctgctgggcggaggggctcctcacttcccagacggggtggctgccgggcggaggggctcctcacttctcagacggggcagctgccgggcggagggtctcctcacttctcagacggggcggccgggcagagacgctcctcacctcccagacggggtcgcggccgggcagaggcgctcctcacatcccagacggggtggcggggcagaggcgctccccacatctcagacagtgggcggccgggcagagacgctccacacttcctagttgggatggcggccgggaagaggcgctcctcacttcctagatgggatggcgggcgggcagagacgctcctcactttccagactgggcagccaggcagaggggctcctcacatcccagacgatgggcggccaggcagagacgctcctcacttcccagacggggtggctgccgggcagaggctgcaatctcggcactttgggaggccaaggcaggtggctgggaggtggaggttgtagcgagccgagatcacgccactgcactccagcctgggcaacattgagcactgagtgaacgagactccgtctgcaatcccggcacctcgggaggccaaggctggcggatcactcgcggttaggagctggagaccagcccggccaacacagcgaaaccctgtctccaccaaaaaaatacgaaaaccagtcaggcgtggcggcgcgcgtctgcaatcgcaggcactaggcaggctgagacaggagaatcaggcagggaggttgcagtgagccgagatggcagcagtacagcccagcttcggctcggcatcagagggagaccgtggaaagagagggagagggagaccgtggggagagggagaggagggagaggagggagagggagagggtctgaccaattttttaaaaagtgagatactttaaaaagtttcttcagcataccaacaaaaaaatgaaggtagcattgcattttactacagatgtgcagatattcattaaagttcaccattgtcatatatatggctcaacagtagtatttaagaatatgctgtaaaacaacaatctttagagtcaaaagaatgtaattttaaaacctttataaattaaagcagtttataaagttgtcttaattgtaaaatagctaatctagttacaattaatgtgttccaaaactgacctacttgaaaaactagtcttatatatttgttgagtatgtgaaccatgattaggtcttgctatttggtattaacactgtcaagttacagaccacagctggttcatagaaaagctactttaaataatggaattgaattccgtagaaattttctacaagaccaactcagctatggggagaaacacgaaactgtcaggtgaatattcctacagatgattggggccacctcagaattcacccctgctacccctatgaaagggaccaaaaaaacaaaaaaagcaacctctattctgtagttactaaaggttacatattcaaatatatctcatctacttgaaaagcttcactgattctttcaagcgccagaccttaaattcatcagcatcttgaaactccaccaagcccagtcatgtgccacagctgaaatttgtttttggtttttttttttaaacataatttactcgagtctaaaatttcagtcaaccaatgaggtgaactgttagagccacctccagctatatgatctactcctacacatgttctgaaggtttttgccagtatattattgccacgatcttgcatgtcctggattactagcatcccctttcccattggcaaggtgcttagcactgcacttaaacccaagagtgccaccaaaccaatttctaaatcccatgtttttaagtccgtcctctgagatcaccctactttttgtaccagttctggatcagggttcagtctggaaacagaaatattgcaatttgaacaagggaaagttaacataaagaattattaactagtaatagattaaccattaaagggtaaagagaactctgaaagatgtaggtgtatcagctataggagcagctactccctctgtgcctgaggcagagtatgaaagaaagagacagattggagagagagcctacccaaggcggagattcagaccttttgaggaggtaaagctgtagtctgttgcagttttaagttcctgaggatggcaccagccgagggttaaaagcaagagtattgtttgctggagtgccaacaaaactgtctaggaagctgctctgggtggtgctgtcgaaaatcactgggaagttagctggggtgactggaactcacctgaagccactcattgtggtatccctaaaactggtgggtgagcaccgctgggtgtcccacgcatcacatgaggccacgggagaaagaagaggaaaacacagtggaaccaggaggaaatcctcttcctcctgtagtattcctccagtgcttgctattggcataagaaaaacatttgaagagtccagcttcattattgcaaagcagagcagtaaagtatagatttggaactgaaaggcaataaattgataactaatatatcatacctcttaacctatgcctagaatggaatacaatttccagatgtagtttagccagcataagtagagcaggatacctaccccactccgcatcattcctggtactatgttgttgatgttgcttgccaagaatgtaagctctctatgggtggtgattcttttttttttttttttttttttttgggacgcagtcttgctctgttgcccaggttggagtgcagtgggacaatctcggctcactgcaacccccgcctcctgggttcaagcaattctcctgtctcagccttctgagtagctgggactacagatgcacaccaccacactgggctagtttttgtattcttagtagagacggggtttcaccatgttggccaggctggtgttgaactcctgacctcaggtgatctgcccgcctcaggctcccaaagtgctgggattacaggcgtgagccaccgtgcccagctgggtggtgattttttattgctttatccctagaacctaaatggaacctggcacgtagtatatgtacttaagggatagttgaatgaataagtgattacagctcaagatagcgttaaattgttgtcttttttatgttagattcatccaaattagtgaaagaaaaactgcagtttgacctagtcaaccaactgaaatggattaatgtagaattctgagtggctgagttaaaggacaccttatttgatttggtttaagaaaattgatcggccgggcgcagtggctcacgcctataatctcagcactttgggaggccaaggcaggtggataatgaggtcaggagttcaagaccagcctggccaacatggtgaaaccctgtctctactaaaaatacaaaaaaattagttgggtatggtggcgggcacctgtaatcccaggtactagggaggctgaggcagagaactgattgaacctgggaggcgggggttgcagtgagccgagattgcgccactgcactccagcctgggcaacagagcgagactctgtctcaaaaaaaagaaaattgatcacctgccagagcatggattgacccctcttctgatgacttggtatgtgtttgtacacactgttaacacccctttctatagaataggtcacaattatgggttgggcgtggtgactcaacgcttgtaatcccaagactttgggaggctgaggcagaaagattgcttgagcccaggagttcgagaccagcctgggcaacatagtgagacctgtctctacaaaaattagcctggcatggtggcacatgcccacagtcccagctactccatatgttgaggcaggaggatcgcttgagcccaggaggttgagactgcagtgaattatgatcacaacactgcactccatcctgggcaacagagctgagaccctacctatctcaagaaaaaaaaaaaaaaaaaagaataggtcaaccagccttcccaacatggcgaaatcccatctctactaaaaatacaaaaaattagccgggcgtggtggcgggcacctgtagtcccagctacttgggagcctgagtcaggagaatcgcttgaacccaggaggcagaggttgcagtgagccaagattgtgccactgcactccagcctgggcaacaagagtgaaactccatgacaaaaaaaaaaagaaagaataggtcatggttatgaccagtgggtacaaaagacatagacttgtgtatttattgcatgtttcaaggtagaaagcaaattgctgcatcaagtattgttgtcatagcctttaattacctattagtaatgcaaagaagcagagatttttgttttcttttctttttttcttttttcttttctttttttttttttttgagactctctctgtcgcccaggctggagtgcagtggtgcgatcttggctcactgcaacctctgcctcccgggttcaagcaattctcttgcctcagcctcccgagtaactgggactacaggcgcccaccaccacgcctggctaacttttttgtattttagtagaaatgcagtttcattgtgcccaggctggtctcgaactcgtgagctcaggcagtttgccctcctcggcctcccaaagtggtgggattacaggcatgagccaccacacccggcttgagatttctctcttctaggagagttctggcagatgatttggcctttcctcccttgttgtacactaagaggaaatgaggcagagtaggaaagaaaggtacccaaggttgagtgttgaatgagaggaccagggattaaaatcaaaatccctacctggctgaatgtggctctgctgccttggggtaggagattgggccacaagtccagctgggtgccaggaggaggaaggggtaaaaagggagtggaaaacccctccaaggacccactgaccctgctggcagacttcttattcaagtgtgaagaaatctgtcagaatctgagggaaccaaagacaagaaaaaagtacaatgtttggacataaatttccttaattcttgtaatgttttaggattctaataatcttctataaggaggatattaaatatccttaaataatttgctgtacttgggaaagtggtttttcttcttcagtttagagctagaatctcagttacctatagttgcctggagtcaattggtagaatgggtttgaagccattgaaaattgagcgtggatatgaatacagtttaatgtttacatgtgatttctgccacagttgattttgattatggctacttgtaaatcatttttctggctttaaaccaaaaacttttaaatttctggcataatttaaatactttcataaatataacctgcttaacctgtttaacagaatgtgaaaatagaaatagggttcattataagttattgacatttaaagggaattcctgttttgtatatcacatcatagatatatgatagccctggtttattatgtctattatcctgacataattgttaatagttgcttctttttttttttttttttttttttttgagacggagtttcacctttgtcacccagacaggagtgcaatggcacaatcttggctcactgcaacctctgcctcctgggttcaagcgattctcctgtctcagcctcatgagtagctgggattataggtttgtgccacaacacccggctaatttttgtatttttagtagagatggggtttcaccatgttggccaggctggtcttgaactcctgacctcaggtgatctgcccacctcagcctcccaaaatgctgggattacaggcgtgagccatcatgcccagccaatagttgtttattttactcttgttttggcctactctgaccaggcaaatttatttcttagaatgtgttgatttagtttagtataaattaaactaaattagtgtaatagtcctgagcatttaagttatggggccgggtgtggtggctcacacctgtaatcccagcactttgggaggcagaggtgggcagatgacaaggtcagtagatcgagaccatcctggctaacatggtgaaaccccatctctactaaaactacaaaaaaaaaaaaaaattagccaagcatggtggcgggcgcctgtagtcccagctactcaggaggctgaggcaggagaatggcatgaacctgggaggcagagcttgcagtgagccgaaattgtgccactgcactccagcctgggcgacagagcaagactccatctcaaaaaaaataaaataaaataaaaccagtcttggcaacacggcgaagccctgtctctacagaaaaatacaaaaaattagctgggtgtggtgatgtgtgcctgtagtcccagatacttgggagactgaggtcacttgagcccaggaggttgaggctgcagtgagccaagatcgctccactgcactccagcctgggtgacagagtgagaccctgcctccaaaaaaataaaaaatattaaattataatattttaatattcagcaaaaaaagtaaataaaattcagtagaacaaaggtgttgcaaaaagaagaatcttaatttgtagattgcatcttttaagaaaaactcataagaataccagccagtatttttatctccagatgaattttttcccctccaaattacaatcatttctccattcaacatcctttattaggcaccacctaggtatcaggccagatacatggtgctgggaatagtgaagagaaagacacagtccttgttctcaaaggactaaacagagaatggaggaaccgtatcttgtattcagatgtttaaatgtatgcataggttgcttatgcatacattatgagaacctatgctacatgttttaaatgtatgcataggttctcatgacatacatttatgagatctcagctcactgcaacctctgcttcctggattcaagcaattctcctgtctcagcctcccgagtagctgggactgcagtcgcatgccaccatgcctggctaatttttgtatttttagtagagaggggtttcaccctgtgggtcaggctggtctcgaactcctgacctcaggtgattcacccgcctcagcctcccaaagtgctaggattacaggtgtgagccaccgcgcctggccagcaatctgatttcatctgttcccaatcactccctccatttaaccctaggtgttttttggaagcaaaccccagatcatttgatctttatattagcatgtatctcaaaaaaaaaaaaaaaaaggttcctttttagagcataattgcaataccattaacaaacacacaccggttccctagtaccaaatatccagtcagtattcaattcaccagttatctcataattaaaaaaaaaaaactagctcgttagaattagaatctaaatttattttaatccatagattcttctataggggatatatatataaacagtttggattttacttgtgttttaaagatgccagagatttaactgtgctcatagccagagggggagaaatgaggagagaaggaatgaaaaattaagtctagaaggttggaggactgggtggcaagaaggtgataaagggcatatttgctgtccttggaaaggagaatcacgtgtattttgcatattctctggtttagcattttccccaaattaaaaagaaataaaaatgggggattatatttttctcataaataggaaggaaagaagtaatgatggactctgatgtagataaatttatggtagaggaaacagcagtcatataatatcattttctataaagtaaaatactatattttggatggagtgagctggaaaagaaagtatgtataacagactgtggagaatgagaaaggaagttgcatggggacacattttgtttttgtttttgtttttgagacagagttttgctctctcgcccaggctggagtgcagtgacgtgatcttggctcactgcaacctccgcctcccaggttcaagccattcttctgcctcagcctcctgattagctgggattacaggcgtgtgccaccacacccagctaatttttgtatttttagtagagacagggtttcaccatgttgatcaggctgttcttgatctcctgaccttgtgatccacctgcctcagcctcccaaagtgctgagattacaggcgtgagccaccacgccttgccagggacacatgtttttataggaagttgtgtagagaggtgtgtttataggaacaagtacattcagtatgataataaatcaagtgttgtaggaggtagaatactgaaactattcagtattctgagttgacagctcagctactgccaacttagcctgtattgtggtctcagggtagcatccttcacctgtggccactctgagacacatccagcagaatttctggttgaagcaaaacaagtgtgctatgtgatcttaaagttatctccttcctgctggagatttccttcaaatgccttggtgttttcaaatattgctagagggctaaactcagagtcttccaaccattgtagggatgtcaaatatcattaatttatttttgtttttttaattgagatgggtttgaagccttttttggggagagtgggggaaagagtcctgttttgtcacctaggctggaatgcagtacgggatctgggctcactgcaccctctgcctcccgagttcaagcaattcttctgcctcagtctcagtggctgtgattacagacatgcaccatcacgcctggctaatttttgtatttttagtagagatggggtttcaccacatgggtcagactggtcttgaactcttgacctcatgtcatctgtgggcctcagcctcccaaagtgctgggattacaggcatgagccaccgcatctggcctaaaatattattttaaatcaagaaaggttagtgggctttttgctagtttaatacagtggagaaggacgctaatatagttggatatgaacatttggatctatttaattataaaaaatggagtcggctgaaaatctgagaaaggagtaggctttctcctgtcactttttttattgaaatacttttatttttattttgaaagttttttttcttttgtgtttttggagacagggtcttggtctgttgcccaggaatacagtggttctatcatagctcactgcaatcttgaaatcctggctcaagcaatcctcccacctcagcctccaaagtaactgggacgacaggtgtgcactaccgtgcctggctaattttttaaattttttttgtagaggttggggtcttgctacattgcccaagctggtctccaatgcctgggctcaggcgatcctcctgcctccacctcccaaattgcgatgattacaggtgtgagccgccatgcccagcttattttgaaataatttcaaatttatagaaaagttgaaagaactttatacatttttccagattcaacaatcaatacgattttaccacaactattttagcattctgtaagatatgtatgtatatgaatatacacgtattttccttgtcacctttgtttgatctaataatctaagatgttctcacatgtgttacttacaatgtcaacagtaactggtatccctgtgtgcatgaaaaaagcaaaaaacaaaaaacaaaaacagtggtgattgtcagggcacagtggcatgtacctgtagtccctgctacatgggaagctgatgtgggagaatcacttggggccaggagctcagtcaaggctgcagtgagctataattatgcctgtgaatagctactgcactccagcctaggcaacaaagtgagaccccatctctaaaaataaatagaaaaaaaagtttttaatttaaaaaaaactgtcagtagtaaatgaaaataccacattcagacattttcccctttcttttctgtgaagcacctttgccagcattaatttttcttaatttttattgttatgccattttaacgtctttatgattaagtttagctcttaatgagatactgtgttgtgtattttttcatttctcacatggctaagcttctatcccaaaagcataatgaagcctgaactttgtcttggatttcttgactttctgcagggaatggggagagggaagaacggggctgtaggaggctagaagtgtgagcttgcactggagtatatagggatttggactaacagacttctaaaactgtaaaggagtttagagaccaaatactagcacagcccttagtaaagacccccaaagagcttgtgtttgtgagggttatatctatttatcaaactaaaactggagaaacctgaaaaatacttatctcattttaaaaagtaataataaacaatatttttattgagaagtatagtttcaaaaatgaaggagattagtaagaacagtggtagcgttttcgcctttttttttttttttttgagacggagtcttgccctgttgcccaggctggagtgcaatggcacgatctcagctcattgcaacctctgcctcccgggttcaaacagtcctcctgcctcaacctcctgagtagctgggattacaggcacacgccaccatgcccagttttttttttttttgtttttgtttttttagtagagactgtgttttactatgttagccaggctggtctcgaactcctgacctcttgatccgcccacctcggcctcccaaagtgctgggattacaggcgtgagccaccgagcccagccatggtttcgcttttaaaaatctttttaatgtctgtcttaatagaacacagctgtatttttatatctgcctctgcattcagtctgtcacaatatgttgtttgggttgcagtatatgaagaaaatccatttcacacaaatatgtagttaggaggaggaatattttgacagttttttttccaggtaactatgggtatttgatttgacatcaaaacttcacaaatggtagtttcttttcttcttcttcttcctttttttttttttttttttttttttttggtagagatagggtctcattatgttgcccaggctgatctcaaattcctgggctctggccaggcgctgtaatcccaggactttgggaggccgaggtgggtggatcacctgagatcaggagtttgagaccagcttggccagcatggtaaaaccccgtctctactaaaaatacaaaaaattagccaagtgtggtggtggctgcctgtaatcccagctacctgggaggctgaggcaggagagttgcttgaacccgggaggtagaggttacagtgagccgagattgcaccattgcactccagcctgggcagcaagagcaaaactctgtctccaaaaatgaaaaaaatattcctggtctcaagcagttctcccacctcagcctcccaaagtgctgtggtttacaggggtgaactactgcacctagccaagtggtagtttcttaaaggttgtttgcaatggggaatctgaaaccatatcaatgaactttttgtactgttatttaaaatccattagtctatcttgcacttggaatggatcatatgtgacagaattagtctagttttgatatgtagatatgctacttgtttaattagtactttaagtgtttagccatatgccttttctgttaaatgccttcaatttcacagagatagaaaactgtcccctgtccttccccattctacttttataggagaatcaaagtctctagggatggccagtggtagtggtaagtattttttctactgcattatgtaaattgcttcttgtttagaatttcattttccatagttttactgaaatagactctctgagtagattgcaagtatgctaaaaaatttattctgaaggctgttgtttctacaggggagtttgcctgcttctgctgtgtagttttaagaacaaaatctaggtcagcagtattgaataaagatgtgggagtgagcctctggtcaaacatgctccttaataataatggtggcgggggactggtgattctgaactttgctgttgagatagctgctccaggctgtgctgcaccctgtggaagggaataaccagcaaaattctgcatcttaaaaccagatttgggccaggtgtggtggctcacacctataattgcagcattttgggaggccaaggcgggtggctcacctgaggtcaggagtttgagaccagcctgaccaacatggtgaaacctcgtctccactaaaagtacaaaaattagccaggcatggtggtgcacatctgtaatcccagctactcgagaggctgaggcaggagaattgcttgaacctgggaggttgcagtgagtggagatcatgccactgcactccagcctaggcaacagagtgagactccacctcaaaaaaatttttaaaaaaatgaaaaaaacaacaacaacaaaaaacagactttcatgctccttctccaggaggggtgaggaaaatgtacccatttctctgattaaaaacttattttttgatcaagaggtggttgtttaaaaaaaaaaaaaaaactatttctttacagtttcttaccatgagtaagaaatataagcagaatcagagtttttaatgtctatcttagaaatgataggctattgtttaaattattttggaattccttatgcttttttaaaaaaaaacattatgtcaccaaccttatgctctttataataaatgcaaatcactttccaagaagtttggtgtataatgtgaatttaacttacatcatttagcccaaataatgatcttgtgataatttgatagcaacttatttattgaatactattctgtctcatgcagttagctaggcattgtgaggaaataaaagtagtaaaagcacagtattttctttttaaacattaatgagttcacttactaacatgtaaaataatgaaaattttaatgataaatagaatacttaaaggctttttaattttttaaaaaaagactaacaggaaaacatgtgcttaaggactaaattctttcctagtaacagtgaatggtaaaagagctaagtagtggaaaatgagcattaaagtcatcagagaggttctgtggaagctatgaggcccaagtggtggctttggaattggatcagggaggagacatttcaagcaggggatcagtgatctcatgagcaaaggcacaggggcagagtggagcacaggctctagcaggagccatgaggggacagcatacttactgcatgactttcctgttggagtagtagggaacaagcctgggatgggttcatttgatgggtaaggaaggctttagattagcatctaacatttgccgtaataatgttttgtgttgttgaagccctaaacacatcgtctttataagctttgaaatagatggataggtgcaccttctctaaataggatgtgacttgaagaatgttttttacttaaccataattttagaactgaacaagtatccttagaggtcattactgtgactaagagagatgaaagggctgtcccaaatttacatggttagcctgtggcaaagccagggttaagaactcaaatatgggcctggtatagaggctcatgcatgtaatcctagcactttgggaggtcaaatccggaggattgcttgagcccagttgttcaacgccagcctgggcaatgtatggagaccctgtctctacccccaaaataataacaataataaattagaagggcatagtggcacacatctgtgtccttagctactggagaagctgagaggggaggattgcttgagcccaggaagttgaggccgcagtgagctgtgattgcgccactatacctgggagacagtcagaccttgtctcaattaacaattcccttttttctttttttcctttgagacagaatctcgctctgtcgcccaggctgggtgcagtggcacagtctcggttcactgcaacctccacctcccaggttcaaacaattctcctgtctcagcctcccgagtaggattacaggtgtgcgccaccatgcgtggctaatttttgtatttttagtagagacagcgtttcatcatgttggccaggctggtctctaactcctgacctcaagtgatctgcctgcctctgccttcccaaagtgctgggattacaggcatgagccaccacacccagcagagatcttgtctcaataaaataaaagtaagaactcaaatatgtctgctggtgcccagctgttctctccctcctttccctctatagattttttagaatatttaataataataataaaagaagaaaaatggctgggtgcagtggttcatgcctgtaatcccagcactttgggagactgaggcgggcggatcacctgaggtcaggagttcgagaccatcctggccaacatggtgaaacctcgtctctactaaaaatacaaaaattagccgggcatggtggcaggcgcctgtaatcccagctactcaggaggctgaggcaggagaatcgcttgaacccgggaggcagaggttgcagtgagctgagattgtgctatcgcgctccagcctgggggacaagagtgagacttcgtctcaaaaaaaaaaaaaaaaaaaaaagaagaagaaaaaggaaaagctgttcttgaaggtagccaaaggttctgagattgattcctaccttcaacctgagaacatcagaaacatctttctcctataattttctgattaatttcactgcagtaatccagaatggggttgttttattacatttgtgttttgtgattcaagaactaagacaaatatattaatcctatgaaaaaacatattgcttttaatatttttactaatttaaaaaggcgtttatccaagtttcatcaccttttcttcccctctgctcagtgtatatgccacttgtgaaccttcccgaggatgctgtggtttgttctttaattcatcgtcatttttctggcttagacaagtaatgagtactttcatctacttaaatgaccaagtatttcatctgtctaataactgctgagtcttatttgtaagttatgttttaccagatttttgagaattataaagatgaatggataagtcaaaagtctcagaattaattttaaaattaaaatgggcttcagaaattatgtagcacaatttttttttttaattctggatgagtagtgtagctctaacagtcttaaggtcacacccaaagttaagtggcagagtcaagattagaacctgggtctcctgattctgttttctttcttttctttttttttttttttttgagacggagtttcgctcttgtcacccaagccggagtgcagtggcgcgatcttggctcactgcaacctccacctcccgggttcaagcagttctcttgcctcagcctcccgagtagctgggattacaggagcccgctaccatgcctggctaattttatatttttagttgagacggggtttctccatgttggccaggctggtcttgaactcttgacctcaggtgatctgcctaccttggcttcccaaagtgttgggattacaggcgccagccaccgtgcctgggctcctgattctgttttctagttctgttttccttctttagcatatctctttttggtttagattgcttttctgtcctgtgaagaagctttgtttttagagatttcctcaatgttacgtgtgccattataagaactaggcattgtatatttgtatattttgttgcgtgcttgtagctagattttttttttttaacatataagggttttagaataatacctgatccataagtctctcctttctcctcccccttttttcttttctttttttttaagacagagttttgctctgttgcccaggctagagtacagtgatgtgatctcgggtcactgcaacctctgcctcccaggttcaagcaattctgcctcagcctcccgagtagctgggattacaggtgcctaccaccacacccggctaattttttgttttcttagtagagacgggttttcaccacgttggtcgggctggtgccaaacttctggcctcaagtgatccaccacctcagcctctcaaagtgctaggattacaggtgtgagccaccatgcctggcctctttctctccttcttctccttctttgtctctctcccaccctcctctttctccccttctttcctccctacaccttctttggcttcattcttaggcagtgtctttcagggttgagaaagatggccactggcagctatattcttaattttatattcttatataaaattcttaatttttttgaggtatattcctaatattttttttttttttttttggagactaagtctcactacgtcactgcagctggagtgcagttgtgtgatctcggctcactgcagcctctgcctcccgggttcaagcaattctcctgtctcagcctcctgagtagctgggactacagacatacgtcaccacacccccggctaatttttgtatttttagtagagatggggtttcaccatattgatcaggctggtctcgaactcctgaccttaggtgatccacccgtctcagcctctcaaagtgctgggattacaggtgtgagccaccacgcctggccagctcaggtatattattatggttcaatatcttaaaatgtctgtatatcaggtttctccaaaagggctttgggcctgcttgaatcacaagtctacttcttcggtggggaaagcaaaacaccaggaccaaatagaggaatgggatggttcctaggggtgggtttccctttagaaggcattcaggcagacaaatcttaagtttctatttggcctttgaaactctagctgccgtttatgaagaactgctgtccttcataaatgtgtttcatccaaagtgatatgctcttggttttcccattcttgcccatggccctaacttctattttgcttgctgtgtgtcttccccactttgtctctttctctgtttcccagcttcatttaattacatccttctatcttcctagattcaattaagttctagtctcctacaggaagatcctagatcatcccacgactgtgttatgtgactgttctttaaactcctataagtagcacttactgcattgtagacacttgtcctacataaaccataatggttattataggattagcaataatttagcatgtttctcataattttctaagcacttcacatatcttagccttatgaagtaggtattagttatgaaaactaaagcttgcagaggtttgcatcattgggcatgtcttaaactctcaactaggctaatacttgcttctgtgttttcgtagtgcctaagcatagggtggtgatggtggtgatctaagttccatgagagcaggacatttcaccatttggtttactgctgaatcactaatgcctggagtagcgattgacagtatgtgcttaaattggtaaatgaattatctggacaaatgtggcatggtttaaacttcagaggtttggattaggtgatcctctaggttcctttcactttaaagttctgaggttaccactgggggaaaaaaacaaaaaaacaaggaaagagctgagggtgtgaaatagaaggagtcactgattcgtttgttagtaatatgtaaattatgagccgcactaatattgtttataagaaagcagactgggccaggcacggtggcctgtaatcccagcactttgggaggccaagatgggtggactccttgagcccagaagttcaagaccagcctaggtaacatggtgaaatcctgtctctaccaaaaatacaataattagccgagcgtgatggcacgtgcttgtagtcccagtactcaagaagctgaggtgagaggataatttgagcctgggagacggagtttagggtgagctgagatcaagtcactggattccagcctgggagacaaaaggagacgctgtctcaaaactatgccatcagtatacagcagatactaaaaggtattgaaagggtagaaatttgactggggaaaagtagggttcaaaaccctaatcacttttttaaaaaaattatttaatatgttgtggtgctgttgattcagtgctgcctggtcaccaccagtagattagctcttgatgtcctgtccctctctttacccagtgcctgagtctgttgcttcggtcagccttgagatttcttctccagcagtgtttaaaaacaagtatgtgtgacctatgtaaaattggccttacatatctactgaaatggtgatgaatacatacatagagtacagaaaattaaactacataattaacccaatttcaccacattcagctctggggaacctacttgtgttgaaatgccatttaaagttggcttttggggccaggtgcagtgacacatgcctgtcatcccagcactttgggaggctgaggcaggcagatcacttgggttgaggagtttgagaccagcctggccaacatggtgaaaccctgtctctactaaaaatacaaaaaattagccgggcgtggtggcaggcgcctgtagtcccagctgcttgggaggctgaggcaggagaatggcgtgaatctgggaggcggatcttgcagtgagcccagatcgcgccactgcactccagcctgggtgacagagcaagactctgtctcaaaaaaaaaaaaaaaaagctgggcaggatggcatatgccagtagtcccagctacttggcaggctgaggtgagaggattgcttgagtcagggaggtcgaggctgcagtgagctatgatcgtactaccgcactccagcttgggtgacagagtgagaccctgtctcaaaaaaaagaaagaaaaaaactttattgaggtgtaatttacatacccaaaaatttacctgttgtaagtgtggaagtaaatgattcttagtaaaattacggagtcgaaatgattcttagtaatattatggagttgtgcaaccatcagtgtaatccatcgttagaacatttttttattaccctaaaagttcccttgagcccatttacaaagccagtcccttttctgacctacagtttcaggtgaccattgatctgcttcctgttatagttctgtatgttctagaaatttcatataaatggaatcatacaatatatattctttggtatcttgatttcctcacttagcataatgcttttgagattcttctctacaaaaattaaaaaaaaattagccaggtgtggtggcatgcacctgtagtcccagctactcttgaggctgaggcaggaagatctcttgagcccaggagtttaaggttgcagtgagctgtgatcgtgccactgcactccagcctgagcaacagagcaggactgtctcaaaaataaaaacaaaaaaagatagccaagcatggtggtgtacacctgtggtctcagctgtaggtgtctcttgcagaggcaagaggattacttgagcccaggagtttgaggctgcaaggcagtatgattgcacctgtgaacagccgctgcacccgaatagtctgggcaacataatgagaccccactcatttcacgtctccaaagaaaacatacaaatgccagatgaacacatgaaaaaatgctcaacatcattagtcattagagcagtccaaatcaaaaccacaataagatgctacttcttaccacatctagggtgactacgataaaaaaagataacaacatgttggtgaagatgtgaagaaactggagtcctcatgtattgttattgggattgtaaaatgacgcagccattttggaaacagtttggcagtgtctcaaaatattaaacataaagttgctttatgacccagcagttctactcctagggatatatcaaagataattgaaacacgttcccacaaaaacctgtacgtgaatgttcatagcagcattattcacaatatccaaaaagtagaaacaaccaaatgtcagctgattaatggataaacaaagtgtggtggatctacacagtggaatgttatttggctataaaaaggaataaagttcagttaccatactacagcatggatgaaccttgaaaacattgtgctaaatgaaagaggtcagtcacaaaagatgacatattgtgtgacttcatttatatgaaatatctagattaggcaaatccttaggaacaaaaagtagacgagtggttaccgaggggtaggggaaagtgggaaaggagaaaagatatgggatttcttttttggagtgaagaaaatgttctgaagttagatagtggtgatggttgtataactgtgtatatgctaaaaaacctttgaactcgactttaaaagagtgaattttgtgaattatactcgataaaactgttatttaaaaaataaaaagaggctggtccaaaggtagtgagttatctcaattgttcagtcagttacagattgaactccacgttccactctttccctgcttctcactgttgtacttgactagtctttaaaaatacagatggagccaggcacagtggctcaaacctgtaatcctaggacttgaggaggttgagatcagagaactgcttgagcccagaagttggagaccagcttgggcaacataatgagaccctgtctctacaaaaaaaaaaaaaaaaaaattttgtttaaattaggcaggtgtggtggcaagtgcctatatttgtagctacttgggaggccgaggtgagaggattgcttgagcttgggaagttgaggctgcagtcagccatgatccacaccgctgcattccagcctggatgacagagcaagaccctgtctcaacaacaaaaaaagagcaactttgagaaaaacaaaaataagtaaataaaaggaaaccaccaaactaccattttacacattctcaaaattgctcctgtcagtctttttgtacagccttttttaaaaaatagggcctttttctgtcaccaaggcagtagtgtgatcacaggtgactgcagcctcgacttcccaggctcaagcaatcttcctgctttagcatcctgagtagctgaaactaaaggcactcgtcaccatgcttggctaattttttttttgtatgtttttgtagagacagggtctcactatgttgcccaggctggtctcaaactcctgggctcaggtgaccttcttgcctcagcttcccgaagtactgggattacaggcatgaaccattgtgcctggcctgataacagccattttagtggttttgtagtaggagttcattgtagttttaatttgcatttccctaaggactgatgagcttcattcatgtgcatattacgcattatatattttctttggtaaaatgtctattgaaatatttagccaatttttttttttttttttttagacagagtctcgctctgtcacccaggccggagtgcagtggcgtgatctccgctcactgcaagctctgcctaccaggttcacgccattctcctgcctcagcctcctgagtagctgggactacaggcatcctccaccatgcccggctaatttttttttgtatttgtagtagacagggtttcactgtgttagccaggatggtctcgatttcctgaccttgtgatccgcccaccttggcctcccaaagtgctgggattacaggcatgagccgctgcagctggccatcaagttttaaattgagttgtttatcttataattgtattgtaagagattataatctcttctacatacaaatcttttatcagatttatgatttgcagatatttctcgaagtctatgacttctcttttcattttctttaatagtacctttgttgttgtcttttgttttttttgtttgtttgtttgtttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgtcttttgtttttttgtttggttttgttttttgagacgcagtctcactctgttgccccaggctgcagtacagtggcacaatgtcagctcactgcaaccttcgcctcccaggctcaggtgattatcctgcctcagcctcctgagtagctgggactgcaggcacaggccaccaggcccagctaatttttgtattttttagtagagatggggtgtcacccagttggccaggctggtcttgaattcctaacttcaggtgatccgcctgcctcggcctcccaaagtgcagggattacaggcatgagccaccatgcctggccgtttaatagcatctttgaaaagcaaaagttttaaattttcatggtgtcccatttatatattttgtctcttacagatagtgcttttggtgacatgtctaagaaatctttgcctaatccaaagtcacaaagattttttcctgtttataagtttttttagttttaactcttacattaggtctttgtcttgtcttttttttttttttttttttttttttttttgcataataagttagcaagtgagctacgttaggtctttgatctgtttggagttaacttttgcatatggtatgtggtcagtgtccaattgtttctgtatcatttgttgaaaaaaaatttgtttctgggttgaatataattatgttgaattatattatgtttgtagatagccagttgaccctaactttgtatgtttctttctgaacctgttctgttccagtaccacgttctgaacctgttctgttccaataccacgttgtcaataccatgctgagttggtacagtcttgctctgtcacccaggctgtagtgcagtggcgcaatcttggctcactgcaaccttcccactcccaggttcaagtgattctcgtgcctcagcctcctgagtagccagaattacaggcatgcatcaccatgcccagctaatttttgtatttttgctagagacagggtttcaccatgttggtcaggctggtctcgaactcctgacctcaaagtgagctgcctgcctcagcctcccaaagtgttgggattacaggtggtgagccacttctcccagcctgagttggtacatttataataacttttgaaatcaggttatgtaagcccttcaactgtttttcttcaaaattgttttggcttttctaggttttttgcatttttatataaattatggaatgagcttattttgtactttcttcaatatattggtcattttcaggattgccatcttaacagtattgaatctttcattcctgagcatgttatacctttccacttatttaggctggctttttttttttttaattccagctccctgaaattgttgcttttgacagttttatccttgttctttcatgtggagaaatcactaccctcttcgtgcctgcataacctagaagtcactctgtagtgtttttttaaccttaatgacctactttatttccttctatctaaaattttttttagtgacagagtcttgctatgttgcccaggttggagtgcagtagctgttcacaggtgtgatcatagtgcactacagcctcaaactcctgggttcaggtaatcctctctcagtctcccaagtaaatggggctacagacgcaccattgcacccagctccttttatctttcaattaaaagaaaaaagttttcttgtaagacactagctagataggattttttatattgtactagctgtaatactttgtagaaattccactgtagtggaggagaaaactgtaatatcttgtaacttttgttttgtgtctctattttaagggtctccaactgaattccttgaagagaaaatggcctaccaggaatacccaaatagccagaactggccagaagataccaacttttgtttccaacctgagcaagtggtcgatcctatccagactggtaagtgttggcttgctcgtgactactaaatgtgtgctatgacataaatgtgaaaaagctacaaccaccattcagatgaaaatgctttagcttaagtatagatcacaaagtacaaccttagcattggtttgtccctttctcttcttcatttatcctttcctttgagacacttaatgccctctagttccctgctcttcaaaacctattttaaatacattatgtgaaattcatatacactgaagattagaggatccatagtaccttagaaccttaattcttccagaaggaattattatggtaatgttaaaccagtgctgttctgtgccaggcacagtgctagagcctttatatacacattatcggtatttcttacctaactctgccaaatatatgtatcctcttttgacagaagagaaagctgattcatacccactttctataaaattaaaaacagaccaggtgcggtgggttatgcctgtaatcccagcactttgggaggccaaagtgggcggatcacctgagttcgagagttcgagacaagcctgaccaacatggagaaacgctgtctctactaaaaatacaaaattaggcaggtgtagtggcatatgtctgtaatcccagctactcgggaggctgaggcaggagaattgcttgaacctgcgaggcggaggttgcagtgagccgagatcgcgccactgcaccccagcctgggcaacaagagcgaaactccatctcaaaaacaaacaaacaaacaaacaaacaaacaaaagcctatctgtagtagcccagagctagagttggtaggaagaatgagttccaaaagagccttaaaggaatagctttggtacttccctgttagccagattgagagctcaagttatgtttccacttaaatatggcttcttttttgacatctaacttataagatgctcatcgtttgtttcaaataacctagtatgtgatgttctgtaccatttgtcagttatcggctttcctaggtacaaagtaattatggggggagggtgaagaaaaagctgtattgagatacaattcttttttttttttttttgagacagagtcttgctctgtcaccctggctggagtgcagtggcgcaatctcagcttactgcaacctctgcctcctgagttcaagcgattctcctgcctcagcctcccatatagctggaattacaggtgcccactacacccaactaattgtatttttagtagagaccaggtttcaccatgttggccaggctgatctcaaactcctgacctcagatgatctgcccacctcagcctcccaaagtgctgggattacaggtgtgagccactgcgcctggccaataattcacagtaccatacagtttacccatttaaagtatatagttcggccagattcagtgacttgtgcctgtaatcccagcactttgtgaggcataggtgggatgatcacttgaggccaagagtttgagaccagcctgaacaacataatgggattctgtctctacaaaacattttaaaagttagctggttgtggcagcacatgcctgtagtcctagctactcgggaggctggggtgggggaatcacttgagtctgccacttcaaagctgcagttacctaggatcgtgcttctgtactctagcgtgggcaatacagcaagaccctgtccctgatagatgtgtagacagacagacagacagataggtagagtagatagagtagataaatggagtaacttaggccaggcgtggtggctcacacttgtaatcccagcactttgggaggccgaggcaggcggatcacctgaggtcaggagttcgaggccagcccagccaacatggtgaaacctcgtctctactaaaaataaaaaaatcagccgggcatggtggcgggcgcctgtaatgccagctacttgggaggctgaggttggaggatcgtttgagcccgggaggcagaggttgcagtgagccgagactgtcccactgaactccagcttgggtgacagagccagaccctgtctcaataaaataaaataaataaaatagagtaacttaattccactgaattggccgggcgtggtggctcacgcctgtaatcccagcactttgggaggctgaggtgggcagatcacctgaggtcaggagttcgagaccagcctggccaacatggtgaaaccccatctctactaaaaatataaaaaaatagccaggcatggtggtgcacgcctgtaattccagctacttgggaggctgaggcaggagaatcacttgagcccgggaggcagaggttgcagtgagccaagatcgtgccattgtactccagcttgggcaacgagcgaaactctgtctccaaaaaaattccgctgaattgtactctatctacttacctatctatttatctatttatggttataaccataaccagattcaattttagaacacttttattaccacaaaaagaaactctgtaccttttaaatatcacccccatctccctatccactgcaaccctaagcaactaccaatttgctttttgtctctataaatttgcttagattggacattttatataaagggaatcatataaagtggtttctttgtgactgctttttttcacttagcatactgttttgaggagtcctgcattttgtggcatgtatcagtactttctttatggacacgtaatactccattatatggctataccatattttgttcattattttatttttttgagacagaatctccctctgtcgcccaggctggagtgcagtggcacagtctgggctcactgcagccttgaccgcccaagctcaaatgataagtacataaataatttaaatcaggaagaagaggagccagcaagggtaacaaaggaatgaccaattttgagtaggaaaaaaaattcagtggagtttaatttcctcagcggaaagttgagtgtggtagtcaactgccaagatggcgtccaatgatccctgcctcctggtattgatacccttgtgtagtcacctcccatgtggtactaggtttggtctgtgtgattgtagaatagatggcagaaataatagtgtgtcatttctaagattaaattacagaaaatatcatagcttcagccgggcacggtggctcacgcctgtaatcacagcactttgggaggctgaggcaggtggatcacgaggtcaagagatggagaccatcctggccaacatggtgaaaccccgtctctcctaaaaatacaaaaaattagccaggtgtggtggcggatgcctgtagtcccagctactcgggaagctgaggcaggagaattgcttgaacctgggaggcggaggttgcagtaagctgagatcacgccactgcactccagcctgggcgacagagcgagactccatctcaaaaaaaaaaaatatcgtagcttccatcttgatcactctgtgtttactaatcatgaggaaagccagctgatatagagaggcacacatgggagaggagcagaggcctccattcaacggccacgtaagccatcttaacaggcaggttctgcagccccagtcaggtcttcagatcaccacagcccctggccaaccgctggactgcaaccttgtgagaaaccctagtcatggagctgggggagaaataggttctggggcacattttgaaggtcaagggcaatggattttctgatgggttggctgtggtgtgtgaaaaagaggaggtccaggatgactccaaggttttttgcaaaaaacatagaaggatagaatgccattagagatggaaagactatataatgagtagatttggaaacatgctacataaaagtctgaaaataaggtgagaggtctagaggtcttgaattataaattcaggtgtcatcaacctatagatggaattttaaactgtgggattagaggagagggaatgtagagagagaaaaggtttgtcttcctcctcataaccactcagttctttagttctcagcttaaatacttatcaagcaaagatctcccttgacttgaaccaaaatatatcctgtgggaacatatataaatgttcccatccctgaccttgtacatctttgggttttttagagcatactgggtctgccatgtggtaggcacccagtaaaaaattaatgactaaatgacagaactctgtaagaatcatctatttttacaagtaatttagcaagctcccatcttaaagtgcaaaccatccagaatttagtctgtttgatgctttaagaatccttttttccctcaagggggaagtgtgagaggcagagcaagcagcgagctatcccaaaccatatagaactgggaagaatgaatgtttatcatctctctcatattctatctccccatcttttctttttcttaattttgttctgtttttattatttattttgagatggggtttcactttgtcacccaggctgtagctcagtggtacaaccacggctcaccacagactcaacctccccaggctcaagtgatcctcccacctcagccttccgagtagctgggactgcaggcatgcgctaccatgcctggctaatttttccgttttttgaaaataagggtttgttttttttttttttaaacaaaaagcaggctgtgttttttgtttttaaagatgggcggtctcggtgtgttgcccagacaggagtgcagtgactattcacagtcgccatatcatagtgcactgcagccttgaacccctgggctcaagaagatcctcccacctcagcctctcaagtagctggggtgtgtgccacttttccaggctcccatggttttctgaagaagaagcctcaacaagtttcccaatattgccttctgcttgttcacacttcccgatgcagtggtctcccctaatcctgaaatttcttacaaaaagagggtggtatagctgcctcagagccaagaaaatgaacattctctcaaggcctgggcttttatgcggctgtctctgacaattgaagtgtcttaagggagtgatgtgttagtgtcactcaggaactagttggaaatgcagattctcaggaaccagcaatctttatttttaacaagtcttcaggatgattaagataataaaataaattccaagaaggcctcttcagaaagtggaactcttgtttagcctgaacagctttgcttttttttcttttttttttgagacagtctcactctatcacccaggctggagtgcagtggcgccatctcggctcactgccacctctgcctcccgtgttcaagcgattttcctgcctcagcctcccgggtagctgggactacaggcacgtgccaccacgcctgactaatttttttatatttttagtagagacggggtttcactctattagccaggatggtctcaatctccagacctcgtgatccgcccgccttggcctcccaaagtgctgggattacaggcatgaaccaccatgcccggccctgcttttttttcatgtacaaaagcacaaagagtttacctgatgttttgagtgcttttattcatgccagctcctgagtcaagagtttatttcttctgttaggataacaattgtttatcttgtcccattcagacagttttgaaatgcagttttcttcatcatgtccacatgaggtgaaaaattacttgttggtttttttttttaagcttgttaatggctctgtctttttaaaaagtaacttaaaatgaatgttatataaatatatattgaaaatttagtttatactttcacctctcagagtgtttgttatacagctgagcattagttgccctttttgttttatgcatttgttggctatctgatgtacataaccaaatcttagagaagggattatttattattaactcataacaaatgaattagtgaatattgattctctaccatgtgcagtcacatatgatttcggtttacttactattgacaactcatctatattcatcataggataataagaaatattggccaggcatggtggctcacgcctgtaatcctaatactttgggaggccgaggtgggcagatcacttgagatcaggagtttgagactagcctggccaacgtggagaaaccttgtctctacaaaaaaatacaaaaattagccaggcatggtggcgggcatctgtaatcccagctacttaagaggctgaggcaggagaattgcttgaacctgggaggtagaggttgcagtgaaccaagatggcaccactgcactccagccttggcaacagagcaagactccacctcaaaaaaaaaaaagaaagaaagaaagaaatattaatctttctagttgcattcaccaggaatgagttttggatttcttctatattccagatccctttaagatgtaccatgatgatgacctggcagatttggtctttccctccagtgcgacagctgatacttcaatatttgcaggacaaaatgatcccttgaaagacagttacggtatggcttcttcaaatggatttattctgtagggaaggaaaaaaattttttctttactcatctttggttcactgactagggctctgtgacaaaagattaacaagaaaaaagagaccaaagtttaaaatgtgaatttaatatgtacatgagaggtacctagggaatgagtaactccgcaagaggtggctttagaattccaccttatatagcttcttcaataaagaatgacaaattttttttttgagaggtgagaagatgaaggaaaagacttttgagtctctaggggccgcaaattgtgggagacaggtaaatggtaggtaaaagctagttagtaaaggttgctgtgtagattcctatggtgccatctccaggctaataatagccttcagcttaaaaaagtccttatgccaaagtagcgtattttggggtggcatattctggtgtcctttagttgtttaatgccaaacaatcaacatggcctttcacacatcacctttgaagctaaccactaagaaaagtcagatttaggggctgtgggtgtgacaaggctctctttggattaatcaaaggagacaattcacagattcacagttgggctgtcatctccccttttttttgagacagggtctcactctgtcacccaggttggagtgcagtgatgcgatcacggcccactgcagccttggcctcctggtcaggtgatcctcccacctcaatctcctgagcagctgggattacaggtgtgtaccactatgcctggctaattttttgtagagatggggttttgtcacgttgcccaggctggtcttgaactcctgggctcaagtgatccacccgcttcagcctcccaaagtgctgagattacaggcgtgagcctttgcacccagccacatttttctacttcttcatttacaggcagacacagtggctcatgcctgtaaccctagcactttgggaagctgaggtgacaggattgcttgagcccagcaatttgaaaccaatctgggcaacatagggagatcctgtcctacaaaaaattttaaaattcatccaggcgtggtggcacatgcctgtagtctcagctactcaagaggctgaggtggaaggattgcttgagcccagaaggtcgaggctgcattgagccatgatcatgccactgtactccagcctggacaacagagttgagaccctgtcttaaaaaaaaaaaaaaaaaaaaaaaaccatctgggtgcagtggcacacgcccgtaatcccagcactttgggaggccaaggcggatggatcacttgaggccaggagttcaagaccagcctggccaaaatggtgaaatcccgtctctactaaaaatacaaaaattaggctgggcctaatggctcatgcctgtaatcccagcactttgggaggcagaggcgggcagatcacctgaggtcaggagtttgagaccagcctggccaacatggtgaaaccccatctctactaaaaatagaaaaattaggccgagtgtggtggctcatgcctgtaatcccagcactttgggagacggaggtgggcagatcacctgaggtcaggagttcgagaccagcctggccaacatggtgaaacactgtctcgactaaaaatacaaaaattagctgggagtggtggcagacacctataatcccagctactcaggaggctgagtcagaagaatcacttgaacctgggaggtggaggttgcagtgagctgagattgtgccattgcactccagcctgggcaacgagcaagaatccatctcaaaaattaataaataaatataataaaaataagaaaattagctgggcaaacaacaacaacaacaacaacaacaaaactgctacaaagtattttaataaaattgtcttctaatgttggaaagggaggtgttaatctcattttgcagatgaagaaattaagactcgcagttttttactatagtatattatgttggttgtggtgttggaactagagttcaatcattaatattttgaatctttatattaccctttatatattatatagaaagtagccagtgaatgttgattaatggcactactgggatatactataccacctactaacaactagctaaaacctgaagaatgtcagcagtgtttcctttaaaacttgtttgcgttgtcggccgggcgcggtgtctcacacctgtaatcccagcacgttgggaggccaaggcgggtggatcatgaggtcaggagttcgagaccaatctggccaacatagtgacaccccatctctattaaaaatacaaaaaaattagccaggtgtggtggtgtgtgcttgtagtcccagctacttgagaggctgaggcaggagaatggcgtgaacctgggaggcagagattgcagcgagccgagatcgtgccattgcactccagcccaggcgacagtgcgagactctgtctcaaaaaaagaaaaaaaactttttttgcattgttttttattagtctgtgtcttcctggcaatatatgcagctgattttaaatatcaaatacctcttaggccgggcgcggtggttcacgcctgtaatcccagcactttgggaggccgaggcggttggatcaagaggtcaggagatcgagactatccgggctaacatggtgaaaccccgcctctactaaaaatacaaaaaattagccgggagctgtggcaggcgcctgtagtcccagctactcgggagactgaggcaggagaatggcgtgaacccgggaagcggagcttgcagtgagccgagatcacgccacttcactctgtctgcgtgggcaacagagcgaaactctgtctcaaaaaaaaaacaaacaaaacaaaacaaaacaaaaatatatcaaataccttttgtttccaatgtttactaagtttcaaaatgtatttgtttgtgtttcaatattaggtatgtctccctgcaacacagctgttgtacctcaggggtggtctgtggaagccttaaactctccacactcagagtcctttgtttccccagaggctgttgcagaacctcctcagccaacggcaggtaaactattagagactccctttatcagttaatggttgcagtattggtaatcaatataaatcatcaggtgtattttttagcagcttacagcaggtataaaaatttcagaacaatcacaaatgttttgcttatattagtgatatcaccactggaggaattaaattgttgaactataacacttagggttaacgggcacataaatactttttttaaattttttaacatatatatatttttttcatcacattttcattgtattaggtatcagaatttttttttttaattcagtacagatttacggcctggtgtggtggctcacacttataatcccagcactttgggaagctgaggcaggcagatcacttgaggtcaggagttccagaccagcccagccaacatggtgaaaccccatttctacaaaaaatacaaaaattggtctaggcacggtggctcacgcctgtaatcccaacactttgggaggccaaggcgggcagatcacctgaggtcaggagttcgagaccagcctggccaacatggtgaaaccccgtctctactaaaaatacaaaaaattagctgggcgtggtggcaggtgcctgtaatcccagctactagggaggctgaggcaggagaatcacttgaaaccggaaggcagaggttgctgtcagccgagattgcgccactgcactccagcctgggtgaaagagctaaataaataaataaataagctcagcgtggtggcgtgtacctataatcccagctactagggaggctgagacaggagaattgcttgaacccgggagccgagatcatgctactgcactccagcttgggcaacagcgtgagaccgtgtctcaaaaaacaaaaacaaaaattcagtacagatttagaactctggagtttttcttgataggaagcatgactgacctgctgtcccacagattatctttctaatactaattctgtgcccgtgttatttttgaagcctatgttttctctcttctttgccatttctcctccactacttgtcctcccagtattttacatcttattcttccaagtgttgagactgtcaaagagtaggcagaatatgttacttgacattagcttcttcttctttttttttttttttttttgagacggactcttgccctgtcccccaggctggagtgcaatgccgtgatctcggttcattgcaaactccgcctcctgggttctagcaattctcctgcttcagcctcccaagtagctgggattacaggcgcctgccactgcatggctaatttctgtatttttagtagagacagggtttcaccatgtttgtcaggctggtctcgaactcctgacctcagatgatccatccgcctcggcctcccaaagttctgggattacaggcgtgagccactgtgcccggcctaacattaattcttagttatgtgtacagtcttatggtcacaaaagccaaatactctcatgcctgaagaaagtaagcatttttaatgcaaaggtatgagtagacaatgatgtgtcctaaatttccaatttagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccaggtacgtgcttgtgcttattctcagtatttctctctaccaggttgtagtctcgagaagactaaggacaaacatcatgccaggtaaagtacagacagtcacactgtactttgcaagtttattcatactcctgctctcctagacaactctttcccgcctttaccctcctcccacctccaacaccttttctatgttcattctctgctgattgtcctgtttttcttgcagataagtcaagcaataaaatagaacatcgacaaacttctattccattatctacccaactacttgtatctgtatccatggtctctgcttatgaaagttcccgtttttataagtaaactgttcctgctcctaattaagaccaacctctcctcattttgccctagattccatctcctctttcctactcgatatattgccccatgtattcttcccttttttgcccctcataccaatttaaatcttttttcattggatcattcccacccatttaacaaacgtttgttatttttcccatcttaaaaaacgaaacattgaccgggcatggtggctcacacctgtaatcccagcactttgggcggccgaggtgggcggatcacctgaggtcgggaattcaagactagcctgaccaacatggagaaaccccgtctccactaaaaatacaaaattagccgggcatggtggcgcatgcctgtaatcccagctactcgggaggctgaggcaggagaatcacttgaacctgggagacggaggttgtggtgagccgagatcgcaccattgcactccagcctgagcaacaaagagtgaaaaactccatctcaaaaaaaaaaaaaaaagtaacataactagacataccttcccaacttcagcttccaactaccacttcactcctttgctgccccttgtaggagaactcctcagaaactaatcccatatccaatttctggcagatggaaaatagctgaaatcatgcttctctgaaacgtgtgtggcttttgttattacctttagaaaccgtcacaggaacggggaaaaagtgcagcttgccggccgaggaggattctgtgttagaaaaactaggggaaaggaaaccatgcaacagtcaaccttctgagctttcttcagagacctcaggtaagttaggaaaacaaaatgaactctttgaaacaaattaggggcgatagagtagtgatggtagacattgtctctagttccctgttgtatggtggtaatcagcagtatagtttatgaagtcaattctcttagacagattttatctggtttagacagaatgtcagcttgttatatctttaaaaattactactacagcaaatcaggatacctaattttttttttctccactgttttttttgttgttgttgtcgttgtttttttttttttgagacagagtctcactctgtcgcccaggctggcgtgcaatggcgtgatcttggctcactgcatcctccacctactgggttcaagcgattctcctgcctcagcctcctgagtagctgggattacaggcgcctgccaccatgcccggctaatttttagtagagatgaggtttcaccatgttggccaggctggtctcaaactcctgacctctggtgatctgcccacctcagcctcccaaagtgttgggattacaggcgtgagcgaccgtgcctggccttctccactgttttcatagtgaagaaaggacacccaaattttgatctggttcagctattcactattctatcctgtgtggtcttaagcaagttacataacttgcctatatctcagtttacttagctataatataaattaattggtcaaatgttctctaaagtcttactagttacagtgttccatggcccaacagcatctacattacctgagaggctggtagaaatgcagaatcttgggctctaccttaggcctttgtaattattatctgcattttaattagatccccagataattctaattttcattaaactttgagaggtactgctctaagatactttccaatttaaagtttgattattcagtgaatttgaagattacctgtttttaataacccagaagcatatgtatatgattatcaacttgattttctgtttacttttctgtgactatgattggaatgtggacatcctgacatatgggacataagggcccatgacttatttcacttagaatctctaatgctttgcacactacctagcacaagactagagcttaaataaatgtgtgattttttttttaaatgttgttttactgactcaacaaatcagtaaagatttatcaagtgcttatggtatacaaaatacaccatgttaaggcatatagatatttaagtccccgtccttgccccctgaattattatattataacctgaatgaagagataagttctcaggcatgaactctgaaacccaagatttacataataattgaataaaatagtataaaagatggcactgaatagctgctgattaattgctgaattaaatgttataaatactgggggatactatagcctagcaattttttgagcgatgcaataattaacctgagatattaaacaaaggctaggatttagaggatattggaggggtaaggacaagaatgaaatccactatttacatattataatattcttggaaatcaatttattgggtcagacttgacaggagctggcatatacctgctcttaatgagactcttgccaggatcttggatccatattatattaactgggaggaaggttagaccagatcacctgctgaaactcttccaaaggtactcatcttaattgttaaaattaattatcctacttaacattatatatatttctctgtcttttgggaagtacatttaggagcagaatgttgaaatttaacatatttgtctttcaaagtaggatgctctggttctggaatcatgagaatttttctctgaccaaaatgtggattcagtatattttgtgtgtgtgcgtgaagtgacttaagtctggccttctgatctagttcccagaatctgtctggtttgtttgacaagtattagtttaatattggtgacctagtcttagaattataaattttgtccaaaatcatgtatatttaactgaagcaattaataaatttcaccaaaaagaggcaagcactaagaatgaccaatataaatcagatgagatttacaggcagtaagtgcttatttttagaggttaaaagatgtgaaatgtttcatttttaaaagttcaatcctgctacttctgaaatttcaaatattttataaatgtttgaaaacaatctttacctgagatgatgatctgttaaatatttttgctagcgccagttaaaagtgagaaatgttttagaaaagactgttttcctgagcaaattacagtaagtactatatgtattagtgaaaatagcctccttaaattagtcatttatatggtctggtttttttgtttgtttgtttgttttttgttgtttttaagaaacaataacgaggagttttttgtttggaattttagccaacttcatgtattgcggtacccctcccacacaagccaaacaagtttgcagacccagtgaccgcaggtcaacccggcccaagcctgccagggtccctcctgagctgctgggaggctctcctccatggaagactcttgatcacaggctgggccactgctctttgtctgagtcaggttgggtctctggttcatcctcctgtggtgggcctgggaaccaaagaaaaagtattcatgttgactcacttgaaccccagagggatcttggcagggaggcctgggatatagaaagcacaccaataatgatgaagaaaaagaagaagaaaccaaagcaaaagagatattctcaaccacgggctggaggaccttcggatgatgacaatgcagataagcctaaaggtcatccatttgcagctgacacacaaaaatcaggtgttctccccagccagcctaccactatgggtacagaatatggacttgtatctggagaaaacttgaaaagggaatgtttagttaactccagtgcagccagactggtagctgagaactttgtctcagagagtctcagaattcctttatatccttctgaagaagcccccaaaactgcaataagttctcagtctaagctgagagtagaggaagagagcaaaagtaacaagtcagtactacaaaaccaagacaagaaattgctgaagcaacatgaatacaaaccacagcctgcaccccacctgaagactcctgtagataaaagccagtcagtaggccctctcaatctgaaaggacccctagcagaagtttctgcatacaatgtagaaacccctttggatatcagacttaaagagggttgctctcctttcttggaccaagaggttatgggtgtagtttcaaaacccacagcagcaaaagaaataccaaatttggtacccactttgatagcaagtaatccattagaatgtaatctaaaagaagggaataatgaaagtaaaatgactaaactgcagaatgtcaaactgaaggagtttcctgaaggagctgaagaggataaagaactaaaaaaggaagcttttcccaacgaaagacaagagatcagcatctttacttctgagcagctgcagggccaagtgttggtacaggtccctggggtagagaatgaaccatttaagagaatggcaggtgatggcaaaagcaggaagggaaggggaagttctgggaaaatgagaacagattctgggaaggtaaaagcaaaatctgagctgccatttcttctggacagccagaaggacggaagggctgttctcataccgagtgagccagtctctaaaactgaaggaatgactactcaggataagagtgaggagctggggctgaattcttcaaagcaaccaggcactaaggctgatctcacggaggcagtggtgatgggggagcctaaagagatgactcagcctaaggtggcaggcaccatgcaggcattgattcctttggaaagtggatcaggcatgactcagacttctggtgttagcacagaaacaggagatgtagtcaaagatatgggtgtcaataaccagagcaaggaaggaaggtgtccatggaaggatcatgaggcagctccctggatttctgaaaagcctaaaaagagaggcaatgaaggcaaaagcaaaaagtttaaaaataattattccacacagcctgctagaatggagaggaaggaagaaatccttaacccaccttttgaagggaaggatggagatactggtagtattccccataaaagcaaggaaataggatttactttccccaaaatgcatgattcttcgttctcacatacaccagatacacccacagtggaagcagttgacaggaagggtggaaattttcaggttaattttgttgagcttgggactcttggggaaaacaagataagcacagtcaaggcttctactgttactgaaccacctgccaaggtgacagatgtgagctgccaagagcaaatccagggggcaggatttgttccttcagtagtatctgaggagaataagacagatgcagccaatagatacactgcagtggctgacaaaccaagtaaaaggagtaatgatggaaaaagtaaaaaggttaaaaatagttctcctgagaagcacattctggagaataagatagatgcaacaaaaatacatgttcccatggaaaccacaggggaccagggaattgaaggaatggcctatatggacgaaaatagaaatattacatttacctgtcccagaacaccatcagagctgataaataaatcatctcctctagaggttctggaatcagcagcctgtgaaaaactgcccactcctactcctcaagtagtaaaggaaggtgattcctttccagataccttggcaaaaaatgggcaagagatagccccagcccagatttccaaatcattaatggtagataactacaccaaagatggagtcccaggtcaagaaagacccaagggtccctctgctgttgtgccctctacaagcacaggaggagttgctctacctattacaacagccatagaaacagttaacattcatggagatcactctcttaagaataaagctgagcttgctgattccatgaaaaatgaagcagggatcgatgaagggcatgtgataggagaatctgagtcagtgcacagtggtgcgtctaagcattcagtagagaaagtcacagagctagcaaaaggtcacctccttcctggagtgccagtagaagaccagagcctaccaggagaggccagagccctagaaggatatgcagatagaggtaatttcccagcacatccagtgaatgaagagaaagagactaaagaagggtctgttgcagttcagattcctgacttactggaagacaaagcacaaaagctcagtttttgtgaggaccaaaatgctcaagatagaaattccaaaggttcagatagtttgaataagaaggtagatctgactcttttgtctccaaaaagtgaaaatgataaattgaaagaaattagtctggcttgtaaaatcacggaattggaaagcgtttccttgccaacaccagaaatccagtcagatttcttacatagcaaagtcgaagctcctccttcagaggtggcggatacgttagtaataatgactgcttccaagggtgttcgactcccagaacccaaagataagattttggagacacctcagaaaatgacagaaaaatctgaatcaaagacaccaggagaagggaaaaaggaagataaaagcagaatggcagaaccaatgaaaggctacatgagacccaccaagtcccgaggacttactccacttttgccaaagtctacaatccaggaacaagagagacataagcaactgaagtccgctggtatgaacctgccatggggaaatgtgtgtgcttgtggcttttgagtcagcatcagaaaggcaaagagcttgtgtcttggctccatccagactctaatcatccttgttaatcattggtttgttggcatgaaacctataactgctacggtgtgttttctgcagccaatgtgttccttgtgtcctgcttgaggaggctggtaacttggttgcatgccttttttacccagcactgaacgttgaattttaggggaagttgaattttcaatgaattgtctaacaaaagacctatcatcatccatttcttaatttttttaaaattgtgcctcctatgtatcaagtttacagctaaattttaatcattacttggtataaggattcacaggaggaaagaaaatatttcatgtctagctatgtgcatgagatttttttcaatttatatgtagcttgtgctggtgggactaaatatccaaactgcttttaggttaaatgaaatcagtccacctccttatgaggaaatggtggcctcaaaccagcattggtaggcaccgatttatttgtgtttctagtaatgggaaatgatctctcaatgatacagatacattttttgaccagtttgttgcttatatccattgccccacagttccatgtgggtttgagttttgggcatagtctgtgtccatcaaacatagtccataaaacttgcccatgttgtgttcctcataattttactcttttttggctctattcagtcaagtaattggaatgagattaagaagatgattcctttaagatttagaaatggtagccccgtttccccccacccccaattccccaaaaaagtatacatttaatcgtggcttccctgaatctagctttcaaaaaatgttcccttgtctttgagatttttcacagcctacaagtgacactatttcttaatcactgtttcccagcttgcatgatgtagctactaactccagaatttaaaaaaaacaccaattggttttagtagccagtcaggcttttagagaggtttcatcatgggattgtgttctgcatggtatggacttgttcttttgggtaaagcttgtctatgcatgagtatgtacccactaaggaatactgctgtgtgagtaaagaatgctaaaggttgttatttgcataagacattctcatcttctctgtttttatcttctattagctaccctattaccaaggcagaaaatgaaatagtatgtagagggctttccagcattcattgagatttccagtgttctatccagttctttcgttttggtttctagacccattctttagtttcagcagtgatctaaaagttaacatgtaatttctgtgaaatcccagccatctctttttgctcagtatttccaaagaaatgcagaaagaggatttgtttttcttgaggaagcaagaccagtactgcagaacttttggggccctgcctgggtcaggtcaggctcagagactgtgttagcagtggccttacagagtgggtatgggaaggataatgggtttgggacaaaatttattgtttcttctataaattctaccacacctttcccctaaggacaatgtatacctttttaatagttaaaaaaaaatttttaaactaattgtcgaataggttaatacattcacatggtacaaaggagtatacagtaaaacgtaagttggcctccctccattaaccgccttccagctttccctctccagagcaaccagtgttcacaatagcttatatatccttccagacaatttatgtataataagtaataacatatatatttcctgatttcatataaatgagacgtatacatacatactgatgtgtgctattctttttaaacttaatttttaaagagatcttttaagactcagtataaagaagccaggcgcagtggctcacacctataatcccagcactttgggaggccgaggcaggcggatcacctgaggtcaggagttcgagaccagcctcaccaacgtggagaaaccccatctctactaaaaatacaaaactagctgggtgtggtggtgcatgcctgtaatcccagctacttgggaggatgaggcaggagaatcacttgaatctgggaggtggaggttgcagtgagccgagatcgcgccactgcaccccagcctgggccacaagagggaaactccatttcaaaaaaaaaaaagaatcagtataaagaaagaggcctcttttttttgtttttttttttaatcttttttcctggtacatgtctctagatatgactcattcttttttgatagctgtatactatttcattacataggtatatactaatgtattatagtactttttttttttttgagacagagttttgctctcattgcccacgaaggagtgcaatggcatgatctcagttcaccgcaacctctgcctcctgggttcaagtgattctcctgcctcagcctcccgagtagctgggattacaggcatgcaccaccacgcccagctaattttgtatttttaatagagacggggtttctccatgttggtcaggctgatctcaaactcccaacctcaggtgatctgtctgcctcagcctccccaaagtgttggaattacaggtgttgagccaccgtgcctggccagtacttctttactgatgcacatttaggtgtttcccaactttttttcattagaaatatggtacataaactatctttgtatctataggatgtcatcttcatgtgtgtgcgtctgtgtaataaaaaggggctccggagtaagaatctctggtttgaagaatatgtattcataattttgatgggtgttccatattgctctctgtaggcctacagagatgtcccttgtagagaaaggtacatctctactcccaccctcaacatagacaaatacctgtttccctgcctttctctactagtgtgattttttttttttttttggttatgtgtactgatctaatcggtgaaaaattatttcatggcatagattttgtgtgtgtgctgttttttgtttgttttttttgttttttgagatggagtttcactcttgttgcccaggctggagtgcaatggcacgatcttggctcactgcaacctccacctcccaggttcaagcgattctcctacctcagcctccctagtagctaggattataggtgcctaccaccacgctcagctaattttttgtatttttagtagagctgggtttcactatgttggccaggctggtcttgaactcctgaccttaggcgatccacttgcctcagcctcccaaagtgctgggattacaggcatgagctaccatgcctggctgtgttttattttttttttagtgacttcttcatgtattaacaagtttataaaagccaatccatgctctgaaattatgaaaatattttcttttctcttctattaatatttttcattttaaattgttggccaatctagaatttgcttgtttgtggggttttttttttttgttgttgttgttgttttggtatgttttgtttataaggttgtgaggcagggttacttggtcatcccaccatcatgtttataatcgatctcccactgaactgccacctttgtcataccctaaatttctgcatgtatttggtctatttctggactttctttcctgatccattgatctttccaccaggcttcctaatatattttaatatctaatagggctagcccaaccccttgccctattattctttttcagagttgtcctattcttattttttagttttgtagaagaaaaattaatccactcaatatttttcttgaagtcactgtttctagcttatcgtagggagagtttatgtcttgcatatcgagtttttctgtcgaacagcataatgtgttcacatgttttgttagtccatcactggtgtttatctttgttcctcactttgaatcattcatgttaactgccctgcccccatattgctaccaattctcacatatcttgttctcattcgtcttgtggtcaaatggtgtcacccatggtttccattgtttggacagtaaagatattacaaatggtgttggctgggcacagtggctcacacctgtagtcccagcactttgggaggctgaggtaggcaaatcacttgaggccaggagttcaagaccagcctggccaacatggtgaaaccccatctctactaaaaatacaaaaagtagccacgcatgatgttgcatgcctgtaattccacctactcaggagactgaggcaggagaatcgctctcttgaacccaagaggcagaggttccagtaagccaagatcacaacactgccctccagcctgggcgatagagtgagtgagactccatcccccgccccgcccctctctagcccccccgcccaaaaaaaaaaaagatattattagtggtgttagtaaaaataatagtacctctaactaatccgggtgttaataataatagcactggccaggcgcagcagatcacctgaggtcaggagttcgagaccagcctggccaacatggtgaaaccccatctctactaaaaatacaaaaattagctgggtatgacagcgcacgcctgtaatcccagctactcaggaggctcaggagaatttcttgaacctaggaggcagaggttgcagtgagccaagatcgcaccactgcactccagcctgggagacagagtgagactccatctcaaaaaataataataataataatagcacctaccacctattgagttgattttatttgcctggttatctggaaataggtaaatagatcatacacacacacataaaataacactattaaagattatctccatttttcaggtgagaaaatggaggctgtcaaggtcacatagctggtgaagtgccagggttagaatttgaatccaagtctttatgtttctaagatccatgcttttcttagacttgcttcagaagcttccggaagtttcaggtacttaaaaagaaaaagatgaaggttgacaattagtaaacataaaatagactttttttagtatctaggcactaattaaacacttttctacttggagaaataaagatacatcatgaaaatataaactgtgaattagaggttaatttaggattagaatctaggtcttttgactctgtctagcattttattgtccagagagtctgtgtttgatttatttacatgtactttttaacacccagcctagagctttatatatacatgatgcctaatgacattttttgaattataagtgaattatctttttgctgatcttaccctgtttagaagtagggaaagtgaatatattgccaaagtctcttccagcttactgtttgctctactgttattttttcatgctgctgtcaaatttagggaaactttaacagaaggtttctttgcatactatgcatgttcttccaggcagggaagattaatgcaatacgtcaggaagtctaagctcaacttttcagaaaaggactttttttttttttttttttgagacggagtctcgctctttcgccaaggcgagagtgcagtggcgcgatctcggctcactgcacgctctgcctcccaggttcacgccgttctcctgcctcagcctcccgagtagctgggactacaggcgcccaccactatgcctggctaattttttgtatttttagtagagacggggtttcaccgtgttagccaggatggtctcgatctcctgacctcgtgatccgcccgccttggcctcccaaagtgctgggattacaagggtgagccaccgcacctggccagaaaaggacttcttatgggattgtgttttttgtgaagggaagcacaaacttgaaaggatgatccacattagattccaatacccgctccatgttagttgttcccctggaaaccaagtagaactgtgagtgacagtgtacttgctatgctgctactgtgaatgggacagtttgggatccctgtaaataggccctccctttgccatagtgaagcctggtcttcttataatctggctttcatttctttcttcagtttgcttgagctcatcaactgtctaccagcagctgggaatgtcagtttatggtgagaaactctcttggtgtgaaacttgaagtaatttataaacccagaattctaacagtttcaaggcccttgtacataaataaaatatgctcagcagatgaaaaaaccatttgttatcttagaacttgctactattttacaactggagaagtacccatttggtaatgtcttttcttaactgtagtgccatttgtgaagttcctttcctcattactctcaccccacttgccctctgattcaactggcttctttttttttttttttttttttttttttgagacagagtctccctctgtcgcccaggcaggagtgcagtggcacaatctcggctcactgcaacctctggctcctgggttcaagcagttctcctgcctcagcctcctgagtagttgggattataggcatgtgtcaccacgcccggctaatttttgtatttttagtagagatggggtttaaccatgttagccaggctggtcttgaactcctgacctcgtgatccacccacctcggtctcccaaagtgctgggactacaggcatgagccactgcgcctgactccactggcttttttttactaccatgctgatgaaatttattgggactagtcacacaactaaaaatagctaccatttattgaaccttactatatactcattgccatcctaaactcttaacctccaaaaaatactgtgtggtcattaccttgtttgagccagaacatttaaatattctttgaaatgaatcaagcaacaattgattatcctactttgttttgttaaatttgtatttatttttttgagacaaggtatcactttgtcacccaggctgaagtgcagtggcatgatcacggcttactacagcctcgacctcccaggctcaagtaatcctcctgcctcagcctcccaagtagttgagactacaggtgtgcaccaccatacctggtgaatattttttgtagagatggggtctcactctgttgcccaggctagtctcaaacttctggcctcaagcaatccttcctccttggcctcccaaagtgctgagattctaggtgtgaggcaccatgcctggcttgaatatcctactttaaaagaagcttcttcccctcatattccctcacccttcacttgtaccctctggttgacaaatagcattgggggattctgaacacactgttaaaataaaaacttagttttgatttacagtattgcagatatagttatttctttaagatatggaggtgacagtaagggggcttccattcttttttttttttttaaatagggtcttgctcagttgcccaggctggggtgcagtggtacagtctcagctgactacagcctccgcctcctgggctcaggtgatactcccacctcagttgcaagtagctggaactacaggtgcgtgcctccgtgcccggctaatttttgtattttttgtagaggctgggtttggccatgttgcacaacctagtcttgaactcctgagctcaagtgatccgtccacctcggcctcctgaagtgtataaacattgcctattgctctgcaaatagcggacacacagcatgatttgtactttttagtatttagtttattcattcattcagtagataccaagtgacattactcctactctaaaaatagactaataaaacacattctatactcttcagagattccagggtggaaaacagacagttttcctctagtaagagaagtttactcctctgaaaaaggatagaagtgtgagctagatcctatggaaatacagagcagaaagggactaagttttcctacaagacctagagaaatcttcacacaggagactctgaaagtatggctaagagtttgctgagcaaattaaggtaaagaattctaggggacagctgtgtaaaggcatgcatagtgaagtgcaggtgcatggaataaagtcaagtttggggaaacagggacatctgttaaacattttgagatgaaattggggaaaagaaagtaagctcctaaaggatcctaggggtattgtgtgcctctaaaagcagaagatcttagatttttgcttgaagaaatgggttatctttctacctagtttagttggatgattctcttttcttttggggagggctatgggagggtccatactagacttaaaagaacaaagacttgatatttccaagttgtagtttttagagttgttgttgttgttgttgttgttgttttgagacagtctccctctgtagcccaggctggagtgcagtggcgccatctcggctcactgtaatctccacctcccaggttcaagcgattctcctgcctcagcctcccaagtagctgggactacaggtgcacaccaccgcacccagctagtttttgtatttttagtagagacagggtttcaccatgttggccaggctagtctcaaactccagcaggtgatgcgcctgcctcagcctcccaaagtgctgggattacaggccttagctaccatgcccggcctttagaggatttcttatccataagcattttcatgtctttggttcacatatatcagattattcgcctcagcttattcattctgtctgtttgcttctcatcctttttttaatcagggagaatcatgatttattttcttgagttaaaacatgagaaatgtttctaaaatgtagaatatggtttctgaaatagttttacctttatgtatgtatgtctaaacacttggaacgtttacttccagggaagaaactagattataacttgacaactttatcttttattaacaaggagtgagtgtcatcaatcattgttaatagtagaattattgactttcattgtaatgataattgtttcctggaggcaataactgggaacagttggtcaatctggaaagtagtgttgccttggtaactgataagaaagaatgcagagaaactagttgtctgtcatgtataaaaaccaaggccctgaacaggttaaatactaactccaagcacaaggctaaaacagaaatatctgccagtacatgtactgggattagagacctgcaggctttgccaagagtcctggaaaccaccttctgcccagacacacaggaatccatgcgctttcttcaaactcagacagaatggaatagaacttcacaatatttagctcaaaggacattccagatcaccaccgcttgggttgggttgaagacagctttaatgatggaacggatcaggtcaaatgatgcagatgcagtgtaaaaggaaactacccatcctttcactgagcagatcttttttgaaagcttatttactgtgagtcaagcactgtgcagtgcacccacatggcacaaatgcacagttcacattcctaccttctagaagctcctgggaaagtcatataaataaaagattacagtgtggtttctaaattctaaaaagagatagagtattatgataatataaagaactcaggaggggttcaaagagactttgcagaggtgagtgagtaggaataggacctagaggcaaggggccgggtgcggtggttcacacttgtaatcccagcactttgggaggctgaggcaggaggatcacctgaggttaggagttccagattagcctggccaacatagtgaaaccctgtgtatactaaaaatacaaaaattagctgggtgtggtgattagctgggacacctgtaatcccagctcctggggaggaagaacctagagacaaggaatcccagtggcagctgaatctaggacttagtccttctggttcttaagtgtgtttctttttacctaggcaggctcacccttttcaaacttcatgtatttacctcatccaccaacttgatataattttacagtggctgggagattggagtttcttgctgtggctatttcctgtggataaatctgcatccctgattgagattatgtctgtaattcttatttggactggagtactgaactggccattctcagggtgttctgtgggttgttttgttttgtttttaaacaaggtctctgtcgctcaggctggagtgcagtggcgtgatcatagttcactcactgcagcctcagactcttaggtttaagtgatcctccttcttcagcctcccaagtagctagtactatgggcatgcaccaccacacctggctaaaaaacatttttttcttattttttttgtatagatgtgggtcctgctatgttgcccaggctcttgaactcttggcctcaagtggtcctcccacctaacccttctaaagtgctggtgttacaggcgtgggctactatgcccagtctttcttgagttttactaattattctatactagggtttccccatcatttgtcatccaggtggcattcacctcatttggggtgcaacaaagccattaattattcttccatttaatatctttgtatgccttgcaaaagcaatagtgtaatcttttttttttttttttgaggcggagtctcgccctgttggcaggctggagtgcagtggcgcgatctcagctcactgcaacctctgcctcccggattcaagcaattctcctgcctcagcctcccgggtagctgggactacaggtgcgtgccaccacgcccagctaatttttgtattttcactagagacagggtttcatcacgttggccaggatggtctcgatctcttgacctcatgatccacctgcctctgcctcccaaagtgctgggattacaggggtgagccaccatgcccagcctagtgtaatgaaactagaagctactctgtcccttccccctctgtaaaagcgtctggttctctgctttttcttagtgaggctgaatctgtcttcctactcagaagccacatgaaaggaaacttacagtgctaaggcaccatagaaagatattaacataaatctaagttctcttaagactggaaattagaaacagaagtttgctaaggaataagtcacccacatcttactctttgcataattaaagcaggaccattctttcttttttttttttcccccccccgatatggagtctcactctgttgcctggcctggagtgcagtggtgggatctcggctcactgcagcctccacctcccaggttcaagcgattctcctgcctcagactcccgagtagctgggattacaggtacctgccaccacacccagctaattttttgtatctttttttagtggagacagggtttcaccatgttggccaggctggtctcgaactcctgaccttgtgatccgcccgcctcgacctcccaaagtactgagattacaggcatgagccactactcccggcctcaaacaagaccgttcttaagatataaagtaaacaccgaaaccaagtgcattgcctctttttctcccttacttcaaacacgcgtttgctcccctaaacacacatacatacacacacatgtgtatgcatactgtgtattaatttgggagttttggagtgatcacaaaagaattaaattataattccaaattaaagtttgaagtacttcaatgatcacaaaaaagatacattgggccgagcgcaatgcccacagctgtaatcccagcacttggggaggccgagttgggcagatcacctgaggtcagaagttcaagaccagcctggccaacatcgtgaaaccctgtctctactaaaaatacaaaaattagtcaggtgtggtggtgtgggcctgtaatcccagctactccggaagctgaggcaggagaatcgcttgagcctgggaggcagaggttgtagttagccgagatcatgccactgcactccagcctgggcaacaaagcgagaccccctctcaaaaaaataaagatacatcgaaaaggagagtcatctagtgactaagattaatttttgctcagcggtttgggaagactggcagtcagaaacctagcatcttctttgtggcttttccattaagttttcaccatgtgatcatgggcaaaccactttttttctctggacaccattttgttcctctataaaatgaggggtctgttagggaagcctcagcattctgactctgtactgtcacacatactttagtgtctttgcagtactgttgatggatataatggacccttgtcctaaaagggattcagggaataggttatttactttccttaggcagtgccccagattttgaaatttagcttttctttttctcttatctgttagtgattgcaattacgatttatatgttgtttcttgtgagtagtagtggttgttttgttttgtttttgtctgtctttaccagagtgcagcagttctccagtccagggacttaggctttctcacttttgttgttgttgttgttattattactacacatcagattccctatagggagtaggaaaacctacttcatatatatatatgtacagtttcttggttgtttttttgtttgtttgtttggagatggagtttcgctcttgttgcccaggctggagtgcaatggcatgatctccactcactgcaacctctgcctcccgggttcaagcgattctcctgcctcagcctcccgagtagctgggattacaggcatgtgccaccacgcccggctaattttgtatttttagtagacacggggtttctccatgttgttcaggctggtctcgaactcccaacctcaggtgatcctcccgcctcggcctcccaaagagctgggattacaggcgtgagccaccgcgcccggccttcttggttgtttttttaaagctagcatcagtagatacattatgtatttgtgtgttttaactactttgtcaaatgctttttatatatattccctcaatcctcacggctatgtgttttgttgtactcagacccctgggtgaccaccaaacttatctgtatgcctgagcacctggctgacatgatgtcttgggtactcgccccttctatgggcttgaacttcttgttctgaccgcccccccaccccagattgcttctttcaactctctgtctcctgagccttgtaactatgaagccagtgcttggcccagttgctagatgttgacctcataattatattttttcagtttgaccacatttctgatctacacagtatgaactgtagtctggaatatgcacttctttgtgcctgactagcttcattcttctggtttctgctcttggtcttttggctggttcacattttgcagtctgctgtttatggatagaattactgaggcagaatatgtgatatctgaaggtagcagagacctgtaattttagttattgccttagctgttgggtagggatgaactagtgaagtgggtctgggtaggctggccagaactaaaaataatttggctataaggaacaagtttctatgcttgttctttgccttggtattttccacttcttcagaatataagggccaactaccactttcttcagacatgctgcaacgtccgccatgcccagtcatgcctctgccaataggcagcactcccgcatgagacagaaaggttactgaagatactgcctagtggagtcccaggttgaagtcatactttgagctggacatagcagtgggcctgtgattacttgaatggctgtttcaacttcagaagtgaaagtggtaaaactgaatccaagagcaccttaaagattcccctccttttatagaggaagaaactgaagctaagagcagttaaatgagtttctaagactcttaactattaagtgacacagattttaaaatctggccttctgactcaaagtcaaattaattttttccccaccatgtcagtaaattaagggtgtatatgtgtgtgtcgtttgtggggggtgactagtttacacagaatggggttgttgaggcttacctgatttctaaggtattttccagagttttcctctggtatattcagactgtattacaacaatatcttcctcacccccttttttttttttttggacagggtttcctctcacccaggctggagtgcagtgatgtgatcacggcccactgcagccttgacttactgggctcaggcaattctcccacctcagccttctgagtagctgggaccacaattgtgatcaccatgcccacctaaatttttgtactctttgtagagacagggttttgccatgttgcccaggctggtctcaaactcctgggctcaagcaatctgcccacctcagcctcccaaagtgctgggattacaggtgtgagccatggcacccagccatctccagactttcataattttcctcacatattgtacatacttaattatattattcaattatatgtataaaaaaagaaagcaagaattcaactatgttgtattaccaaggcctttctgtacccaatctcgcctcatattttttcttttttttttattttttgagacggagtcttgccctgtcgcccaggctggagtgcagtggcgtgatctcagctcactgcaagctccgcctcgtgggttcacgccattctcctgcctcagcctcctgagtagctgggactacaggcacccaccaccatgcccagctaattttttgtattttttagtagagacagggtttcaccatgttagccaggatggtctcgatctcctgacctcgtgatccacctgccttgggctcccaaagtgctgggattacaggcgtgagccaccacacccggccaatcatattttttcttgttactaattagaatcatgattctcctggcattcttcattttgttatacctcacttccttttccttagcaagatctttgccatagagtatggaaaccaggttccttgccagttaatctgtattgtgctttgtcatgtattgttactaaacagctcaagatcaaggggaagaaatgtatatgaggctcagttcatgttcagtttttttttttcagcattgcaacattgccactcatcatcatgagtgtagccctgtgtcaggtactgaaggtaatggaaaaggtatataaggttgatccctgtactcttgttgggaacttgagtggtatgaatagagaaggtgagttcttggggacagaggctacagtttagcaagctttcctatgcggaccttggtaatttctttacattttatagaccaaagaacaatcttaacttgcccttttttctaaaggcattgtttaaaaactgtcatcaaatcattgcagtttatggcaaatggcctttttttaaaaaaaaaaaaaaagcaatctaaatcttttcttcatcttggaaaaagacttctcttggatttctgatagaatatttccagtatgctatgttattgcaagacagtaacttacagctagacaagaaaaatcagctttgttcaaagtaagagtatagcctgtccttatagtgtaatttttttctcacagttttgttttatggttccttcagtttgaatatacaatatttgagctcaaagcccagggcagcaaaggaccatgctgagttaaatgggggcagtaagctctggtgagtggggaaaactccaagctacaattgttagagtccctaagtctggaggtcagagaaagatgcactgcccccagtgtgttcacatgacacctaacagattattaggctggaaagagcagggcttggtagtggagggagcaacccagctcatccaaggaaccaagtgggggcagggacaggcgtaaatgcataaggggtatgttgtcacacaaatgtcttataattagaatatctatccccaaagccctgatcactgaagtctttaaatgaaccctttattaaactcttccattatgcagagctacagatggagctcttacgggttttggggaccccactcaagtcagttttcaagttagtttgataagttgctatgacagcaaacccactcttcctctgagaatgaatgcctgcaatcttaatactacgttaaggtgtggttttttttttttttttttagtccaattttgaacaatttcctggattcattgttcttcagggttatagctggggattggcaaatgagtctcggttatttttaaaacagttttctgagtggttgaatgtggaagggtgggcatggtatcagataaatgagtgtgtgggtatgcacgtatctatatcagtgaaagccaaaataattactatccttagtgcttggattggcaccatactgtgttttaaattgcagatctaaacagagtgctagttcacgggaaattacattctcagattaaagtagcattttgttgtgcagaaagcagcaggttccttcctttctttcgctttcattcattcttcctttctttctttctttcacatttgtaagtgcatttaatactcaactgcttgaggagagaggggcattgagggagagatgaattttgtcatgaatactggggaattggtgtgatgtcactgcaagctctgtgtgatcgtaggtggtattagagctccaggagcgaaagcagggagagcagtggaggagagacgatgtcgctctcagacaagcagacagcctctctcactgccgcgtacggtcagctcagtaagggcaagcctgcagagtgccgaatggactccccaaaagaaatcagtcaagccggattcgaatggcagaggacagagggcaaactgaatgaaattgggctgaatgtcagcatggacgggcaaccaaaagatgggcttgtgaagaatgccagcttcctggagcagaacaagctctgcttttttgaggggaagctagacaaagagctgagcattgaaatgcaggacaaggactgtcaagaagcctcaggtcaccttgagagcaggtatgtgatttcagagacctgccatcccttggaggggaactcggtacaccagaagacctccgagttccatctgggactcatagaggggccagacaaaaacaaaaccattccagttcaggggaaggtggcagggaagaatggactagagaccaagagccagtcagatctggatttccctggggctgctgacatccctaccagatatgttaaggagcaggaaaccagtgtttggaaccccagctttcatccagtggctcaaggctctctgggctcaagggaagcaactccgggagagatggagaatagcatcacccctggctgcccagtgattggggtggtaaatgataactctgagcagctgaagtgtgagtccccactcctggtgtctctagcccacccagcccccattattgagcattcacccaccaccattccgccaatcactatggtgttcacccaggaacatttgaatgcaagctgtcacatcagagaccatgataaggagttggagaaattgagttctaccgaggaggctgtgctcaaccaagccccccagcagaaaaaggcagtgcgcagggccctgtctgaatgttctcacctctcagttcccccagctgtcaaccttgcagataagtaccctgaactccctgcccgagaagagccttcttctggcctgctgcctccccctagtagcccaatgcctagtcctacacctgggaaactgggagctcctgctatgaagcgctccatgactgtgggtgaggaacagacagctagctacaaattgagccctgggaaactgcccatcttgtctactaaagagatacctcctttcatctgtgaggaaccagtggccaagaagagagaagaattggctcacttcagcaacagcagcagcaactctgggaagaaggaactcggcactgctggattatatctccatagtaagctggagcagattcctgaaggaagcagcaaggaaaaagggcaggaagattttagtgaaactagaattgattcatgctcgcaggtttgccagcgaggagagaaacagccaggacagacggctctggcagggaagaaagaaattgaggtcactgcaacccagagcactccatcgttcctgtttgaaaagcccccacgtgatggtatgtttctaaattttgcctccattgggaacaagcagacagcaaggaaggaaccaaagtgacagattaccggcagagcactaagcagctttttacagctgggttctgtgactgcctggggaaagcttaattcccttgtgttggaagcttgctgggagtgaggcaaggaagagaacaaagtgaatcttgcagggtcaagctgaatgtcttgctagcatgacagataatgtgaattgagtgtgcaagtttggggtggaatggggtcagagaatggtgggtataaaaactagaccccctttcttgacctcatgtcaccctgtccaacccatcccccatccacccagccctcagctccctgttggtttgaaccagatgattcctgagctctaaatccttcaatcccaactgattgatttccttgcttgaaaatctgtcactttatatagattcacaatgggtttatcagcactaacctcctctcattaagttgcacaatctgggtggaagctctgttttctgtttttgctttggagaacgttttacttttgttcaaactgaaaaagagccctttaaagctagctatttaatattctttctgtgttcttcatgtttgacccaatcttgcttctagttttctctttttgtatgtgttttgagaggatttgtggggagaaaaagaagaaagagaaagcagggagagaaggagagacttgcaacctaataaacagctaaattttgcggtctttgtgacagccttttgtgtctttcttcctggccctttcttttcttccccatctcccatccccccacagctcttattgtggtggtctaaaaaagcttgtgtttctccgagtccagtttgagcacaaagggccataattcacaaacttgtaaatggggatttaaaacatgtgttttgcttgtttaaaaaaaaatagtcttgtttcctgggacctgttttctctaatatttattactctcagtatatttttatgaaattgtactttttttctttgaaagtaagaaatggtattttctaggggagtggtaagtagaagacatacagatgttttgggttttttttttttatggagataaaaaacattttttgttttttatggagataaaaaacacgtttttttatggaggcaaagaagcttaatagttcctctttgatttcttatgactccagaattacaagcattcaggtgtcccatgctgttgcttccttctagctgggacagaactgtaagctcttcctggacaggactttgtcatctttttcttgatccccaggtgctttgttcagtaccacataacttctaggtgatcatgagtgaagactttgtttcagaacaagttctttctaattcagactaacagaagtttgtgctaatagaaaaaaatttcagatgactgacaaatccaccgatccattcacccgataaatgtttaaatgctgactctgctaaccactctgtagataaaacttttataggaagattgtttcatttaacatgcctaccatttgcattcactatctaggcactggaaattatccttatcctcaagcaacttttgatccagttggaggactgggaggcagtgggagggttgtgaattgtggaaacattttggaggaagtcacatttgaggtgggccttggaaccctgggatgccaaataatgcggagggaaagccttccaggcaagggaactcatattaaacaaagatatgaagcctagacagctcatgttaggtaaaagaacaatggaggaatctcagggcatccagtcacaggaaatgtggccaggctgctgccattgtgtatatctctcttgggacctctgcttctccctgcacatgtactccattctcttccctttaaaaatctgtatttcctctgtcatctctttttgcttcccttgtaactctgcccaggacagaatagcattgagttgccatggtttgagctctgtggccagctttgttaccaccatatatgtcagggttccgatgttgcatgactgtcatttccatgtctttgtctatactgacaatgagtgagtaattatatcttattggctcagcttggtccagtcaactctataccaggtcccatagccttcttaaccaatctgagccatttagacccacccgcttcattcaccttgaggcttctctaaaggagagagtataggttaaggaaatattccaaagccgtctttacatatgtgacaagaaataatgggagaaaattctagaaagttgtttggaatccaatcttgctaagcttcaaatgtcccactgaaaagtttaaagcttactactgtgtctggaattggtgggttcttggtctcactgacttcaagaatgaagccacggaccctcgcggtgagtgttacagctcttaaggtggtgcgtctggagtctgtcccttctgatgttcagatgtgttcggagtttcttccttctggtgggttcgtggtcttgctggctcaggagtgaagctgcagaccttggcagtgagtgttacagctcttaaggcagcgcgtctggagttgttcgttcctcccggtgggtttgtggtctcactgggctcaggagtgaagctgcagatcttcgcggtgagtgttacagctcataaaagcagagtggacccaaagagtgagcagtagcaagatttattgcaaagaacgaaagaacaaagcttccacagtgtggaaggggacccgagcgggttaccagtgctggctcgggcagcctgcttttattctcttatctgggcccacccacatcctgctgattggtagagccgagtggcctgttttgtcagggcactgattggtgcgtttacaatccctgagctagatacaaaggttctccgtgtccccatcagattagttagatacagagtttcgacacacagattctccaaggccccaccagagcagctagatacagagtgtcgattggtgcactcacaaaccttgagctaaacacagggtgctgattggtgtgtttacaaaccttgagctagatgcagaggttctccaaggccccaccagagcagctagatacagagtgtcgattggtgcattcacaaaccttgagctaaacacagggtgctgattggtgtgtttacaaaccttgagctagatacagagtgccgattggtgtatttacaatccctgagctagacataaaggttttccaaggccccaccagagcagctagatacagagtgtcgattggtggattcacaaaccttgagctaaacacagggtgctgattggtgtatttacaatccctgaggtagatataaagactctccacgtccccaccagactcaggagcccagctgggttcacctagtggatctcgcactggggctgcaggtggagctgcctgccagtcctgcgccgtggtgcgttcgcattcctcagcctttgggtggttgatgggactgggcgccgtggagcagggggtggtgcttgtcagggaggctcgggcggcacaggagcccatggaggggtgggaggctgaggcatggcgggctgcaggtcccgagccctgccccgcgggaaagcagctaaggctcagtgagaaatcgagcgcagcacttatgggccggcactgctgggggactcagtacaccctctgcagccactggcccgggtgctaagtcccccattgcccggggccagcagggctggctggctgctccaagtgcggggcccaccaagcccacgcccacccggaactccagctgacccgcaagtgctgcgcgcagccccggttcctgctcgcgcctctccttccacacctccctgcaagctgagggagctggctctggccttggccagcccagaaagggggtcccacagtgcagcggcgggccaaagggcccctcaagtgccgccaaagtgggaacccaggcagaggaggcgccgagagcaagcgagggctctgaggactgccagcacgctgtcacctctcactaccatgttctgaaactgtggtgactgcctatgatagcagataaagtagctccaggtcagctttaggaagatttacttgttctcagtaagtgtgatgaactggaagacaaagagttgaaagcaaacaatcctgttagaaatttgattcaggtagtggcagatgaaacgctgaggatatgagaggggaaatataacaggtgaagataaagtgaaactggaatttggaaggtgtgtgagaaaaaggaattgaaggtcatgctgtgatgtgaggctggttttcccagccagtggtagtataggtaatggaaagacccaacagaagagcacagttcattgaaggagttagtaagttccacatcagacattgcttttgtgaaactctggggatatgtgggtggtggtctctagaaattgcctgatagctgggcttggtggctcatgcctgtaatctcagcactttgggaggccttggcaggcagattacttgaggccaggagtttgagaccagcctgagcaacatggcaaaaaacccatctctatggaaaaatacaaaaattaggtgggcatagtggcatgtacctatagtcccaactgtttgggaggctgaggtgggaggattgctcgagcccaaaaggacaaggctgcagtgagccaagatcatgccactgtgctccagcctgggagatagatcaagatcaggtctcaaaacaaacaacaaaaaagaagttgccttatatatccatgagacaagggaaagggcttggtgagaactaccttctgggagagagaaagcagtttctgcttatgcacagttacatttatttgtataggtcgagttactgcatgcctgtatcatagacaatgcgactttatgaaatatgttgtttactgaaaaatgctgaacttattgaaaaatatttatagtggtctggggccagtggcagctagttacacaagtaagatcttctttgagcttgctgtagaacaaaggcattagccgggcgcggtggctcacgcccgtaatcccaacactttgggaggccgaggcgggcggatcatgaggtcaggagatcgagaccatcctggctaacacagcgaaaccccaactctactaaaaatgcaaagaattagttgggcgtggtggcaggcgcctgtagtcccggctactcgggaggctgaggcaggagaatggcatgaacccaggaggcggagcttgcagtgagccgagatggcgccactgcactccagcctgggtgacagagcgagattccgtctcaaaaaaaaaaaaaaaagaacaaaggcgttaacaaatttgcacagttgttggctatggtttttccccattacattttaaaactagaaaaatactcagtttttgactaaaagtacatatggttcaaacatcaaaaagtacaaagtgctctccattacaaaaacctcctaccaagacaagatggtatcatctcattgttttctgctcctcccctgtaaatacaactaaatagtctggaaataattgaagataattccataaaagaatatgaggtagaaagaaggcaaacctggtagggatctcaggacttgaggaatggcaatacagtgaattccctgggactgatgaattgattgattgattgattgattgattgattgatggtagagatgggatcttgctatgttgcccaggctagccttgacctcttgacctcaagtgatcctccttgcttgacctcccaaagtgctggtattacaggcatgagccactgcgtccatcccctgggttttctttttgtctcctacatatccctggctgggcactggagaggcctgtaacctggaattaccaacaggcatagactgaaaagaaaaggaaaggaaaaaagaaaacaaatagagaaaatctgttctctattgccaaaaaaacaagaaagaaaaaaacccagcaaagacctaatggtgagccctgtttcactacccatccccagcagtgggctcagtctgcctgcaggtacagtgtcaatgcagcccataagggccttcctgttgtccactccatactcagcagaagctataggcctggtccgcccacatcaccagcaactgcagggaggcctgtcccctaccaggtaacagcaccagtggcttctatagccctggtgtcttgtaatcctctacccaggggcaggagactttcgtaggtttcagaacctctacttccttccccttagcaagagaaagcccccgaggtaggtgtttcctgctcccagcaaccccagcagagatcaaacaggaggtctgcctgggtcccaggcagccagagagcagtccagaggaagctctctattctatgtttccagcatcactcagcccctatgtgctgacactgggtgacacaggtaagtccctacagccctttcaggcagtaccaaaagggattagttagaaccttagcagaatcagaacacaacaggccataaatgcattgcaagggctctaggaaccaaattgtcatcagaactacagtcataacctgtagactaaatataaacagggtgattgcatgctaaagtacaaaatcagaattttaaagcagccatcataaaagtgctttaacaagcaattatgaattctcttgaaacaaatgaaaactaaaaacctcagtaaagaaatagaagttacataaaaagaaccaaatgttaattgtcaatatgaaaaatataataattaaaattaaaaacttcaatgggctcagcagcagactgcagataacagaggacagaatcagtgacgttgaggacagatcaataggatttattcaatctgaacaacagacgaaaaaatggtctacaaggaaaaaacatatcttcagacccatgggacaataacaaaagatctaacatttgtatcatcagaatctcaggagaggagcaaggatgcaaggctgaacaactgttcaaagaaataatgacaacaaacatcccaaatttgacaaaagacaaaacttacagattcaagcaactgaacaaataccaaataggataaatgtggagaaatcatgccatgacttttcataattaaacttttataaactaaagacaaaaatctgtaaaaaaagcaaagagatatgatgcattagggaaacagcaatttttttttttaaccttccttatggtgctgaggaaacagcatttaaatgacagcctgtttcttatcagaaactggggaatgcaaaaagaagtggcacaacatttttcaagtgccaaaagaaaagaactgtcaactgcaaattatttggtaaaacaatccatcaggaatgaaggggaaataaataaaaaagacatttttagataaaggaaaactaagaatttgttgctagtagacatacccttagagaatggctaaaggaggctctccaaaaaaataagatttggtaacagaaggaggcttggaatttcagaaataaaagaacaacaatggaatgggtaaaaatatggaaatagccaggtatggtggctcatgcctgtaatcccagcactttgggaggccaaggcgggtggatcatctgaggtcgggagttcgagaccagcctgaccaacatggagaaacccccgtctctactaaaaatacaaaattagccgggcgtggtgacgcatacctgtaatcccagctactcaggaaggctgaggcaggagaatcgcttgaactcgggaggtggaggtcgtggtgagccatgccactgcactccagcctgagcaacaagagcaaaacttggtctccaaaaaaaaaggaatataatagacttatctcctcatgaattttttaaagtcataaatcatatttgaagcacaaattgtaatgccatctgatgtagtgcttaatctatgaagaggaaacacttaagacatattttagggctgggcgcagtggctcacacctgtaatcccaccacttttggagaccaaggtgggtggatcacctgaggccaggagtttgagaccagcctgggcaacatgacgaaaccccatctctactaaagataaaaagaaaaattagccaagcatggtagcgcacacgtgtaatcccagctgctcggttggctgaggcatgagaatcacttgaacctgggaggcagaggttgcagtgagccgagattgtgccactacactccaacctggacgacagagtgagactctgtctttaaaaaaaaaaattaaagtagggagaaaataaaggatcctaaatggaagtaaggttccagtaggtcactcaaagtagtaaaacatagctgggtgtggcggtgtgcatctgtagtcccagctactcaggaggctgaagacggcaggatcacttgagcccagagtttgagaccagcctgagcaacacagtgagaccccatctctagaggaaaaaacagtagtagaacattgataccagtttgttgtatgtatattgtaatacctagagcaaccactaagaaaactatacagagcaatatactcaaaagcttttttttaataaaaatagaattctaagaaatgttcaggtaaccttgggtgagatgtaatttgaaaaaatgaaaaaaggaaattaaaaagattaaaaatgttcaggtaaccaacaggaaggcaggaaagtgaaacagaaatgagaaaaagagagaacaaataaaaaataaaatatcagacttaagccttaacatagcagtaattattttactttatttcatttatttttttatttactgagatggagtttcactcttgtcacccaggctggagtgcagtggtacaatctcagatcactgcaaccttcacttcccaggttcaagcgattctcctgcctcagcctcccaagtagctgggattacaggcgcccaccacaacgcccggctaatttatgtatttttagtagagatggggtttcaccctgttggccaggctgatctccaactcctgacttcaggtgataagcccacctcggcctcccaaagtgctgaatggattacaggcgtgagccactgtacctggccatcaggaattattttagaagcaaatggtctgagtactacaattaaaagacaaagattggaagagtatattatttttaaaaaatgactcaagtaggccaggtacagcggctcctgcttgtaatccctttaggaggctgaggcagaaggatcacttgagcctaggagttcgagaccagcctgagcaacccagggagaccccatctctacaaataatttaaaaattagccaggcatggtggcacatgcctgtggtcctagctattcaggagctgaggtaggaggatcacttgaaccgaggaggtagaagctacagtgagtacagtcagccatgatcacacctgtcttaaaaagaaaaaaaaattgcccaagtatatgctatctacaagaaatgcataacaaacataaggacataggtaggttgaaagttaaaagatggaaagaaatatatcatgttaacaattttttaaagtagcagtagctatatataatgattatgcatatatatatatatatatatatatatatatatatatatatatatatatatagttgttttttcttgttgcccaggctggagtgcagtggcctgatcatagctcacagcaggcttgactcgctgggctcaagcaatcttcccacctcagcctcccaagtatctgagtcttataggcatacaccaccatgccccactaattttctttcgatttttgtagagaggaagtctcactttgttgcccaggctagtctcaaactgctggcctcaagtgatcctctgcctcagcctcccaaagtgctgggattaaagattacgtgtcctggagtgactatactaacatcagacaaagtagatgtcggagaaaagaataaaggatcaatcccactaagattgatccttacatttagaaaacttagcaattctaaatgtatacacaccaaaaaacagagcatcaagatatatgaaacaaaaactgacagagctaaaaggagaagtacacaaagtcacaattacagctggggacttctgtaacccactatgaacagttgatagaactactagacagaatgttagtaaagatgtaacagtgccatcaaacaacaaaatctcataaacattgatagaaattccactcagtgacagaatgtacattcttctcaggtgtccattaaacactcaccaagatggatcttgggtcataaaaccaacttgaatcaatttaaaagattgaaattatgatggggcatggtggtttgtgcctataatcccagcactttgggaagctgatgtgggaggactgcttgagaccggtcagtttgggccacatggcaagacctccatctcttcaaaaaaattttttttgtaaattattcaggtatggtggcacgtaccagtagtcccagctacttggaaggctgaggcattagggtctcttgagcccaggagttccaggtggcagtgagctgtgatcatgccactgtactgcagcctaggcaacagacttcatctcttaaaaaaaaaaaaaaaaaaaaaactgaaattggaattatttcaggtatacaaggttagtgcaataatcaaaagtaattgtcagccaggtgtggtggctcacacctgtaatcccaacattttgggaggccgaggcaggtggatcacgaggtcaggagatggagaccatcctggctaacatggtgaaaccccatctctactaaaaatgcaaaaaaaaaaaaaaaaaaaaaattagccaggtgtggtggcgggtactgtagtcccagctacttgggaggctgaggcaggagaatggcaggaggcggagcttgcagtgagctgagatcacaccactgcactccagcctgggcgacaaagtgagactccatctcaaaaaaaaaaagtaatctgttatagtctgaagaaaataaattgtaaacacagaaaaatcgtttaacagaatcaaatagccattcatgttaaaactctcagcaaagtaggaatagagaggaacttatttaacttgacaaagagcgtctacagaaagcctacagctaacatcatatttaatggtgaataagtgaatactttctatctaagattgggaacaaggcaaggatatctacttgcaccactcttttaaatatagtgtactggaagttactatagagatggagaacatagtagttgccatatatttagggattggaaaggggatggggtagatatggctatagaggggtaacatgaagaagccctattgattgtaaccagccactccaggccaggtaatctgtaatcccagcactttgggaggctaaggtggtggtggtggttacacaaagctacacttgataaagttgcatagcactacacacacaaacacacacacacacaaatgagtgcatgtaaagtgaaaaatctgagtaggctctgtgggttgtctctgtttcttggttttgatagtatactgtatttacgtaggatatcaacacttggggagactgggtaaaagggtacacagggaccttccctatgtatttctttgcaacttcctatgaatctgtaattatttctcaaagttttaagcctcctaacctccccagttttgtgtcccatcctttccctcaaaaacgttgttctgtttaattacaatcctttcaaaaattcttttaaaatgcatatataagtgtatttgcaatatcttttccctcatcccttttcaagacaaatagtttcacattatacttatgctttgttgttttttttttcacttaatagagaccattgcatagtaatcataaaagaatttctccatgctttattttttcacattcagagattacattgatatttctaccataataaccagttttctattaacggacttctgggttgttcttttgcttttagaaacaatgatctggtggaaaccttgcacatttactatttggctggtgtgtaaatacacttctaggataaattactagaaattggttttctagattagaatttatctgtccttgtaattttcagaaaatgacactgccaggcagccctgcctatgggtcatacagttcacatacctaccaagtatatttccctatattattctcagtagttattttaaaattttaggacttttgacaatatgttaatattaatggcatttcaggccaggcatggtggttcatgcctgtaatcccagcactttgggaggctgaggtgggtggatcacttgaagtcaggagtttgagaccagcctggccaacatggtgaaaccctgtctctactaaaaatacagaaattagctgggtgtggtggtgcatgcttgtaatctagctacttgggaggctgaggcaggagaattgtttgaatggggagacagaggttgcagtgagccgagatcgcagcattgcactccagcctgggtgacagatcaagactttgtctcaaaaaataaaatggcatttcagtggggtttttttatttttcttatacttaacattgtacatcttttcatagtttcaaaaaactttgtatctcttttctataaagtctgttcatattgttttgcattttcccagtggattattggcctttgtagcagttactgatttgtgggagtaatttatagaataagctctttgtctttggtatgagggtcaagtattttttctgtttgtcatttgccttttgacttttattatagtgttttgtcttattttgttttttgccacattgaagttttttatttttctttagtcaaacttatctcttgtggcctcttgactttgtgccagttagaaatgccttcccccacagcaaggttatacatttcacagtattttaatgctctcaggtatagtcctattgaaatccagagtaacctctccacagagaggaggctatgttgccttaggcaggagactttatttctggccctgagtctggttccatgggtctccttggccttgttgaaaatctgggtcactgttagaactggatcaggttaatctcacatcctccataaagtggttctttatagggaaaggaaggaaagggagtcattgaatgatcttctggctcttatcccatctcacagcaacctttattccaaagatagactggtagaagaggtttttgtcctattgcttggagagctagtggttggaagacagagtccctttggtctctagggaagggaaaccaaacttaaaggaccatttttttccactgatcatttgtgcatgtgtcccttagactgcttctccacagggtcaggctctctgaatctgaggaatctaaaactgtcctccatcacaatgagaacttgggaggcttgtccacatttcagcagcacaaccctgtggacttttttcagaatgaagtgctagttagtggtctgtctttgctaaaccttgtattttcaaaatgggcatgtaaaatgtttgcttagcataattcccactcaccctctccccttaggaatagccaggccagaagaaggaaggcctgtggtgagtgggacaggaaatgacatcaccaccccaccgaacaaggagctcccaccaagcccagagaagaaaacaaaggtaggtgccagaatggtggttatcttctactgccataatttttaaacggagtatcttctgctgttattgcttgaatcacgaatgaaatttcttttttctgagctgttattgtccttcctcatgtttggacatgcttagaaaatatcttgtattctcatttaccacagtggcctaaaccaactttaaaatctcagcctttgaccctattatcttatatatctgtaaaaaatgttctgtagaggccgggcatggtggctcatgcctgtaatctcagcactttgggaggccaaggcgggcggatcacatcaggagatggagaccatcctgaccaacatggtgaaatcccatctctactaaaaatactaaaattaactgggcgtggtgatgcatgcctgtaatcccagctactcaggaggctgaggcaggaggattgcttgaaccaaggagttggaggttgcggtgagccgagatcatgccactgcactgggctccatctcaaaaaaaaaaaaaaaagttctgtagagattgtttcaacttcccttaacaacaacaaaaaggacaattgcaaaaatattctgaaataaattctgaattatttactattatctcagcgttagatgaaagaaaaaaaaagattctgaaatatccattcatgaaaagagaatgcagattttgaaggtggatcatatagcttcagatgcataactagtacttattgcaaagttcaaaagccacactgtaggctgtggctgctattgtcccatcaagatacaggtagtttcagcatgttgtccagggtcttcaaaaaattaaaaagttattaaaaaaaatacaggtaataatggctgaatcacctcctgatgcttttcttttagaatagccaccaaaagttagttaattattaagagttaattgttttactgaattaaatcttcaggtgccaaactgccagaatttgtgccactatcattaagaaactattcccaggccaggcgcggtggctcacgcctgtaatcccagcaccttgggaggccgaggcgggcagatcacaaggtcaggagatcgaggccatcctggctaaaacggtgaaaccccgtctttattaaaaatacaaaaaattagctgggtgtggtggcacacgctggtagtcccagctacttgggaggctgaggcaggagaatcgcttgaacctgggaggcagagcttgcagtgagccgagatcgccactgcactccagcctgggcgacagagagagactccatctcaaaaaaaaaaaaaaagaaagaaaaagaaaaagaaactattccccattttctttctctatcctggtttcattccattatttattgagctcagaagaaagaaatgctaattttaagttgcatctatcctcattgcttataattttactttgaattgtgcaatttatactttttttaatttgtttttattcttgtctgtttgatgttgccctttaaaaaataaaaataaaaaataaacaacaatcaacctaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaaggtaagtggtcacctaactactgtgccgaggaaaattgttcccctctgagtgtcagatagacagatccttgttgctaacagacaacagaatcaggctggtggaattgggaaaaggcaagggaaatgggggagagggtgatttgaaaattggcatggctactctggacgcgctgcctatgggttagccctgctccacgaggagcagccaaaaaaagaaaaaagaaaaggaaatcaatttggggcccattgatgcagacattaacattttgaagcccttttatgctcttacctttcccttccctgtttggaggtaatactctatctacttaggttcttcctcctttctctcagctacctactctttacctatttaagcacttattaaccagtttcctctactccacataccagttagatattcttttttggtataattcccacatcaaatgtaattctttgtctttccctgttatcatcctgcagaagttttatccattactattgtgatataactagttcttccagcttatctcagcatgttccagcatgatgtgataacttactttgctttgggcattaggccacctctcactgagctacttctgaagtcatccagttttccaggtcacccacggtttctgtattgcccagaaactggtcacatttggagcagcattagtgttacagaattgctccaggaggagaggatagtggaggctgtggctgcattccttaacatcttgtgttatttgagaagggcctttaggtcagcctgatagtactctttaaattcatggtacgaaatagtttcccatgttaaaatgtcagtttttaatttaatatggtgaagaaaactgtggaacctaggagttgaagtctaggctgaagccctggccaagaaactgaaaaatcctctcataaactagtaatgataaaatcttgtaaagctttctctctgatcctcatttatccagttggttgcttttcttgatctttagaaaacaataggtttgaataagagggcagaggggaggtgcctggagccctggcagcaggtcctccctgttgcttattcagcagcggcttctggggggtgacagaggagagtaggaaggagaggtgtctagtgaaatttcactctataataatcatataaatgaagtgtagtgtactagttgctgtatatacatgaacttttttttaatttttatttttttgagatggagcctcgctctgtcacccaggctggagtgcagtggcacaatctgggctcattgcaacctccacctcccaggttcaagcatctcttgtgcctcagcctcccgagtagctgggattacaggcacccgccaccacgcctggctaattttttgtatttttagtagagctggggattcaccacattggccaggctggtctcgaactcctgacctcaggtgatccgcctgcctcggcctcccaaagtgctgggattacaggcatgagccaccgcgccagtcctgttctaatctcttttatccagatgaggaaataaagctcagagaggcccagcgatttgccaaatagcacacttagaattaaggggccaaaccaggactgcagctcaggcttctgacccagatttggccagtggcctcttcatctgcagcttattttggtagaaagatttgtagagacagagagagaaaaacctattcagaaaaaataagtagattacgattctggcagagaagaaaatgtaaattgggaaacagcagaatagctccagttaacttctgcaggtttttgaagccaagagcctgacatctaaaagatgcaacatccttttgagatttctatcccacataacttttttctaacttattttatcattattaccctcatggcaaaataataagactatgctagattattctgaataatagtcatagtcttaaaaatttgatgcacatcccagagagcatctggtttagtcctcaaattttagagcaatagaaaagggaatcctctggccaaaatcctacatgtttccagcagagctggtagcagaaccactttccctgattccagccttagcgttcttcacaccatacttaaggcctttatttgtggaaattgtcattaccctacatttgcagagttagactttggatgccagcccttaatttctagtacctccttagctgatttttccatttaacgatatcctgcttgtcgctacctacatactgccctctttatagccacttctcttggaggaagagagctgagcccactgtgtctgtgatttggcatactctcttttgtaatgtggtaatttgtttatcaaaatagtgtcttcatcccctatccccgtagaaaccaggctaaactgattctttcccttattcactagagacgtcattctcagcctccatgtaaaaggaactagagtgacccagatgccaagcatctatacttgagagactttttcccttttgctttcagactgtagctgtgatatcagtgctttttatcccttctgttgatcaggcctgcctcttctcatcgtctctgtgctgagacctttcatcctttatttcctgacatcacatattatcaaagctggtccttcatcaccctccattctaatctctttatcccgatgaggaaataaagctcagaggctcagtgatttgctggagtagggctacagctcacgcttctgtcccagatttggccagtggcctctccatctgcagctcagtcctgttcagcattctctaggtgcgtgttagccaaaagaatggctcgatttgaacataatttttagtttttgtttgtgtatgtttaatctttggtcaagtataatacattagattttattacattaaatacattagtatttttggcatttctacagaggttacattaaaatatatgcgtgtgtgtgtgtgtatgatatatatagcagtagatttggaggcaaacgtaggttgtggtgatgtacccatcagggctgttcattctcactggctcaagttggattgaagtagttttactctctgttgtgtgccctcagatcacatagcaccctgcatggccagtttgttgctttatgtggaggactttgctcttagaaccatatgtattttcctgtcagtagctgctgaacccacagtacctcctgttctccaatacatggttgtatagacacatcttgtgtccaggtgcagtggctcatgcctgtaatcccagcactttgggaggctgaggcaggcggatcatgaggtcaggagatcgagatcatcctggctaacacggtgaaaccctgtctctactaaaaatacaaaaaattagctgggcgtggtggcacgtgcctgtagtcccagctactctggaggctgagtcaggagaattgcttgaacctgggaggcggaggctgcagtgagccgagatcatgccactgcactccagcctgggcaacagagtgagacttcgtctccaaaaacaaaacaaaacaaacaaaaaaagaagcatcttgtagcgtgactccttggggctattgctgacctgcaggcctcattcccactttcctatttccagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactggtgagtattgcctttctctcccatgggaactagggaggggaaaatgggatcttggctttgccccagccatagctctagctagtatcacaaacagctgtgcaggcctgcttacgcaccggtccttagtggactacctggaacagtggtagccctgtgggcctggtacttaacaagccttgatctctgtgtgagcttagcagttgtatgtattcagaaaaatcttgagtgaaggcagaaaaatgtactgctcatgaatttccaggtagaatttactcttgccttagtaacccacagcacctagcacgtggtgctcatgggcttacatgatgataagaagagggcgtggtgctcatgggcttacatgatgataagaagagggctattcaagtccataggcatgtattgacagcctacttttaaggccacatagaaggcttatcagggcagtagagaagaataagactcagtgcctgaccatctaatttaccactccattcccagggactaacacagtccctggctcaaagtagatattcagtaattgttaaataatgaggaatctcactattggatgaactatccaacaggtcagtttgttaaatgttatattaataagtatattttgtacagccattaagactgagggaaaacctgcagaagtcaagaagatgactgcaaagtctgtaccaggtaatagcccatccgccattttgtagagccctaacttgaacccccacctcctctgtggcttaagtctccctttttctctctctccctgaacccgtgttatctctcactcccttctttgcagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggtgggtccagggagcttggggtcctggcatgctggcccctgcatcttcccctccatttccacccactgttcccaggcccaccaaagaagcaggcagtcaggacactggactcagcatcagggtatttcagccggggctctgtagtgggttttgtgccccagcagcagggaggcggggtaggctgagctctgggctttctcttcctgtctcagtaagaaaggctcctgttctagatgttggggtctgagtttacatttttgcttggatgtaaaaggattcttttgtagaagaaacagaggaggcctcagagactctgcaagtgagagagacacttgacatgagcctagtttttcatggttcttagcctgcacagagaatgtcaggataggcagaaggtagaacacctcttacttccacaacccatgacttgagtggaatatatctgaaagaggactagggtgtcctcttatggccaggatgagtcgtgctgtgagcctctggccttcctaaacagcaggactgcactgcatatagtgatggagaaagatcacagtgcttcacttttaggattttccggtggttaagattttctggttgcatcagtcccagaattatttaactgttggtaaccatgggaactctgcgtgaaaaggtggtgatgaaagtccgtctgagaatgttcgggtccctggagtagtgaccatctcatctcctaggtcattcactagctctacaccaccaccaccatccagggcagcatacttaaattgcttaatctggagctgttaagaaattcaggagggacaaaaatgaggtggaatcctggtgctgttggaagacactgatggcaagctgagatcagtctagagaagagcctgagagttgcttgtggtagcgacagtggctctggtgtgcccagcaggcctctgggctgtgctgctgatggcctatctccccgtctttgctcttatggtttcatggtgcaaaagttacaggagttcttgggtggggagttgagtgacttgatctagtgaattgttttctgcttcaacatacctaaagagtctgacactttctatcagtattgacttcctgtgaccgtggcagctgcttggggcatatcaggacatttggcatggggtggggggtattgtaattggaaaatcatgccccagcacactctcagaatcactaatttggttgtcttagccttcctttgtgccttttcttcattagctagtgtcttgatctgttcctcatgtcttaagactatggcctgcagctccttcttttgtggtcctctactcaaggatctttgacttggtctaccctgggaaatgtatggttttgcctaggatcaaaggccacctgcttttgcctggtggcctgacctggatttgagtcccctacagccttcttcccttcttggcttttgagctcttatcctcttggtttgaaatttgccctccctttatctccatccaggccaaagtagagaaaaaaacagaggcagctgctacaacccgaaagcctgaatctaatgcagtcactaaaacagccggcccaattgcaagtgcacagaaacaacctgcggggaaagtgagttttatttagacccacctctgcaaggtgaagatggtaaaatacttcttccagcctgagccacatgccctctcttgcactttttccctttccctaactagtttctacttcttctcccctatattcccttctctgtgcttgatgactcggccatcagaaaattttttgtattaaccttgaaagttaatagagttgggagcccattagccctttggagaatacatatgtgtataatttttggctggataaaatggatccaaagactttcattcatttccttcacactgaccttgatgtgaaacctacctggtatggatgcaaatacagtgcacccacattcgttatcaagaagacatggcaggggtaatttccaccacctggaaccctggagcccctgtgctttaccttgaagtagaagatccctctcataacgctgctgggtatggagataacttcatttgtcctggttccccgggtcacctcttaactgaaagttaggatgctcattcccaatggaaacccacttagtataggtatgcagcatcaactggagggcagaggtaagctgaaaccacaggttctttccccttgcctctgtaaacctggaaaccaggcccctcctgagtgcttgcaacacctaccttccttagctgtagcaggtaggtgtgcctctgccagagaagcccgcactccagcccttagggaccagcatgggaagtctcagcctagggcattcctacagtgaagaaagctgcaccgtggcttctgggtgactactagaggtcctaggttcagaccaaggctcattaagtagtttgctaaccacttggttaccatcaaagttgtgaaaaaggctagaaatgagtaggtacaatgaggtatatgggttggagtttctcaggatttctgtactctgtggagaactcttcagcctgggacctgcatcatttgcaaagaaaggaagttggcaactattccttcttgagaaggtcctaggattctttgttccagactcttagagccagggccttggtgtttctcagttccaggggaagccattcccgtactatacagtgtggttgtgcccccaggattgggcgtccttgctgccctgcttagagcctgttctttccgcatgggcatctcacagggcagaggattaggcatatggaggattcaagaaggtattttacccttgagtcaaaaatactatgccttctcgagccctgagacaaatgggctaagtgtggaggctgtagccgctcccctggtgttggagattctgtatccatttgtatgcacatctgagcactggcccctccttcctgttagtatcatccgtgcccttgttgccagctgcccagtgcttctcagagcagcctttgcttctgagagtgggtctggctgcagccattccagggcccagatttaagggaagcaccctctttgggtgagaacaggtccacatgataagacttgcagagaagagccaaggacactgtgcccagctcttgaggagggagcagagcaaggaggtagggctgtgcctggttgggcatcaggttaggctgctgcctgggccttgtgaaccacaaccccgcccccaaaggagcggtgatgaccaacatgcagtgcctgcgcagctctgctcctgtcgttgtgttgtctgttcacgtttttcactccccttcttgctctttcacatttcttttcctgtgcttttccacatctgttctgtagaaggtgggggtggaggtttaacaacactttttgttggtcattgtgatcacgtgtggactcactgccttccctgtgtcggttctaaccagtcctctccctttgtgttgttttttctattttctaacactccaggtccagatagtctccaaaaaagtgagctacagccatattcagtccaagtgtggttccaaggacaatattaagcatgtccctggaggtggtaatgtaagtataagctctggttagctggcatctgagatatagcccactgtggggtatactagggagagagccaggtgcccatgtagatagaatcccagtgacctgagctgtagcgttctgtaagaagcagactagcaaagtgaggggaccttgatgctcccatgttagacagggtgtttctggtgagcccctaaacaccagcatggtgatatccactcagtatctttttacccatatgggtgggaggctttggatttttctccagctatgtcagagcctgggtctgagcacagtggtcagcagcagacctgttgcctgtctggagtccgttcctgggatgtgtatgtcggtctgcatgcccttgaattaccgtggaagtaacttctctgagacagatgtctggatggatctttccagagctcatctttgaatccttgttattataaaataagaattaatcaacattttcttcctatcccttccccacgtttttttgagatgaagtctcactttgttgcccaagctagagtgcagtggtgtgatctcagctcactgcaaccaccacctcccaggttcaagctattctcctgcctcagcctcccgagtagccgggactgcaggtactcgccaccatgcccggctaatttttgtatttttagtagagacgggatttcactatgttggccaggctggtcttgaactcctgacctcatgatccacccactttggcctgccaaagtgctgggattacaggcatgaaacactgcgcccggccctcccatttccctttctgctctccttttttttgtccattttctaatcccttcctcctttttcttcccctccttttttagtcccttttcctgtttttttgtttgtttgtttgtttgtttgtttgttttgtttttgttttgatacagagttcactctgttgcccaggctggcgtgcagtggtgtgatctcagctcactgcaacctccacctaccagggtcagtcaattctcctgcctcagcctcccaagtagctggggctacaggcatgcgccaccacgcccagctaatttttgtatttttagtagagacggggtttcatcatgctggccaggctggccttgaactcctgaccttgtgatctgcccgccttggcctcccaaagtgctgggattacaggtgtgagccactgcgcccagactttccctccttatctttttgtcctctttcctcttccacccaaacatccttctttttgtcttgctgccattgtgtgccagctctatgatgtgtattagggacacaggtgatcccagctcacagggaggttctggtctagggagagacagggcgaagtcttactatcgtcgagtgtgtgaagaacaccctgtgtgctttccgcttgtcactgtgacagtgcctagaaaagtggtactctgtggagttgtgccagaggcaccagaagccgccatgtacagcccctgccctcaccgctcccttccaggccaagtgagacagcctgtcttgcctccgtttcttttgagttcattcggttctttctccttactgtcctgaaccggactaggtcctgctccacttacccttatcatttttagactctgttaacactcctgcctcctccttggtgatcatgacatcctgcccatggcctacagatacccccagcagttgtatcatgaggaatgcggccatgagctttcattcttgccccacacaactccttcctgcccctccttcctggtcatcttctcaccactgcctcttcctggcctgggtagaaatggcatcctttacactcgggtggaattgcttgaccagactaattagtcagcctggaataggatcagctgaagtgaggtgacaaagatccagcccacgaggggcccaggcagctgctgagcctggctttgtcctggatgaaaacagaaggtgaacaggggttctgagggaactgggtcacttgtgtaggtgagacatagagatatatttgtgtgtgttgtgtggtgcatataagagctctgaaaatagtcatcattaatgtatcacctgctgtgatctttccacactgcctacacatgacctcacatgtgtagggttttttgttttgttttgttgttttgagggtgaatgtatttttaaagccttttcactttaggaggcttccttaaacagagaattagggagactactgtgagccatctttcctggtgggaagatgaggataaacaacagctgaccacagctggacccaggtgctttgtttccttccataatctctgtcagtccctccctaaagccaccacaaggaaatgtgcagtttaaaatgatgagccccccagctgggcaccatagtaagacccccgtctctacaaaaaaaagtcttgctctgtcgcccagcctggagtgcagtggcgtaatctcggctcactgcaacctctgcctcccaggttcaagcgattctccttcgtcagcttcccgagtagctgggattacaggcacctgccaccatgcctagctaatttttgtattttatgttatgttatgttattattttatttttgagacggagtctcgatctgtcaccaaggctggagtgcagtggtgcgatctcggctcactgcaagctccgcctcccggattgatgctattctcctgcttcagcctcccgagtagctgggactacaggcgcccgccacaatgcccagctaattttttatattttttagtagagacggggtttcaccatgttagccagaatggtctccatctcctgacctcatgatccgcccgcctcggcctcccaaagtgctgggattacaggcatgagccaccgcacctgggctaatttttgtacttttagtagagacggggttttgctatattgggcaggctggtctcgaactcctgacctcaggtgatccacccaccttggcctcccaaagtgctgggattatagcaagagctactgcgcccagtcccaaaaaaaatatcttttaaaataaggccaggtacagtggccctgggaggcccaggcaggaggattgcttcgaaaccagcctgggtttcaaagcaattttaaattagacatgtgcctggcagcattaggtggcatgtgcctgtggttccagcttctcaggaggctgagaggggaggattccttgagcctgggtagttgagactgcaatgagccgtgatggcaccaccacacttcagcctgggtgacagagagagacactgaaaaaaaagggaggaggacctgctgtgcagacagaacagcattacaccccccaccactccccacacacacacacacacccacacccacacacacacacacagaaataacgcagttaccacagggatgagaggctccaaacaggatcctagttagtgctccaaaaatgcccccgacagacagacagacataccccttgatgagagccaggaggacaccagcggaggggagggaggggagtgatgagccagtgccaatgtagtggcttcttctgtggctggtcccagttaagattttgtgtccgttttggttccatttcacccttgcaaggggctgtgcatgtgtagtgggcactgagacctgctgacagcatgttttggtacctggagtgtgcctgcaggctctcatagagcggcaggcagcctgtgtaagcacaagcagagcaaggtgtgtgatgccgtgattgctcctaggaccacagagagccagcgtggcttctgcagtccccgaggaggggacacttgggccagcccatgaaggaggcgccgcacatggttccctgaggctggagcatagagtggaggcagggtggtgtgggggaatcgtttggaagcagattgtagactcctccacatagccacctaaggagggagagctgtagcctagaggtggtggactttattaaagtgagtgaggctcagttaagctttttaaaactttttactgggctgggcacagcggctcatgcctgtaatcccagcactgtgggaagccaaggcaggcagatcacctgaggtcgggagttcaagaccagcctgaccaacatggagaaaccccgtctctattaaaagtacaaaattagccaggcctagtggtgcatgcctataatcccagctactctggaggctgaagcaagagaatcgcttgatcctgggaggcggaggttatggtgagccgagattgtgccattgcactccagcctgggcaacaagagcgaaactccgtctcaaaaaacaaaaaccaaaaaaaaaaaaaacaactttttattgtgggaattttcaaacacagacaagtagaaaaaaacagtaaaatgaacctgatgtaccttttaccctgcctcatttactatctacatgagcagtcttggtttatctgtatatgcctatcccaagtattttgaagccagtcctagatatattatttatttgttaatacttcagcatatagctgggcgcggtggctcacacctgtaatcccagcaatttgggaggctgaggcaggcggatcatgaggtcaggagatcgagaccatcctggctaacacggtgaaaccccatctctactaaaaatacaaaaaatcagctgggcgtggtggcacgtgcctgtagtaccagctactcaggaggctgacgcaggagaatcacttgaacccgggaggcagaggttgcagtgaggcaagatcacgccactgcactccagcctgggtgacagagcgagactccgtctcaacaaaaaaaaaaggaaaaaattgatccatatatttaaaatagtaacactaataagataatacaagctataactcttttaatcttaagctgtttttactctacaagtccccactccattctttttttttttttttttttttttttttttgagacacagtctcgctctgtccctcaggcatgaaactataacacatttaaaatcatatttttgtataaatagctttaacatttcaagttatttctctaggatatattcctaacataggactcttatgtcagaaactacatctgtttcatggtgtgggctacctaggtttttttttttttttttttggagacagagtctcgctctgtcacccagactggagtgcagtggcgcgatctcggctcactgaaacctccgcctcccgaattcaagtgattctcctgtctcagcctcctgagtagctgggactacaggcacccgccgccacgcccggctaattttttgtatttttagcagagatggggtttcaccgtgttagccaggatggtctcgatctcctgaccttgtgatccacccacctcggcctcccaaagtgctaggattacaggtgtgagccagcagctttttttgttttgttttgttttgtttttgagacaaagtctcactctgtggcccaggctggagtgcagtggcgtgattttggctcactgcaacctccgccttctgggctcaatcaattctcctgcctcagcctcctgagtagccaggattacaggcgtgcaccaccatgccctgctaacttttgggttcttgttcttgttgttgttgttgttgttgttgttttaaagacagagtcttggctgggcgtggtggctcacacctgtaatcccagcactttgggaggctgaggcaggtgggtcacaaggtcaggagttctagaccatcctggccaacacagtgaaaccccggctctactaaaaatacaaaaatcagctgggcgtggtggtgcgtgcctataatcccagctacttggaaagctgaggcaggagaatcgcttgaaccaggcagtcggaggttgcagtgagttgaaatcatgccattggactccagcctggcgacaaagtgagatttggtctcaaaaaaaaaaaaaaaaaagacggagtctcgttttgtcacccagggtggagtgcaatggcacgatctcggctcattgcagcctctgcctcctgggttcaagaattctgtctcagcctcccgagtaactgggactacagtgcccaccaccacacccagctaatttttgtattttttgtagagatggggttttaccatattggtcaggctggtcttgaactcctgacctcaggtgatccacccacctcagcctcccaaagtgctgggattacaggcatgagccactgcgcccagcctaacttttgtattttttagtagagacagggtctcactgtgttggccaggctgttctcgaactcctgacctcaaatgatccacccgcgtcagccctcccaaagtgctgggattacaggtgtgagccactgtgcctggctcattcttttttttactggtaatttccttgatgggtaagctcagtggtttgtcctagaatctggattcttctaattacatcctcatggttttaattaacatattctgttgtccctcaattttctttaaatttatttggttttggttttttccccacatgctagcatgacatgtaagtaggtaatgaggtttattctgtgagaaattacattcatgtctcattcttcggttgtctctttttttgtgatgttggcaattcctggacctgtgggttcagtaggcatatgccgtggtaagactaattctagcattacttcttcatttaccagctggaatacatccataatgtgaaactgactgcccctcaactattctttaattgcatactagacaaaaggtcaagagatagaggcttcaaatatggaacactgtctagaaatctgtggccctggccgatgcagtggctcacacttgtaatccaagcactttgggaggccaaggcaagtgggttgcttcagcccagaaattcgagaccagcctgggccacttggcgaaaccccttctctacaaaaaaatgcaaaaattagctgggcatggtggtgtgcgcctgtagtctcagccacttgaggggcttgagcctgggaggttgaggctacagtgagctaaggtcatgcctctgcacttcatcctgggtggcagagtgagaccctgtctcaaaagaaaacaagaaagaaatctgtggctctacatcttggtgagggccctgggcttggagagtgactgttaacttcttgcaggtgctgttgtggttacagctaagatgagcttgtcaccattgcttgaagacccatgttgggttggtttaagcagctaccagatctttggctggtaaaagtacccttccctatgccctctcttatgggggataaggatagggagatgtttggatgaggtcttcatgtctccctcttcttgaattggccatttcttcccctaacaaataacaagataccttgttttaaacccagataaagcacttacagtggtgtcatcagcacatacttaggaggaggtatctgtgctgtatcctaaacttccattttggagatgcctataaatatctgtataatgaactatagattgaggagaaaagaaaaaaatttctatctagggaaaattgcagactttttggaaagatgagacaaagtagaggctgtgtgttttcacagtagtaactactctgtatgtaattatcaaacacgtgaagccattatggtatagttcctggtggtgtcccttcaagagatgatatgagaaagagacggattgaagcgagagctatgtgaggccgtatggaaggcaccttttgagctgggcattgaaggatggggaagaaaacataatgggtttgctgggttaggcatgagccaagttttagaggaaagattgagaatggctctggcaagctggggattgtgggtagttattctgtgccaggccttgggctgtgggtgcaaatacaaaaatactggtggcattatatctgtcctctggaaacatggtgaagactatatttcctgacaccaaagaagggaaaacagggctcaagaaggtagctcaccatttaacagcttgtggtgaaacccaccagaatggtgcaacactgcatggagttgatgtgttggaaagtcaggctctcccacagtacctaccagaggacagcggggccgctcacaggaatgctggaatccccatccagcaacccagagggcatgcatggctatagacttaaagatgcaccaccttttttttttgaggcggagtctctttctgttgcccaggctggagtgcagtggcacgatctcggctcactgcaagctctgcctcccgagttcatgccattctcctgcctcagcctcccgagtactgggactacaggcacctgccaccacgcccggctaattttttttgtatttttagtagagacggggtttcaccatgttagccaggatggtctcgatctcctgacctcgtgatccgcccgccttagcctcccaaagtgctgggattacaggcgtgagccaccgtgcccagccaaggtgcaccacctttaaatgcaaatttttgcatttttagtagagatagagtttcactgtgctggccaggctggtctcaaactcctagccacaggtgatctgcctgcctcagcctcccaaagtgctgggattacaggcatgacccactgcacctggctgggaaaattgttataacatggattaagcaggaatactatgattacacacacacacacacacacacacaacgcgcacacacacacacacacacacacacacaccaccccctcacctctcccaaggggaaaatgcattgaaaaggactagaagtaaatatgttattccaggttctctgggcaaggagttgataggtaaggatttgagatggaataaaggggatatttcatgggagccttggtgctggtgtttggacctggtgaaatgacagaagagctgtctggagcatgcatggacagggtctgcacagaaagacctgtggggtgtggaaatggtggtttggtctggctggaggtggggttagaagtgaaggctggtggccgggcgtggtggctcacacctgtaattccagcactttgggatcctgaggcaggcggatcacctgaggtcaggagttcgagaccagcctgaccaatatggagaaaccctgtctctactaaaaatacaaaattagctgggcgtggtggcgcatgcctgtaatcctagctactccagaggctgaggcagaagaatcacttgaacccgggagatggaggctggggtgagccaagatcgtgccagcctgggcaacaagagtgaaactctgtcttaaaaaaaaaaaaaaaaaaagtgaaggccaggcgtggtggctcacgcctgtaatcccaacactctgggctctggaaatctgaggtgggtggatctcctgaggtcaggagttcgagaccagcctggccaacatggtgaaaccttgtctctactaaaaatacaaaaaattagccagatgtggtggtacacgcctgtaatcccagctactcgggaggctgaggcaggagaattgcttgaccccaggaggcggaggttatagcgagctgagatcgtaccactgtactccagcctgggcaacagagcgagactccatctttaaaaaaaaaaaaggaagtgaagagcagggccagggtgggtcgagggctcttttaagtacttagggagatgaccttgtctttgaccagactgagatagcagcttacagagggagcgagaaaccctgaacatggagaagatttaaaaggtagcatggggttggctctgacagtataccttctctctgaatgagtcttttgtgtccttctcttcaggttcagattcagaacaagaaagtggacatctctaaggtctcctccaagtgtgggtctaaggctaacatcaagcacaagcctggtgagtggtgcctcccttgcccactgggtctccagggtatgtcgtcctgccatgggtcagctgggcagccagctggctggcaagggtttcatctctgtgcctttagcatcccatgaagactacccaggacaccacagtcctcattctgtcagggagcaggagttcgggtgctaacctctaagtggaggaggagcagtttcttacagcagccatctgcacaggcattctcttgagtacctactgtgtgtgtggaactattgagctaggcctggggaagtggtgcactctgagctgagaacctggattggctctaaacgaggattacagaagctactgctgaaggagctgtatagagggcagtgttcaggtcccacctatcagatgcaggagcaaagggtgctcccaaccagtgaagcatcagccgctagccctggcaggagaatgggaggcgttcagcaacttgcactaatgcagtttccttccagcaacatggttggcccagcgcccctgtggaagtcgctgtgcggaggctgggctcttgccttgggtagtcccctagcagcctcgtgtcctagttcctgggtctacagcagatttgtgagtaggactgctgtagcagcaggcacactggctggcagacctggtatcccagaaggctagccaccacaggccagataaggtgaaggcaaaactctcttccctcagggcgggcgcggtgtctcatgcctgtaatcccagcactttgggaggccaaagcgggcggatcacttgaggtcaggagtttgagaacagcctggccaacatggtgaaaccctgtctctactaaaaatacaaaaactagctaggtgtggtggtgcatgcctttggagaattgcttgaacccaggaggcagagactacagtgaggcgagagtatggcactgcactccagcctgagcaacagagcgaaattctgtctccaaaaagaaaaaaaaaaaactccctttccctctcagcgaagagcatgatccagtttagaatgtgttctatttagaaagatcaaaacagttctgtccttaactaaccatttttttccccttttatctgggaaatctcctatcagatacttccttctctaatgacactgagtcacttagggtctagtttttgccagggctgggtttcccaatatgggacaccgggagacctcggccagaagctgtgcgtggaggtctgccatgtgagctgagaggagatggaagaacaggagaaggggcccaagggaaaccacgctgctgggcgcgggaggggctgggtactcattgagggcagctcgtcccgcacccttccccttggtctcatgggcacactctggccagtgagctctgaaccctgggcgtgagttcagaccactttccctccccgtcctagcctgaggtcactagatcccaggcctgccttggtccatgtctttccttcctcagcgcacagcctcggggccactctgtcctttttattattccttctttttgctagagtgtggtacggtttagggtctcagacaattttcacaacctgtcactgtcaatcagcagattggtggtaactctgggtgagtcccttctcttttgcagcatcagttttaccggctgggaagcagggaccgtggccgtgatgacagggcattcatgagaattcagtgaggctgtgcctgagaagcactgcatggcccagttagcgggagggcattcccacacagagtagagaagcagaggcttcgccctggaggctgtgctcggagccccaggcctgcccaagcctggcctgcagctcagtggctgtggcatggggtggtggaagggatggctttccttttcttggaggtattcccactggctggacggagagattgtctcagcctcactgtgatatgagaagtcctctttagacaaacgtgttcactgttcttcatttgccacccagaacaggtcacgtctgtctcatttctagattgggcatatcgctagtcctggttttgcctgcagggatattcctctgccaccctaggtgaccagttcctttgtggttccaggtggaggagatgtcaagattgaaagtcagaagttgaacttcaaggagaaggcccaggccaaggtgggatccctcgataatgtgggccacctacctgcaggaggtgctgtgaaggtagcgagtgggtcactggggagacacagctggggaggggtgggaactatgcagttagggtcagggtcctcacaggtaggcacctgtcaccgcccctcagtctcttcaggagtcatgtcttcacccacaccattgccgttttcccaccgtgtatcatcagtcctgactgaggcagaagtgaagaggccccagcccagccacccctcacctgtcagctggaggcagaaccttgctcctgagagccatggccttcctaattgagcccatccagccatttgagaaggccacggactgggacacagaccacccccaggcgagcgggggttctgcaccacacagttctccccagctgtctcgcgccaaggggaatgtgggttcccgccccatgtcaggctccgctcctgggttaggagcaggacagcacattcttagctgccagcgacagcaggctgcctggggcctccctctgcagggcctgcctggggcctccctctgcagggcctgcctggggcctccctctgcagggctctgggacagagctcaagtggcagaggttcccatcctcacgactggctgggcctcttctcccttccctctctcctctttcctcccttcctccttccacagtactgtgagaccttttgtgtgccaagatgctgtctgtcctatgttccatgtcatccgtgggtggggggcccatgaggggcatcttgcagaccccgagcacaaggatggctgctgctgctcgggttcaggtgcgcaggggagaggggccaggagccgctgccctgggccttcccttccatctctgctccccagtgccagccactgcccagcccgtcccctgtcccatcctctcctgatgctctgactgaagccttgatcagcttccaggaacatctgggggggtccttgctgccacaggctctcagttcgtgccccccatacctcgtgaggatgccgttctcacgcccgtctcagtggggcgttaacttggctttagtctcttttccaaggacacagcgagcgagcgtggaccaggattcacatctgggcttttctgaccctaagccttgtgttcttttccttgttcacattatatccctttattagttctggaattattgtttttaatcgaggcctatttctcactatgccgattagaaaccacttctcccttgtcactttttgggtatttggcgacacacgctttccagctccccagtggcctctcgcagctgttctctcttctctgccttcctcacactgagtgttccatgtcccccaaatgtcctcctcctatgacgccctccaggcctccacagtgtccctgggttatacctccttggacacctttctgcctcccatggacccctggtcccagaatggtgccccgcacagacaaggcctcagcacctgtgttcctgaccagacagatgtgcaggcagggctgcccgggagctactgaggaccccactctgtgtgcagggggtggcctgggttcagggagggtttgggagggtgggctgtacccttcagggggctacccttcaggcttattgcttactgttgtcatggctacgtctttggtaccagcctgaggcctggcacctctgccctcagagaggcttcatcagagcctcacatgccacagaggggctctgagagtgtgtcactggtccagctgctcctgaccctcgggagtcggtctcccaggtgaggtggggtgggtggggccggggcacctgcctgggattctccaagcgactgtgccttgagccagtgggtgccagggcagcaagggtgggggctgtgtgtgaaacccaccaccatcaccccatcccactccccccctcgactgaccctgcactgtctcccccactgtttcattgtagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagtaagtggctgggctcggcctaagggccagccaggggccctgccactggccgcaaattgaaactcctttgtttttgactagagtgtggcctaaattttaatgaagtaaccttttattttccaggcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatcacgc

(The sequence listing continues in the following parts.)

What is claimed is:

1. A method for treating a tumor in a subject, said method comprising (i) determining the subject as responsive to treatment with a proteasome inhibitor by (a) obtaining a sample from the subject, wherein the sample comprises a cell from the tumor, (b) measuring the level of expression of Fc gamma receptor 2B (FCGR2B) in the sample and (c) determining the subject as responsive to treatment with a proteasome inhibitor when the level of expression of FCGR2B of the sample is greater than or equal to an FPKQ cutoff of 75 and (ii) administering to the subject an effective amount of a proteasome inhibitor.

2. The method of claim 1, wherein the proteasome inhibitor is carfilzomib, bortezomib, or oprozomib.

3. The method of claim 1, wherein the tumor is a hematological tumor.

4. The method of claim 2, wherein the proteasome inhibitor is bortezomib.

5. The method of claim 3, wherein the hematological tumor is a multiple myeloma.

6. The method of claim 1, comprising measuring the level of expression of FCGR2B in CD138-positive tumor cells obtained from the subject.

7. The method of claim 1, comprising extracting RNA from CD138-positive tumor cells.

8. The method of claim 1, wherein the sample comprises CD138-positive tumor cells isolated from bone marrow cells.

9. The method of claim 1, wherein
the subject (i) has previously been treated for multiple myeloma or (ii) has previously been diagnosed with multiple myeloma or (iii) is a human patient having or suspected of having multiple myeloma, refractory multiple myeloma, or relapsed multiple myeloma.

10. The method of claim 1, wherein the method comprises use of a kit comprising one or more binding agents to FCGR2B gene or gene product.

11. The method of claim 2, wherein the proteasome inhibitor is carfilzomib.

12. The method of claim 5, wherein the multiple myeloma is relapsed multiple myeloma or refractory multiple myeloma.

13. The method of claim 1, wherein the proteasome inhibitor is disulfiram.

* * * * *